United States Patent 12,397,048 (BUNYAVIRALES VACCINE) - sequence listing, part 3

SEQ ID NO: 3571 - RNA, 5067 nt, synthetic construct
  misc_feature 1..5067: note = derived and/or modified CDS sequence (wt) from CCHFV(Turkey200310849)__DQ211636.1__GP
  source 1..5067: mol_type = other RNA
atgcccaccaacattatgcatacactgttggtgtgcttcattctttacctacagctgttgtgtctaggaggagctcatgggcagttaaacacaactgaacacaatggaacaaacaacaccacagcacctggcgcaagccaaagccccaagccacccatgagcacaaccccaccacacgcaccggaatcatccaccatcaaacccaccacaccaataagcgaagcagaaggctcaggggaaacgacttcaaccccaaacaccacccagggcctgtcctcgccagagaccacatcagaacgccctgcaacaactgccataagcacgtcaagcacagacagcacgaaccccaccacacagatgaccgacaacacccccacactaacagtcagtacaagcccatccagcagccccagcacgccatccacaccacaaggcatatatcatcctgcaaggagtctattgtcagtctcgagccctaagacagtaacaacaccaacaccaacgagccctggagagatgagctcggaaaccagcagtcagcactcagccatgagcagaataccaaccccccacacagcaacccgggtctccactgagaacaccaaccacagcacacctagacaatctgaatcctcagcacagcagacaaccccaagcccaatgacttccccagcgcaatcgatccttctaatgagtgctgctcctacagctgttcaagacatacatcccagcccaacaaacaggtctaagaggaaccttgagacggaaataattttaactctatctcaaggtctaaagaaatactacggtaagatactgaagcttctgcacctcaccttagaagaggacaccgaaggcctgttagaatggtgtaagagaaaccttgggtcaaactgtgatgatgacttctttcaaaagagaatagaagaattcttcatgactggtgagggctacttcaatgaagtcttacaatttaaaacactaagcacactaagccccacggagccgtctcatgccaggctaccaacagcagaacccttcaaatcttactttgctaagggcttcctttcaatagattcaggttacttctctgccaaatgttatccaagatcatctgcttcagggcttcagctgatcaatgttacccaacacccagctaggatagcagaaacacctggacccaagacaacgagtctgaaaaccatcaactgtataaacctaagagcatcagtcttcaaagaacacagagaaattgagatcaatgtgcttcttcctcagattgcagtcaacctctcaaactgccatgttgtgatcaattcacatgtctgtgattactctttagacactgatgggccagtgaggcttcctcgcatttatcatgaagggactttcataccaggaacttataaaatagtgatagacaaaaaaaataagctaaatgaccgttgtacactggtcaccaactgtgtgataaagggaagagaggttcgtaaggggcaatcagtgctgaggcagtacaaaacagaaatcaagataggcaaggcatcaacaggctttaggaaactactgtccgaagagccaggtgatgactgcatatcaagaactcagctattgaggacagaaacagcagagatccatgatgacaactatggtggtccaggtgataaaataactatctgcaacggttcaaccattgtagatcagagactgggcagtgaactagggtgttataccatcaacagggtgaagtcattcaagctatgcgaaaacagcgccacagggaaaacctgtgaggtagacagcactccggttaagtgcaggcaaggtttttgtttaaaaatcacccaagagggaaggggccacgtaaaattatctagaggctcagaggttgtcctggatgcttgcgactcaagctgtgaagtaatgatacctaaaggcactggggatatcctagtggactgttcaggtgggcagcaacatttcttaaaagacaacttaattgacctagggtgcccccatatcccgctattgggtaagatggctatttacatttgcagaatgtcaaatcatcctagaacaaccatggcttttctcttctggttcagctttggctatgttatcacctgtatatcttgcaaggctcttttttattcattgataattattggaacactaggaaaaaagatcaagcaatatagggaactgaaacctcaaacctgcaccatatgtgagacagctcctgtcaatgcaatagatgctgaaatgcatgacctcaactgtagttacaatatatgcccttattgtgcatcaagattgacctccgatgggctagccaggcatgtaacgcaatgccccaagcggaaagagaaggttgaagagactgaactgtacctgaacctggaaagaattccttggattgtcagaaagctattgcaggtgtcagagtccactggtgtggcattaaaacgaagcagctggctgattgtactgcttgtgttactaacagtttcattgtcaccggttcaatcagcacctgttggtcatggaaagacaatcgaaatatatcagaccagggaaggattcgcaagcatctgtctctttatgttaggaagcattctatttatagtctcttgcttggtgaaagggctagttgacagtgtcagtgacagcttcttccccggcctatctgtctgtaagacatgctctattggcagtgtaaatggctttgaaattgaatcgcacaaatgctactgtagcctattttgctgcccctactgcaggcactgctctgctgacagagaaattcaccagttacacttgagtatctgcaaaaaaaggaaaacggggagcaatgtcatgctggccgtctgcaaacgcatgtgctttagggcaaccatagaagcaagcagaagagccctgctcatccgaagcattatcaataccacttttgtaatatgcattctaacattgacaatctgtgttgttagcacctctgcagtggagatggaaaaccttccagcaggaacttgggagagggaggaagatctgacaaatttctgtcatcaggaatgccaggtaactgagacagaatgcctctgtccatacgaagctcttgtgctcagaaaacctcttttcttggacagtatagttaaaggtatgaaaaatttgctaaactcaacaagcttggaaacaagcttatcaattgaggcaccatggggagcaataaatgtccagtcaacctttaaaccagctgtatcgactgcaaacatagcactcagttggagctcagtggagcacagaggcaacaagatcttagtcacaggcaggtctgaatcaattatgaaactggaggaaaggacaggagtcagctgggatctaggtgtagaagatgcctctgaatccaaattacttaccgtttctatcatggatttgtcacaaatgtattctcctgtttttgagtacttgtcaggagacagacaggttgaagaatggcccaaagcaacttgtacaggtgattgcccggagaggtgtggttgcacatcatcaacctgcttacataaagaatggcctcactcaagaaactggagatgtaatcccacttggtgctggggagtaggaaccggctgcacctgctgcggggtggatgtaaaagatctttttacagatcacatgtttgtcaaatggaaagttgaatacataaaaactgaagctatagtatgtgttgaactcaccagccaagaaagacagtgcagtctgattgaggcaggtactagattcaacttgggccctgtgactattaccctgtctgagccaagaaacattcagcagaagcttcctcctgagattatcacgttgcatcccaaaattgaagaaggcttctttgacttgatgcatgtacaaaaagtgttgtctgcaagtacagtgtgtaaactgcagagttgcacacatggtataccaggagatctacaagtttaccacattggcaacttgttgaaaggggatagagtaaacgggcatctaattcacaaaattgaatcacatttcaacacctcttggatgtcctgggatggttgtgacttagactactactgcaacatgggggattggccatcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgaaatatcaggcttgaaatttgcaagtctggcttgcacgggttgctatgcttgtagctctggcatctcctgtaaagttagaattcatgtagatgaaccagatgagctcacagtacatgtaaagagcagtgatccagatgtggttgcagctagcacaagtctcatggcgaggaagcttgaatttgggacagacagcacattcaaggccttttcagctatgcccaaaacctctttatgtttttacattgtggagagagaatactgcaagagctgcagtgaagatgatacacaaaaatgtgttgacacaagacttgagcagccacagagcatactaattgagcacaaaggaacgataattggaaagcagaatgatacttgcacagccaaggcaagctgttggttagagtcagtcaagagttttttttatggattgaagaatatgcttggcagtgtttttggtaatcttttcataggcattttgttattccttgccccttttgtcctgttggtgcttttctttatgtttgggtggaaaatcttgttttgctttaaatgttgcaggaggaccagaggcttatttaagtatagacacctcaaagacgatgaggaaacaggctacagaaggattattgaaagactgaacagcaaaaaagggaaaaacaggctgcttgatggtgatagactggctgataggaaaattgctgagctgttctccacaaaaacacacattggctaa

SEQ ID NO: 3572 - RNA, 5067 nt, synthetic construct
  misc_feature 1..5067: note = derived and/or modified CDS sequence (wt) from CCHFV(Kashmanov)__DQ211631.1__GP
  source 1..5067: mol_type = other RNA
atgcctaccaacattatgcatacactattagtgtgcttcattctttacctacagctgttgggtctaggaggagctcatggacagtcaaacgcaactgaacacaacggaacaaacaccaccacagcacccagcacaagtcaaagccccaagccacttgtgagcacagccccaccacacgcactggaatcatccaccatcaaacccaccacaccagcaagcgaaacagaaggctcaggggaaacgaccccacccccaaacaccacccagggcccgtctccaccagagaccacaccagaacgccccgcaacaactgccacaagtacgccaagcacagacaacacgaattccaccacacatgtgaccgacaacaaccctacatcaacaatcagcacaagtccatccagcagccccagcacgccatccacaccacaaggcatacatcatcctgcaaggaatctattgtcagtctcgagccctaagacagcaacaacaccaacaccaacgagccctggggagataagctcagaagccagcagtctgcactcagccatgagcagaacatcaaccctctacacagcaacccaggtctccactgaaaatgccaaccacagcgcacctagacagtctgagtcctcagcacagccgacaaccacaagcccaatgacttccccagcacaatcaatccttgtaatgagtgctgctcctatagctattcagaacatacatcccagcccaacgaataggtctaagaggaaccttgagatggaaataattttaactctgtctcaaggtctaaagaaatactacggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccgggccaccaacagtggaacccttcaaatcttacttcgctaagggcttcctttcaatagattcaggttacttctctgccaaatgttatccaagatcatctacttcagggcttcagctgatcaatgttacccaacacccagctagaatagcagaaacacctggacccaagacaacaagtctgaaaaccatcaactgtataaacctaagagcatcagtcttcaaagaacacagagaaattgagatcaatgtgcttcttcctcagattgcagtcaacctctcaaattgccatgttgtaatcaattcacatgtctgtgattattctttagacactgatgggccagtgaggcttcctcacatttaccatgaagggactttcataccaggaacttataaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggcatcaacaggctctaggaaactactgtccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtactatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgcactattggcagtataaatggctttgaaattgaatcgcataaatgctactgtagcctattttgctgcccctactgtaggcactgctctgctgacagagaaattcaccagttacacttgagtatctgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaattcgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggataggataaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggttaa

SEQ ID NO: 3573 - RNA, 5067 nt, synthetic construct
  misc_feature 1..5067: note = derived and/or modified CDS sequence (wt) from CCHFV(Drosdov)__DQ211630.1__GP
  source 1..5067: mol_type = other RNA
atgcccatcaacattatgcatgcactattagtgtgcttcattctttacctacagctatcgggtttaggaggagctcatagacagtcaaacgcaactgaacacaatggaacaaacaccaccacagcacccggcacaagtcaaagccctaagccacccgtgagcaccactctaccacacacaccagaagcctccaccatcaaactcaccacaccaacaagcgaaacagaaggctcaggggaaacgaccccacccccaaacaccacccagggcctgcccctaccagggaccacaccagaacgctccgcaacaaccgccacaagcacgtcaagcacagacgacatgaattccaccacacagatgaccgacaacacccccacatcaacagtcagcataggtctatccagcagccccagcatgccatccacatcacaaggcatacattatcccgtaaggagtctattgtcagtctcgagccctaagacagcaacaacaccaacaccaatgagccctggagaggtgagcccggaaaccagcagtcagcactcagccatgagcagaataccaaccctctacacagcaacccaggtctccactgagaacaccaaccgcagcatacctagacaatctgagtcctcagtgcagccggcaacccaaagcccaataacttccccagcgcaaacaatccttctgatgagtgctgctcctacagctattcaggacatgcatcccagcccaaaaaacaggtccaagaggaaccttgaggtggaaataattttaactctgtctcaaggtctaaagaaatattacggcaaaatactgaagcttctgcaccttaccttggaagaggatactgaaggcctgttagaatggtgtaagagaaaccttgggtcgaattgtgatgatgacttctttcaaaagagaatagaagaattcttcataactggtgagggctacttcaatgaagtcctacaatttaaaacaccaagcacactaagccccacggagccgtctcatgtcaggctaccaacagcagagcccttcaaatcttacttcgctaagggcttcctttcaatagattctggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtgctttcataccaggaacttataaaatagtgatagacaaaaaaaataagctaaatgaccgatgctcgctagtcactaactgtgtaataaagggaagagaggttcgtaagggccaatcagtgctgaggcagtacaaaacagaaatcaagataggcaaggcatcaacaggctctaggaaactactgtctgaagagccaggtgacgactgcatatcaagaactcagctattgaagacagaaacagcagagatccatgacgacaactatggtggtccaggtgacaaaataactatctgcaatggttcaaccattgtggatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaagtaatgatacctaaaggcactggagatatcctagtagactgttcaggtggacagcagcatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttactcattgataattattgggacactagggaaaaaaatcaagcaatatagggagctgaaacctcaaacttgcaccatatgtgagacagctcctgtcaatgcaatagatgctgaaatgcatgacctcaaatgtagttacaatatatgcccttattgtgcatcaagattgacctctgatgggctagctaggcatgtgacacaatgccctaagcgaaaggagaaagttgaggagactgaactgtacttgaacctggaaagaattccttggatagtcagaaagctattgcaagtgtcagagtccactggtgtagcattgaaacgaagcagttggctgattgtgctgcttgtgttactcacagtctcattgtcaccggttcaatcagcacctgttggtcatggtaagacaattgaaacatatcagaccagagaaggattcacaagtatctgtctctttatgttaggaagcatcctattcatagtctcttgcctagtaaaggggctggttgacagtgtcagtgacagcttcttccccggcctgtctgtctgtaagacatgctctattggcagtataaatggctttgaaattgaatcgcataaatgctactgtagtttattttgctgcccctactgtaggcactactctgctgacagagaaattcaccagttgcacttgagtatctgcaaaaaaaggaaaacggggagcaatgtcatgctggctgtctgcaaacgcatgtgctttaaggcaactatagaagcaagcagaagagccctgctcatccgaagtattatcaacaccacttttgtaatatgtattctaatattagcaatctgtgttgttagcacctctgcagtagagatggaaaaccttccagcaggcacttgggagagagaggaagacctgacaaatttctgccaccaggaatgccaggtgaccgagacggaatgcctctgtccatacgaagctcttgtgctcaggaaacctcttttcttagacagtacagttaaaggtatgaaaaatttgctaaactcaacaagcttggaaacaagcttatcaattgaggcaccatggggagcaataaatgtccagtcaacctttaaaccaacagtatcgactgcaaacatagcactcagttggagctcagtggagcacagaggcaacaagatcttggtcacaggcaggtctgaatcaattatgaaactagaggaaaggacaggagtcagctgggatctaggcgtagaagatgcctctgaatccaaattacttaccgtctccatcatggatttgtcacaaatgtattcccctgtttttgagtacttatcaggagatagacaggttgaagaatggcccaaggcaacctgtacaggtgattgcccagaaaggtgtggctgcacatcatcaacctgcttgcataaagaatggcctcactcaagaaactggagatgtaaccccacttggtgctggggagtaggaaccggctgcacatgctgcggagtggatgtaaaagacctttttacagatcacatgtttgtcaaatggaaggttgaatatatgaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtacaaaaagtgttatctgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactattgcaacatggggaattggccttcttgcacatacacaggagtgacccaacataatcatgctgcatttgtaaatttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctggtttgcacgggttgctatgcttgtagctctggcatttcctgtaaagtcagaattcatgtagatgaaccagatgagctcacagtgcatgtaaagagcagtgatccagatgtggttgcagctagcacaagccttatggcaaggaagcttgaatttgggacagatagcatattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggtgcttttctttatgtttggatggaaaatcttgttttgctttaagtgttgcaggaggaccagaggcttgtttaagtatagacacctcaaagacgatgaggaaacaggctacagaaggattattgaaagactgaatagtaaaaaaggaaaaaacagactgcttgatggtgagaggttggctgataggaaaattgctgagctgttctccacaaaaacacacattggctaa

SEQ ID NO: 3574 - RNA, 5067 nt, synthetic construct
  misc_feature 1..5067: note = derived and/or modified CDS sequence (wt) from CCHFV(1231-CR/TI-2015)__KU161585.1__GP
  source 1..5067: mol_type = other RNA
atgcccatcaacattatgcatacactattagtgtgcttcattctttacctacagctgttgggtctaggaggggctcatgaacagtcaaacgcaactgatcacaatagaacaaacaccatcacagcacccagcacaagtcaaaaccccaagccacccgcgagcacaaccccaccacacacaccggaatcatccaccatcaagctcatcacatcaacaggcgaagcagaaggctcaggggaaacgaccccacccctaaacaccacccagggcccgttcccaccagagaccacatcagaacaccctgcatcaaccgccacaaacacgtcaagcacaaacagcatgaattccaccacacagatgactgataaaaccctcacatcaacagtcagcacaagtctatccatcagccccagcacgccatccacatcacaaggcatacattatccgataaggagtctattgtcagtctcgagccctaggacagcagcaacaccaacaccaatgagcactagagagatgagctcggaaacaaacagtcagcactcagccgtgagcagaacaccaaccttccacacagcaacccaggtctccactgagaacgacaaccgcagcacccctagacagtctgaatcctcagcacagccggcaacccaaagcccaatgacttccccagcgcaatcaatccttctggtgagtgctgctcctacaaccattcagaacatacatcccagcccaacaaacaggtccaagaggaaccttgagatggaaataattttgactctgcctcaaggtctaaagaaatactacggtaaaatactgaagcttctgcaccttaccctagaagaggacactgaaggcctgttagaatggtgtaagagaaaccttgggtcgaactgtgatgatgaattcttccaaaagagaatagaagaattcttcataactggtgagggctacttcaatgaagtcctacaatttaaaacactaagcacactaagccccatggagccgtctcatgccaggccaccaacagcggaacccttcaaatcttacttcgctaagggcttcctttcaatagattcaggttacttctctgccaaatgttatccaagatcatcctcttcagggcttcagctgattaatattacccaacatccagctaggatagcagaaacacctggtcccaaaacaacgagtctgaaaaccatcaactgtatcaatctaagagcatctgttttcaaagaacacagagaagttgagatcaatgtgcttcttcctcagattgcagtcaacctttcaaactgccatgttgtgatcaattcacatgtctgtgattactctttagacactgatgggcctgtgaggcttcctcgcatttaccatgaaggaactttcataccagggacttataaaatagtgatagacaaaaaaaacaagctaaatgaccgatgcacgctagtcactaactgtgtgacaaagggaagagaagttcgtaagggccaatcagtgctgaggcaatacaaaacagaaattaagataggcaaggcatcaacaggctctaggaaactactgtccgaagagccaggtgatgactgcatatcaagaactcagctattgaggacagaaacagcagagatccatgacgacaactacggcggtccaggtgacaaaataactatctgcaatggttcaaccatcgtagatcagagactgggcagtgaactagggtgttataccatcaacagggtgaagtcattcaagctatgcgaaaacagcgctacagggaaaacctgtgagatagacagcactccggtcaagtgcaggcaaggtttctgtttaaaaatcacccaagagggaaggggccacgtaaaattatctagaggctcagaggttgtcttggatgcttgcgactcaagctgtgaagtaatgatacctaaaggcaccggagatatcctagtagactgttcaggtggacagcagcattttttaaaagacaacttgattgatctagggtgcccccacatcccgctattgggtaagatggccatttacatttgcagaatgtcaaatcatcctagaacaaccatggcttttctcttctggttcagctttggctatgtgatcacctgtatattttgcaaggctcttttttattcattaataattattgggacactagggaaaaagatcaagcaatatagagaactgaaacctcaaacttgtactatatgtgagacagctcctgtcaatgcaatagatgctgaaatgcatgacctcaactgtagttacaatatatgcccctattgtgcatcaagactgacctctgatgggctagctaggcatgtaacgcaatgccctaagagaaaggagaaagttgaggagactgaactgtacttgaacctagaaagaattccttggatcgtcagaaagctattgcaagtgtcagagtccactggtgtggccttgaaacgaagcagttggttgattgtgctgcttgtgttactcacagtttcattgtcaccggttcaatcagcacctgttggtcatggtaagacaatcgaaacatatcagaccagagaaggattcacaagtatctgtctctttatgttaggaagcatcctattcatagtctcttgcttggtgaaggggctggttgaaagtgtcagtgatagcttcttccccggcctgtctgtctgtaggacatgctctattggcagcataaatggctttgaaattgagtcgcataagtgctactgtagcttattttgctgcccctactgtaggcactgttctgctgacagagaaattcaccagttacacttgagtatctgcaaaaaaagaaaaacggggagcaatgtcatgctggctgtctgcaaacgcatgtgttttagggcaaccatggaagcaagcagaagagccctgcttatccgaagcattatcaataccacttttgtaatatgcattctaacattaacaatctgtgttgtcagcacctctgcagtagagatggaaaaccttccagcaggcacttgggagagagaggaagacctgacaaatttctgtcatcaagaatgccaggtaaccgagacggagtgcctctgtccatatgaagctcttgtgctcaggaaaccccttttcctagacagtatagttaaaggtatgaaaaatttgctaaactcgacaagcttagaaacgagcttatcaattgaggcaccatggggagcaataaatgtccagtcaacctttaaaccaacagtatcaactgcaaacatagcactcagttggagctcagtggagcacagaggcaacaagatcttagtcacaggcaggtctgaatcaattatgaaactagaggaaaggacaggagtcagctgggatctaggtgtagaagatgcctctgaatccaaattacttaccgtctctataatggatttatcacaaatgtattcccctgtttttgagtacttgtcaggagacagacaggttgaagagtggcccaaagcaacttgtacaggtgattgcccagaaaggtgtggctgcacatcatcaacctgcttgcataaagaatggcctcactcaagaaactggagatgtaatcccacttggtgctggggagtaggaaccggctgcacctgttgcggggtggatgtaaaagacctttttacagatcacatgtttgtcaaatggaaggttgaatatataaaaactgaagccatagtatgtgttgagctcaccagccaggaaagacagtgcagtcttattgaggcaggtacaagattcaacttaggccctgtgactatcaccctgtctgagccaagaaacattcagcagaagcttccccctgagatcattacgttgcatcccaaaattgaagaaggcttctttgacttgatgcatgtacaaaaagtgttgtctgcaagtacagtgtgtaaactgcagagttgcacacatggtataccaggagacctacaagtttaccacattggcaacttgttgaaaggggatagagtaaacgggcatctaattcacaaaattgaaccacattttaacacctcttggatgtcctgggatggttgtgatctagactactactgcaacatgggggactggccttcttgcacatacacaggagtgacccagcataatcatgctgcatttgtaaacttgcttaacattgaaactgattacacgaaaaccttccacttccactctaaaagagtcacagcacatggtgacacaccacaattagacttaaaagcaaggccgacctacggtgcaggtgagatcactgtgctggttgaggttgctgacatggagttgcatacaaaaaaagttgagatatcaggcttgaaatttgcaagcctggcatgcacgggttgctatgcttgtagctctggcatctcctgcaaagtcagaattcatgtagatgaaccagatgagctcacagtgcatgtaaagagcagtgatccagatgtggttgcggctagcacaagccttatggcaaggaagcttgaatttgggacagacagcacattcaaggccttttcagctatgcctaaaacctctttatgtttttacattgtggagagagaatactgcaagagctgcagtgaagatgatacaaaaaaatgtgttgacacaaaacttgagcagccacagagcatactaattgagcacaaagggacgataattggaaagcagaatgatacttgcacagccaaggcaagctgttggttagagtcagtcaagagttttttttatggattgaagaatatgctcggcagtgtttttggcaatttttttataggcattttgttattccttgccccttttgtcctgttggtgcttttctttatgtttggatggaaaatcttgttttgctttaaatgttgcaggaggaccagaggcttgtttaagtatagacacctcaaagacgatgaggaaacaggctacagaaggattattgaaagactgaacaacaaaaaggggaaaaacagactgcttgatggtgaaaggttggctgataggaaaattgctgagctgttctccacaaaaacacacattggctaa

SEQ ID NO: 3575 - RNA, 5067 nt, synthetic construct
  misc_feature 1..5067: note = derived and/or modified CDS sequence (wt) from CCHFV(1-CR/HU-2015)__KU161584.1__GP
  source 1..5067: mol_type = other RNA
atgcccatcaacattatgcatacactattagtgtgcttcattctttacctacagctgttgggtctaggaggggctcatgaacagtcaaacgcaactgatcacaatagaacaaacaccatcacagcacccagcacaagtcaaaaccccaagccacccgcgagcacaaccccaccacacacaccggaatcatccaccatcaagctcatcacatcaacaggcgaagcagaaggctcaggggaaacgactccacccctaaacaccacccagggcccattcccaccagagaccacatcagaacaccctgcatcaaccgccacaaacacgtcaagcacaaacagcatgaattccaccacacagatgaccgataataccctcacatcaacagtcagcacaagtctatccatcagccccagcacgccatccacatcacaaggcatacattatcccgtaaggagtctattgtcagtctcgagccctaagacagcagcaacaccaacaccaatgagcactagagagatgagctcagaaaccagcagtcagcactcagccatgagcagaacaccaaccttccacacagcaactcaggtctccactgagaacgccaaccgcagcacccctagacagtctgaatcctcagcacagccggcaacccaaagcccaatgacttccccagcgcaatcaatctttctggtgagtgctgctcctacaaccattcagaacatacatcccagcccaacaaacaggtccaagaggaaccttgagatggaaataattttgactctgcctcaaggtctaaagaaatactacggtaaaatactgaagcttctgcaccttaccctagaagaggacactgaaggcctgttagaatggtgtaagagaaaccttggatcgaactgtgatgatgaattcttccaaaagagaatagaagaattcttcataactggtgagggctacttcaatgaggtcctacaatttaaaacactaagcacactaagccccacggagccgtctcatgccaggccaccaacagcggaacccttcaaatcttacttcgctaagggcttcctttcaatagattcaggttacttctctgccaaatgttatccaagatcatccacttcagggcttcagctgattaatattacccaacacccagctaggatagcagaaacacctggtcccaaaacaacgagtctgaaaaccatcaactgtatcaatctaagagcatctgttttcaaagaacacagagaagttgagatcaatgtacttcttcctcagattgcagtcaacctttcaaactgccatgttgtgatcaattcacatgtctgtgattactctttagacactgatgggcctgtgaggcttcctcgcatttaccatgaaggaactttcataccagggacttataaaatagtgatagacaaaaaaaacaagctaaatgaccggtgcacgctagtcactaactgtgtgataaagggaagagaagttcgtaagggccaatcagtgctgaggcaatacaaaacagaaattaagataggcaaggcatcaacaggctctaggaaactactgtccgaagagccaggtgatgactgcatatcaagaactcagctattgaggacagaaacagcagagatccatgacgacaactacggcggtccaggtgacaaaataactatctgcaatggttcaaccatcgtagatcagagactgggcagtgaactagggtgttataccatcaacagggtgaagtcattcaagctatgcgaaaacagcgctacagggaaaacctgtgagatagacagcactccggtcaagtgcaggcaaggtttctgtttaaaaatcacccaagagggaaggggccacgtaaaattatctagaggctcagaggttgtcttggatgcttgcgactcaagctgtgaagtgatgatacctaaaggcaccggagatatcctagtagactgttcaggtggacagcagcattttttaaaagacaacttgattgacctagggtgcccccacatcccgctattgggtaagatggccatttacatttgcagaatgtcaaatcatcctaggacaaccatggcttttctcttctggttcagctttggctatgtgatcacctgtatattttgcaaggctcttttttattcattaataattattgggacactagggaaaaagatcaagcagtatagagaactaaaacctcaaacttgtactatatgtgagacagctcctgtcaatgcaatagatgctgaaatgcatgacctcaactgtagttacaatatatgcccttattgtgcatcaagactgacctctgatgggctagctaggcatgtaacgcaatgccctaagcgaaaggagaaagttgaggagactgaactgtacttgaacctagaaagaattccttggatcgtcagaaagctattgcaagtgtcagagtccactggtgtggccttgaaacgaagcagttggttgattgtgctgcttgtgttactcacagtttcattgtcaccggttcaatcagcacctgttggtcatggtaagacaatcgaaacatatcagaccagagaaggattcacaagtatctgtctctttatgttaggaagcatcctattcatagtctcttgcttggtgaaggggctggttgacagcgtcagtgacagcttcttccccggcctgtctgtctgtaggacatgctctattggcagcataaatggctttgaaattgagtcgcataagtgctactgtagcttattttgctgcccctactgtaggcactgttctgctgacagagaaattcaccagttacacttgagtatctgcaaaaaaagaaaaacggggagcaatgtcatgctggctgtctgcaaacgcatgtgttttagggcaaccatggaggcaagcagaagagccctgctcatccgaagcattatcaataccacttttgtaatatgcattctaacattaacaatctgtgttgtcagcacctctgcagtagagatggaaaaccttccagcaggcacttgggagagagaggaagacctgacaaatttctgtcatcaggaatgccaggtaaccgagacggagtgcctctgtccatacgaagctcttgtgctcaggaaaccccttttcctagacagtatagttaaaggtatgaaaaatttgctaaactcgacaagcttagaaacaagcttatcaattgaggcaccatggggagcaataaatgtccagtcaacctttaaaccaacagtatcaactgcaaacatagcactcagttggagctcagtggagcacagaggcaacaagatcttagtcacaggcaggtctgaatcaattatgaaactagaggaaaggacaggagtcagctgggatctaggcgtagaagatgcctctgaatccaaattacttaccgtctctataatggatttatcacaaatgtattcccctgtttttgagtacttgtcaggagacagacaggttgaagagtggcccaaagcaacttgtacaggtgattgcccagaaaggtgtggctgcacatcatcaacctgcttgcataaagaatggcctcactcaagaaactggagatgtaatcccacttggtgctggggagtaggaaccggctgcacctgttgcggggtggatgtaaaagacctttttacagatcacatgtttgtcaaatggaaggttgaatatataaaaactgaagccatagtatgtgttgagctcaccagccaggaaagacagtgcagtcttattgaggcaggtacaagattcaacttaggccctgtgactatcaccctgtctgagccaagaaacattcagcagaagcttccccctgagatcattacgttgcatcccaaaattgaagaaggcttctttgacttgatgcatgtacaaaaagtgttgtctgcaagtacagtgtgtaaactgcagagttgcacacatggtataccaggagacctacaagtttaccacattggcaacttgttgaaaggggatagagtaaacgggcatctaattcacaaaattgaaccacattttaacacctcttggatgtcctgggatggttgtgatctagactactactgcaacatgggggactggccttcttgcacatacacaggagtgacccagcataatcatgctgcatttgtaaacttgcttaacattgaaactgattacacgaaaaccttccacttccactctaaaagagtcacagcacatggtgacacaccacaattagacttaaaagcaaggccgacctacggtgcaggtgagatcactgtgctggttgaggttgctgacatggagttgcataccaaaaaagttgagatatcaggcttgaaatttgcaagcctggcatgcacgggttgctatgcttgtagctctggcatctcctgtaaagtcagaattcatgtagatgaaccagatgagctcacagtgcatgtaaagagcagtgatccagacgtggttgcagctagcacaagtcttatggcaaggaagcttgaatttgggacagacagcacattcaaggccttttcagctatgcctaaaacctctttatgtttttacattgtggagagagaatactgcaagagctgcagtgaagatgataccaaaaaatgtgttgacacaaaacttgagcagccacagagcatactaattgagcacaaagggacgataattggaaagcagaatgatacttgcacagccaaggcaagctgttggctagagtcagtcaagagttttttttatggattgaagaatatgctcggcagtgtttttggcaatttttttataggcattttgttattccttgccccttttgtcctgttggtgcttttctttatgtttggatggaaaatcttgttttgctttaaatgttgcaggaggaccagaggcttgtttaagtatagacacctcaaagacgatgaggaaacaggctacagaaggattattgaaagactgaacaacaaaaaggggaaaaacagactgcttgatggtgaaaggttggctgataggaaaattgctgagctgttctccacaaaaacacacattggctaa

SEQ ID NO: 3576 - RNA, 5067 nt, synthetic construct
  misc_feature 1..5067: note = derived and/or modified CDS sequence (wt) from CCHFV(V42/81)__GU477490.1__GP
  source 1..5067: mol_type = other RNA
atgcccaccaacactatgcatacactattagtgtgcttcattctttacctacaactgttgggtctaggaggagctcatgtacagccaaacgcaactgaacacaatagaacaaacaccaccacagcacccggcacaagccatagcctcaagccacttgtgagcacaaccccaccacaagcaccggaatcatccaccattaaacccactacaccaacaagcgaaacagaaggctcaggggaagcgaccccactttcaaacaccatccaggccccgtcctcaccagagaccacatcagaacgccccgcaacagctgtcataagcacgtcaggcacagacagcacgaactccaccacacagacgaccgataataaccccacaacaacagtcggcacaagtccatccagcagccccagtacgccatccacaccacaaggcatacaccatcatgcaaggagtctattgtcagtcacgagccctgagacagtaacaacaccaaaaccaacgagccctagggagatgagctcggaaaccagcaatcaacactcagccatgagcaggacaccaacccaccacacagtaacccaggtctccactgagaacaccagccacagcacacccagacagcctgagtcctcagcacagccgacatcctcaagcccaatgacttccccagcgcaatcaacccttctaatgagtgctgctcctacagctgtccagagcatacatcccagcccaacgaacaggtctaagaggaaccttgagacggaaataattttaactctatcccagggtctaaagaaatactacggcaaaatactaaaacttctgcaccttaccttggaagaggacactgaaggcctgttagaatggtgtaagagaaaccttgggtcaaactgtgatgatgacttctttcaaaagagaatagaagaattcttcatgactggtgagggctacttcaatgaagtcttacaatttaaaacaccaagcacagtaagccccacggagccatctcatgccagactaccaacagcagaacccttcaaatcttacttcgctaagggtttcctttcaatagattcgggttacttctctgccaaatgttactcgagatcatctacttcagggcttcagctgatcaatgttacccaacacccagctaggatagcagaaacacctggacccaaaacaacgagtctgaaaaccatcaactgtataaacctgagagcatcagtcttcaaagaaaacagagaaattgagatcagtgtgcttcttcctcagatagcagtcaacctctcaaactgccatgttgtgattaattcacatgtctgtgattactctttagacactgatgggccagtgaggcttcctcgcattaaccatgaagggactttcataccaggaacttataaaatagtgatagacaaaaaaaataagctaaatgaccgatgtacactggtcactaactgtgtgataaagggaagagaggttcgtaagggccaatcagtgctgaggcagtacaaaacagaaattaagataggcaaggcatcaacaggctctaggaaactactgtccaaagagccaggtgatgactgtatatcaagaactcagctaatgaggacagaaacagcagagatccatgatgacaactatggtggtccaggtgataaaataactatctgcaatggttcaaccattgtggatcagagactgggcagtgaactagggtgttataccatcaacagggtgaagtcattcaagctatgtgaaaacagcgccacagggaaagcctgtgaagtggacagcactccggttaagtgcaggcagggtttttgtttaaaaatcacccaagagggaaggggccatgtaaagttatctagaggctcagaggttgtcttggatgcttgcgactcaagctgtgaagtaatgatacctaaaggcactggagatatcctagtggactgttcaggtggacagcaacatttcttaaaggacaacttaattgacctagagtgccctcatatcccgctattaggtaagttggccatttacatttgcagaatgtcaaatcatcctagaacaactatggcttttctcttctggttcggctttggctatgtgatcacctgtatactctgcaaggctcttttttattcattgataattattgggacactagggaaaaagatcaagcaatatagggaactgaaacctcaaacttgcaccatatgtgagacagctcctgtcaatgcaatagatgctgaaatgcatgaccttaactgtagttacaatatatgcccttattgtgcatcaagattgacctccgatgggctagctaggcatgtaacgcaatgccccaagcgaaaagagaaagttgaggagactgaactgtacttgaatctggagagaattccttggattgtcaggaagctcctgcaagtgtcggagtccactggcgtggtattgaaacgaagcagttggctgattgtgctgcttgtgttactcacagtttcattgtcaccagttcagtcagcacctgttggtcatggtaagacaattgaaacatatcagaccagagaaggattcacaagcatctgtctctttatgttaggaagcatcctatttatagtctcttgcatagtgaaggggctggttgacagtgtcagtgacagcttcttccccggcctgtctgtctgtaagacatgctctatcagcagtataaatggctttgaaattgaatcgcataaatgctactgtagcttattttgctgcccctactgtaggcactgctctgctgacagagaaattcaccagttacacttgagtatctgcaggaaaagaagaacggggagcaatgtcatgctggctgtctgcaaacgcatgtgctttagggcaaccatagaagtaagcagaagagccctgctcatccgaagcatcatcaataccacttttgtaatatgtattctaacattaacaatctgtgttgttagcacttctgcagtagagatggaaaacctcccagcaggcacttgggagagagaggaagacctaacaaatttctgtcatcaggaatgccaggtaaccgagacggagtgcctctgtccatacgaagctcttgtgctcagaaaacctcttttcttagacagtatagttaaaggtaagaaaaatttgttaaactcaacaagtttggaaacaagcttatcaattgaagcaccatggggagcaataaatatccagtcaacctttaaaccaacagtatcggctgcaaacatagcactcagttggagctcagtggagcacagaggcaacaagatcttagtctcaggcaggtctgaatcaattatgaaactagaggaaagaacaggagtcagctggaatctaggtgtagaagatgcctctgaatccaaattacttaccgtctctatcatggatttgtcacaaatgtattcccctgtttttgagtacttgtcaggagacagacaggttgaagaatggcctaaagcaacttgtacaggtgactgcccagaaaggtgtggttgcacatcatcaacctgcttgcataaagaatggcctcactcaagaaactggagatgcaatcctacttggtgctggggggtaggaaccggctgcacctgctgcggagtggatgtaaaagacctttttatagatcacatgtttgttaaatggaaggttgaatatataaaaactgaagccatagtatgtgttgagctcaccagccaagaaagacagtgcagtctgattgaggcaggtactagattcaacttgggccctgtgactattaccctatccgagccaagaaacattcagcagaagcttccccctgagattatcacgttgcaccccaaaattgaagaaggcttctttgacttgatgcatgtacaaaaagtgttgtctgccagtacagtgtgtaaactgcaaagttgcacacatggtataccaggagatctgcaagtctaccacattggcaacctattgaaaggggatagagtaaacgggcatctaattcacaaaatcgaaccacattttaacacctcttggatgtcctgggatggttgtgacctagactactactgcaacatgggggattggccttcttgcacatacacaggagtgacccagcacaatcatgctgcatttgtaaacttgcttaacattgaaactgattacacgaaaactttccacttccactctaaaagagttacagcacatggtgaaacaccacaattagacttaaaagcaaggccggcatacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgaaccagatgagctcacagtacatgtgaagagcaatgatccagatgtggttgcagctagcacaagtctcatggcaaggaagcttgaatctgggacagacagcacatttaaggccttttcagctatgcccaaaacctctttatgtttttacattgtggagagagaatactgcaagagctgcagtgaagatgatacacagaaatgtgttgaaacaaaacttgaacagccacaaagcatactaattgaacacaaaggaacgataattggaaagcagaatgatacttgcacagccaaggcaagctgttggctggaatcagtcaagagttttttttatggattgaagaacatgcttggcagtgtttttggtaattttttcataggcattttgttattccttgccccctttgtcctgttagtacttttctttatgtttggatggaaaatcttgttttgctttaaatgttgcaggaggaccagaggcttgtttaagtatagacacctcaaagaagatgaggaaacaggctacagaaggattattgagagactgaacagcaaaaaagggaaaaacagactgcttgatggtgaaaggttggctgataggaaaattgctgagctgttctctacaaaaacacacattggctaa

SEQ ID NO: 3577 - RNA, 5067 nt, synthetic construct
  misc_feature 1..5067: note = derived and/or modified CDS sequence (wt) from CCHFV(ROS/HUVLV-100)__DQ206448.1__GP
  source 1..5067: mol_type = other RNA
atgcctaccaacattatgcatacactattagtgtgcttcattctttacctacagctgttgggtctaggaggagctcatagacagtcaaacgcaactgaacacaacggaacaaacaccaccacagcacccagcacaagtcaaagccccaagcctcttgtgagcacagccccaccacacgcactggaatcatccaccatcaaacccaccacaccagtaagcgaaacagaaggctcaggggaaacgaccccacccccaaacaccacccagggcccgtctccaccagaggccacaccagaacgccccacaacaactgccacaagtacgccaagcacagacaacacgaattccaccacacatgtgaccgacaacaaccctacatcaacaatcagcacaagtccatccagcagccccagcacgccatccacaccacaaggcatacatcatcctgcaaggaatctattgtcagtctcgagccctaagacagcaacaacaccaacaccaacgagccctggggagataagctcagaaaccagcagtctgcactcagccatgagcagaacatcaaccctctacacagcaacccaggtctccactgaaaatgccaaccacagcgcacctagacagtctgagtcctcagcacagcagacaaccacaagtccaatgacttccccagcacaatcaatccttgtaatgagtgctgctcctacagctattcagaacatacatcccagcccaacgaataggtctaagaggaaccttgagatggaaataattttaactctgtctcaaggtctaaagaaatactatggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagattatctacttcagggcttcagctgatcaatgtcacccaacacccagctagaatagcagaaacacctggacccaagacaacgagtctgaaaaccatcaactgtataaacctaagagcatcagtcttcaaagaacacagagaaattgagatcaatgtgcttcttcctcagattgcagtcaacctctcaaattgccatgttgtaatcaattcacatgtctgtgattattctttagacactgatgggccagtgaggcttcctcacatttaccatgaagggactttcataccaggaacttataaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggcatcaacaggctctaggaaactactgtccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagcccctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcatcagttacacttgagtatctgcaaaaaaagaaaaacgggtagcaatgtcatgctggctgtctgcaaacgcatgtgctttagggcaaccatagaagcaagcagaagagccttgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcctatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacattgcatcccaaagttgaagagggcttctttgacttgatgcatgtgcaaaaagtgctgtctgcaagtacagtgtgtaaactgcagagttgcacacatggtataccaggagatctacaagtttaccatattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaattttttcataggcattttgttattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaagggaaaaaacagactgcttgatggtgaaaggttggctgataggaaaattgctgagctgttctccacaaaaacacacattggttga

SEQ ID NO: 3578 - RNA, 5067 nt, synthetic construct
  misc_feature 1..5067: note = derived and/or modified CDS sequence (wt) from CCHFV(5180-R-2011)__KR814874.1__GP
  source 1..5067: mol_type = other RNA
atgcctaccaacattatgcatacgctattagtgtgcttcattctttacctacagctgttgggtctaggaggagctcatagacagtcaaacgcaactgaacacaacggaacaaacaccaccacagcacccagcacaagccaaagccccaagccacctgtgagcacagccccaccatacgcaccggaatcatccaccatcaaacccaccacaccagcaagcgaaacagaaggctcaggggaaacgaccccacccccaaacaccacccagggcccgtctccaccagaggccacaccagaacgccccgcaacaactgccacaagtacgccaagcacagacaacacgaactccaccacacacgcgaccgacaacaaccctacatcaacaatcagcacaagtccatccagcagccccagcacgccatccacaccacaaggcatacatcatcctgcaaggaatctattgtcagtctcgagccctaagacagcaacaacaccaacaccaacgagccctggggatataagctcagaaaccagcagtctgcactcagccatgagcagaacaccaaccctccacacagcaacccaggcctccactgaaaatgccaaccacagcgcacctagacagtctgagtcctcagcacagcagacaaccacaagcccaatgacttccccagcacaaccaatccttgtaatgagtgctgctcctacagctattcagaacatacatcccagcccaacgaataggtctaagaggaaccttgagatggaaataattttaactctgtctcaaggtctaaagaaatactatggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagattatctacttcagggcttcagctgatcaatgtcacccaacacccagctagaatagcagaaacacctggacccaagacaacaagtctgaaaaccatcaactgtataaacctaagagcatcagtcttcaaagaacacagagaaattgagatcaatgtgctccttcctcagattgcagtcaacctctcaaattgccatgttgtaatcaattcacatgtctgtgattattctttagacactgatgggccagtaaggcttcctcacatttaccatgaagggactttcataccaggaacttataaaatagtgatagacaaaaaaaataagctaaatgaccgatgtacactggtcaccaactgtgtgataaaaggaagagagattcgtaagggccaatcagtgctgaggcagtacaaaacagaaatcaagataggcaaggcatcaacaggctctaggaaactactgtccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgacacaagctgcgaagtaatgatacctaaaggcactggagatatcctggtggactgttcaggtggacagcaacatttcttaaaagacaatttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtgtctgtctctttatgttaggaagcatcctgtttttagtctcttgcttggtgaaggggctagttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcatcagttacacttgagtatctgcaaaaaaagaaaaatgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctccatcatggatttgtcacaaatgtattcccctgtttttgagtacttgtcaggagacagacaggttgaagaatggcccaaagcaacttgcacaggtgactgcccagaaaggtgtggttgcacatcatcaacttgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgttcggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggttaa

SEQ ID NO: 3579 - RNA, 5067 nt, synthetic construct
  misc_feature 1..5067: note = derived and/or modified CDS sequence (wt) from CCHFV(5170-R-2011)__KR814873.1__GP
  source 1..5067: mol_type = other RNA
atgcccttcaacatcatgcatacactattagtgtgcttcattctttacctacagctgtcgggtttaggaggggctcatggacagtcaaacgaaactgaacacaatggaacaaacaccaccacagtacccggcacaagtcaaagccccaagccacccgcgagcaccactctacaacacacaccagaatcctccaccgtcaaactcaccacaccaacaagcgaaacagaaggctcaggggaaacgaccccacccccaaacaccacccagggcctgcccccaccagggaccacaccagaacgctccgcaacaaccgccacaagcacgtcaagcacagacaacatgaattccaccacacaggtgaccgacaacacccccacatcaacagtcagcataagtccatccagcagccccagcatgccatccacatcacaaggcatacattatcccataaggagtctattgtcagtctcgagccctaagacagtaacaacaccgacaccaataagccctggagagatgagcccggaaaccagcagtcagcactcagccatgagcagaataccaaccctctacacagcaacccaggtctccactgagaacaccaaccgcagcacacctagacaatctgagtcttcagtacagccggcaacccaaagcccaataacttccccagcgcaaacaatccttctgatgagtgctgctcctaaagctattcaggacatgcatcccagcccaacaaacaggtccaagaggaaccttgaggtggaaataattttaactctgtctcaaggtctaaagaaatattacggtaaaatactgaagcttctgcaccttaccttggaagaggatactgaaggcctgttagaatggtgtaagagaaaccttgggtcaaattgtgatgatgacttctttcaaaagagaatagaggaattcttcataactggtgagggctacttcaatgaagtcctacaatttaaaacactaagcacactaagccccacggagctgtctcatgtcaggctaccaacagcggagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtactttcataccaggaacttataaaatagtgatagacaaaaaaaataagctaaatgaccgatgctcgctagtcactaactgtgtgataaagggaagagaggttcgtaagggccaatcagtgctgaggcagtacaaaacagaaattaagataggcaaggcatcaacaggctctaggaaactactgtccgaagagccaggtgacgactgcatatcaagaactcagctattgaagacagaaacagcagaaatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgtttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgaagggctagctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggtcatggtaagacaatcgaaacatatcagaccagagaaggattcacaagtatctgtctctttatgttaggaagcatcctattcatagtttcttgcctggtaaaggggctggttgacagtgtcagtgacagcttcttccccggcctgtctgtctgtaagacatgctctattggcagtataaatggctttgaaattgaatcgcataaatgctactgtagtttattttgctgcccctactgtaggcactgctctgctgacagagaaattcaccagttgcacttgagtatctgcaaaaaaagaaaaacagggagcaatgtcatgctggctgtctgcaagcgcatgtgctttaaggcaaccatagaagcaagcagaagagccctgctcatccgaagcattatcaataccacttttgtaatatgcattctaacattagcaatctgtgttgttagcacctctgcagtagagatggaagaccttccagcaggcacttgggagagagaggaagacctaacaaatttctgccatcaggaatgccaggtgaccgagacggaatgcctctgtccatacgaagctcttgtgctcaggaaacctcttttcttagacagtatagttaaaggtatgaaaaatttgctaaactcaacaagcttagaaacaagcttatcaattgaggcaccatggggagcaataaatgtccagtcaacctttaaaccaacagtatctactgcaaacatagcactcagttggagctcagtagagcacagaggcaacaagatcttggtcacaggcaggtctgaatcaattatgaaactagaggaaaggacaggagtcagctgggatctaggcgtggaagatgcctctgaatccaaattacttaccgtctctatcatggacttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacatcggtaacttgttgaaaggggatagagtaaacgggcatctgattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcctgtagctctggcatctcttgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagccatgcccaaaacctctttatgcttttacattgtagagagggaatactgcaagagctgcagtgaagatgatacaaaaaaatgtgttgacacaaaacttgagcagccacagagcatactaattgagcacaaggggacgataattggaaagcagaatgatacttgcacagccaaggcaagttgttggctagagtcagtcaagagttttttttatggactgaagaatatgcttggcagtgtttttggtagttttttcgtaggcattttgttattccttgccccttttgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaagggaaaaacagactgcttgatggtgagaggttggctgataggaaaattgctgagctgttctctacaaaaacacacattggctaa

SEQ ID NO: 3580 - RNA, 5067 nt, synthetic construct
  misc_feature 1..5067: note = derived and/or modified CDS sequence (wt) from CCHFV(4701-ST-2009)__KR814872.1__GP
  source 1..5067: mol_type = other RNA
atgcccatcaacattatgcatacactattagtgtgcttcattctttacctacagctatcgggtttaggaggagctcatggacagtcaaacgcaactgaacacaatggaacaaacaccaccacagcacccggcacaagtcaaagtcccaagccacccgcgagcaccactctaccacacacaccagaatcctccaccgtcaaactcaccacaccaacaagcgaaacagaaggctcaggggaaacgaccccacccccaaacaccacccagggcctgcccctaacagggaccacaccagaacgctccgcaacaaccgccacaagcacgtcaagcacagacaacatgaattccaccacacaggtgaccgacaacacccccacatcaacagtcagcataagtccatccagcagctccagcatgccatccacaccacaaggcacacatcatcccgtaaggagtctattgtcagtctcgagccctaagacagtaacaacaccgacaccaatgagccctggagagatgagcccggaaaccagcagtcagcactcagccatgagcagagtaccaaccctctacacagcaacccaggtctccactgagaacaccgatcgcagcacacctagacaatctgagtcctcagtacagccggcaacccaaagcccaataacttccccagcgcaaacaatccttctgatgagtgctgctcctaaagctattcaggacatgcatcccagcccaacaaacaggtccaagaggaaccttgaggtggaaataattttaactctgtctcaaggtctaaagaaatattacggtaaaatactgaagcttctgcaccttaccttggaagaggatactgaaggcctgttagaatggtgtaagagaaaccttgggtcaaattgtgatgatgacttctttcaaaagagaatagaagaattcttcataactggtgagggctacttcaatgaagtcctacaatttaaaacactaagcacactaagccccacggagccgtctcatgtcaggctaccaacagcggagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtactttcataccaggaacttataaaatagtgatagacaggaaaaataagctaaatgaccgatgctcgctagtcactaactgtgtgataaaaggaagagaggttcgtaagggccaatcagtgctgaggcagtacaaaacagaaattaagataggcaaggcatcaacaggctctaggaaactactgtccgaagagccaggtgacgactgcatatcaagaactcagctattgaagacagaaacagcagagatccatgacgacaactatggtggtccaggtgacaaaataactatctgcaatggttcaaccgttgtagatcagagactgggcagtgaactagggtgttataccatcaacagggtgaagtcattcaagctatgcgaaaacagtgccacagggaaaacctgtgagatagacagcactccggttaagtgcaggcaagggttttgtttgaaaatcacccaagagggaaggggccacgtaaaattatccaggggctcagaggttgttttggatgcttgcgactcaagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctggctaggcatgtgacacaatgccctaagcgaaaagagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggtcatggtaagacaatcgaaacatatcagaccagagagggattcacaagtatctgtctctttatgttaggaagcatcctattcatagtttcttgcctggtaaaggggctggttgacagtgtcagtgacagcttcttccccggcctgtctgtctgtaagacatgctctattggcagtataaatggctttgaaattgaatcgcataaatgctactgtagtttattttgctgcccctactgtaggcactgctctgctgacagagaaattcaccagttgcacttgagtatctgcaaaaaaagaaaaacggggagcaatgtcatgctggctgtctgcaagcgcatgtgctttaaggcaaccatagaagcaagcagaagagccctgctcatccgaagcattatcaataccacttttgtaatgtgcattctaacattagcaatctgtgttgttagcacctctgcagtagagatggaagaccttccggcaggcacttgggagagagaggaagacctaacaaatttctgccatcaggaatgccaggtgaccgagacggaatgcctctgtccatacgaagctcttgtgctcaggaaaccccttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgtacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagagtaaacggccatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaatattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaaaaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtggttttttcgtaggcattttgttattccttgcccctttcgtcttgttggtacttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaaggaaaaaacagactgcttgatggtgagaggttggctgataggaaaattgctgagctgttctctacaaaaacacacattggctaa

SEQ ID NO: 3581 - RNA, 5067 nt, synthetic construct
  misc_feature 1..5067: note = derived and/or modified CDS sequence (wt) from CCHFV(4574-ST-2008)__KR814870.1__GP
  source 1..5067: mol_type = other RNA
atgcctaccaacattatgcatacactattagtgtgcttcattctttacctacagctgttgggtccaggaggagcccatggacagccaaacgcaactgaacacaacagaacaaacaccaccacagcacccagcacaagccaaagccccaagccacccgtgagcacagccccaccacacgcactggaatcacccaccatcaaatccaccacaccaacaagcgaaacagaaggctcaggggaaacgacctcacccccaaacaccacccagggcccgtctctaccagagaccacaccaaaacgccccgcaacaactgccacaagtacgccaagcacagacaacacaaattccaccacacatgtgaccgacaacaaccctacatcaacaatcagcacaagtccatccagcagccccagcacgccatccacaccacgaggcatacatcatcctgcaaggaatctattgtcagtctcgagccctaagacagcaacaacaccaacaccaacgagccctggggagataagctcagaaaccagcagtctgcactcagccatgagcagaacatcaaccctctacacagcaacccaggcctccactgaaaatgccaaccacagcgcacctagacagtctgagtccccagcacagccgacaaccacaagcctaatgacctccccagcacaatcaatccttgtaatgagtgctgctcctacagctattcagaacatacatcccagcccaacgaataggtctaagaggaaccttgagatggaaataattttaactctgtctcaaggtctaaagaaatactacggtaagatactgaagcttctgcacctcaccttggaagaggacactgaaggcctgttagaatggtgtaagagaaaccttgggtcaaactgtgaggatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagatcatctacttcagggcttcagctgatcaatgttacccaacacccagctagaatagcagaaacacctggacccaagacaacgagtctgaaaaccatcaactgtataaacctaagagcatcagtcttcaaagaacacagagaaattgagatcaatgtgcttcttcctcagattgcagtcaacctctcaaattgccatgttgtaatcaattcacatgtctgtgattattctttagacactgatgggccagtgaggcttcctcacatttaccatgaaggaactttcataccaggaacttacaaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggtatcaacaggctctaggaaactactgtccgaagagtcaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagaaggaaggggccacgtaaaattatctagaggctcagaggttgttttggatgcttgcgactcaagctgcgaagtaatgatacctaaaggcactggagatatcttggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtttattttgcaaggctcttttttattcattgataatcattgggacactagggaaaaagatcaagcaatatagggaattgagacctcaaacctgtaccatatgtgagacagctcctgtcaatgcaatagatgctgaaatgcatgaccttaactgcagttacaatatatgtccttattgtgcatcaagattgacctccgatgggctagctaggcatgtgccacaatgccccaagcggaaggaaaaagttgaggagactgagctgtacttgaacctggaaagaataccttggattgtcagaaagctattgcaagtgtcagagtccactggtgtggcattgaagcgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctccattggcagtataaatggctttgaaattgaatcgcataaatgctactgtagcctactttgctgcccctactgtaggcactgctctgctgacagagaaatccaccagttacacttgagtatctgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattaacaatctgtgttgttagcacctctgcagtagagatggaaaaccttccatcaggcacttgggagaaagaggaagacctgacaaatttctgtcatcaggaatgccaggtgaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaagtggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtacaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccaacctacggtgcaggtgagatcactgtgctggttgaggttgctgacatggagttgcataccaagaaagttgagatatcaggcctgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggcaactttttcataggcattttgttattccttgccccttttgtcctgttggtgcttttctttatgtttggatggaaaatcttgttttgcttcaaatgttgcaggagggccagaggcttgcttaagtatagacacctaaaagacgatgaggaaacaggctacagaaagattattgaaaggctgaacaacaaaaaaggaaaaaacagactgcttgatggtgaaaggttggctgataggaaaattgctgagctgttctccacaaaaacacacattggttaa

SEQ ID NO: 3582 - RNA, 5067 nt, synthetic construct
  misc_feature 1..5067: note = derived and/or modified CDS sequence (wt) from CCHFV(4495-ST-2008)__KR814869.1__GP
  source 1..5067: mol_type = other RNA
atgcctaccaacattatgcatacactattagtgtgcttcattctttacctacagctgctgggtccaggaggagcccatggacagccaaacgcaactgaacacaacagaacaaacaccaccacagcacccagcacaagccaaagccccaagccacccgtgagcacagccccaccacacgcactggaatcacccaccatcaaatccaccacaccaacaagcgaaacagaaggctcaggggaaacgaccccacccccaaacaccacccagggcccgtctccaccagagaccacaccagaacgccccgcaacaactgccacaagtacgccaagcacagacaacacgaattccaccacacatgtgaccgacaacaaccctacatcaacaatcagcacaagtccatccagcagccccagcacgccatccacaccacgaggcatacatcatcctgcaaggaatctattgtcagtctcgagccctaagacagcaacaacaccaacaccaacgagccctggggagataagctcagaaaccagcagtctgcactcagccatgagcagaacatcaaccctctacacagcaacccaggcctccactgaaaatgccaaccacagcacacctagacagtctgagtccccagcacagccgacaaccacaagcctaatgacctccccagcacaatcaatccttgtaatgagtgctgctcctacagctattcagaacatacatcccagcccaacgaataggtctaagaggaaccttgagatggaaataattttaactctgtctcaaggtctaaagaaatactacggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagatcatctacttcagggcttcagctgatcaatgttacccaacacccagctagaatagcagaaacacctggacccaagacaacgagtctgaaaaccatcaactgtataaacctaagagcatcagtcttcaaagaacacagagaaattgagatcaatgtgcttcttcctcagattgcagtcaacctctcaaattgccatgttgtaatcaattcacatgtctgtgattattctttagacactgatgggccagtgaggcttcctcacatttaccatgaaggaactttcataccaggaacttacaaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggtatcaacaggctctaggaaactactgtccgaagagtcaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagaaggaaggggccacgtaaaattatctagaggctcagaggttgttttggatgcttgcgactcaagctgcgaagtaatgatacctaaaggcactggagatatcttggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtaatcacctgtttattttgcaaggctcttttttattcattgataatcattgggacactagggaaaaagatcaagcaatatagggaattgagacctcaaacttgtaccatatgtgagacagctcctgtcaatgcaatagatgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctactttgctgcccctactgtaggcactgctctgctgacagagaaatccaccagttacacttgagtatctgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattaacaatctgtgttgttagcacctctgcagtagagatggaaaaccttccatcaggcacttgggagaaagaggaagacctgacaaatttctgtcatcaggaatgccaggtgaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggaatcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaagtggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtacaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccaacctacggtgcaggtgagatcactgtgctggttgaggttgctgacatggagttgcataccaagaaagttgagatatcaggcctgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagggaatactgcaagagctgcagtgaagaggacacacaaagatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggcaactttttcataggcattttgttattccttgccccttttgtcctgttggtgcttttctttatgtttggatggaaaatcttgttttgcttcaaatgttgcaggagggccagaggcttgcttaagtatagacacctaaaagacgatgaggaaacaggctacagaaagattattgaaaggctgaacaacaaaaaaggaaaaaacagactgcttgatggtgaaaggttggctgataggaaaattgctgagctgttctccacaaaaacacacattggttaa

SEQ ID NO: 3583 - RNA, 5067 nt, synthetic construct
  misc_feature 1..5067: note = derived and/or modified CDS sequence (wt) from CCHFV(3809-ST-2007)__KR814867.1__GP
  source 1..5067: mol_type = other RNA
atgcctaccaacattatgcatacactattagtgtgcttcattctttacctacagctgttgggtctaggaggagctcaaggacagtcaaacgcaacagaacacaacgaaacaaacaccaccacagcacccagcacaagtcaaagtcccaagccacctgtgagcacaaccccactacatgcactggaatcatccaccatcaaacccaccacaccagcaagagaaacagaaggctcaggggaaacgaccccacccccaaacaccacccagggcccgtctccaccagaggccacaccagaacgccccgcaacaactgccacaagtgcgccaagcacagacaacacgaattccaccacacatgtgaccgacaacaaccctacatcaacaatcagcacaagtccatccagcagccccagcacgccattcacaccacaaggcatacatcatcctgcaaggaatctattgtcagtctcgagccctaagacagcaacaacaccaacaccaacgagtcctggggagttaagctcagaaaccagcagtctgcactcagccataagcagaacatcaaccctctacacagcaacccaggtctctaccgaaaatgccaaccacagcgcacctagacagtctgagtcctcagcacagccgacaaccacaagcccaatgacttccccagcacaatcaatccttgtaatgagtgctgctcctacagctattcagaacatacatcccagcccgacgaataggtctaagaggaaccttgagatggaaataattttaactctgtctcaaggtctaaagaaatactacggtaagatactgaagcttctacacctcaccttggaagaggacactgaaggcctgttagaatggtgtaagagaaaccttgggtcaaactgtgatgatgacttctttcagaagagaatagaagaattcttcatgactggtgagggctacttcaatgaagtcttacaatttaaaacactaagcacactaagccccacggagccgtctcatgccaggccaccagcagtggaacccttcaaatcttacttcgctaagggcttcctttcaatagattcaggttacttctctgccaaatgttatccaagatcatctacttcagggcttcagctgatcaatgttacccaacacccagctaggatagcagaaacacctggacccaagacaacgagtctgaaaaccatcaactgtataaacctaagagcatcagtcttcaaagaacacagagaaattgagatcaatgtgcttcttcctcagattgcagtcaacctctcaaattgccatgttgtaatcaattcacatgtctgtgattactctttagacactgatgggccagtgaggcttcctcacatttaccatgaagggactttcataccaggaacttataaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggcatcaacaggctctaggaaactactgtccgaagagccaggtgatgactgcatatcaagaactcagttattgaggacagaaacagcagagatccatgatgacaactatggtggtccaggtgataaaataactatctgcaacggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgtcttggatgcctgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgtaaggctcttttttattcattgataattattgggacactagggaaaaagatcaagcaatatagggaattgaaacctcaaacttgtaccatatgtgagacagctcctgtcaatgcaatagatgctgaaatgcatgaccttaactgcagttacaatatatgcccttattgtgcatcaagattgacctccgatgggctggctaggcatgtgccacaatgccccaagcggaaggaaaaagttgaggagactgagctgtacttgaacctggaaagaatcccttggattgtcagaaagctattgcaagtgtcagagtccactggtgtggcattgaaacgaagcagctggctgattgtactgcttgtgttactcacagtttcattgtcaccggttcaatcagcacctgttggtcatggtaaaacaatcgaaacatatcagaccagagaaggattcacaagtatctgcctctttatgttaggaagcatcctgtttttagtctcttgcttggtgaaggggctggttgacagtgtcagtgacagcttcttccccggcctgtctgtctgtaagacatgctctattggcagtgtaaatggctttgagattgaatcgcataaatgctactgtagcctattttgctgcccctactgtaggcactgctctgctgacagagaaattcaccagttacacttgagtgtctgcaaaaaaagaaaaacgggtagcaatgtcatgctggctgtctgcaaacgcatgtgctttagggcaaccatagaagcaagcagaagagccctgctcatccgaagcattatcaataccacttttgtaatatgcattttaacattgacaatctgtgttgttagcacctctgcagtagagatggaaaaccttccagcaggcacttgggagagagaggaagacctgacaaatttctgtcatcaggaatgccaggtaaccgagacggagtgcctctgtccatacgaagctcttgtgctcagaaaacctctgttcttagacagtatagtcaaaggcatgaagaatttgctaaactcaacaagcttagaaacaagcttatcaattgaagcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtggaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgtacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactatcaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatcttcaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagaaagaatactgcaggagctgcagtgaagaggacacacaaaaatgtgttgacacaaaacttgagcagccacagagcatactaattgagcacaaaggaacgataattggaaagcagaatgatacttgcacagccaaagcaagctgttggctagagtcagtcaagagttttttttatggattgaagaatatgcttggtagtgtctttggtaactttttcataggcattttgttattccttaccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaagggaaaaacagactgcttgatggtgaaaggttggctgataggaaaattgctgagctgttttccacaaaaacacacattggttaa

SEQ ID NO: 3584 - RNA, 5067 nt, synthetic construct
  misc_feature 1..5067: note = derived and/or modified CDS sequence (wt) from CCHFV(3756-ST-2007)__KR814866.1__GP
  source 1..5067: mol_type = other RNA
atgcccatcaacattatgcatacactattagtgtgcttcattctttacctacagctgtcgggtttaggaggagctcatggacagtcaaacgcaactgaacacaatagaacaaacaccaccacagtacccggcacaagtcaaagccccaagccacccgcgagcaccactctaccacacacaccagaatcctccaccgtcaaactcaccacaccaacaagcgaaacagaaggctcaggggaaacgaccccacccccaaacaccacccagggcctgcccctaccagggaccacaccagaacgctccgcaacaaccgccacaagcacgtcaagcacagacaacatgaataccaccacacaggtgaccgacaacacccccacatcaacagtcagcataagtccatccagcagccccagcatgccatccacatcacaaggcatacattatcccgtaaggagtctattgtcagtctcgagccctaagacagtaacaacaccgacaccaatgagccctggagagatgagcccggaaaccagcagtcagcactcagccatgagcagaataccaaccctctacacagcaacccaggtctccactgagaacatcaaccgcagcacacctagacaatctgagtcctcagtacagccggcaacccaaagcccaataacttccccagcgcaaacaatccttctgatgagtgctgctcctaaagctattcaggacatgcatcccagcccaacaaacaggtccaagaggaaccttgaggtggaaataattttaactctgtctcaaggtctaaagaaatattacggtaaaatactgaagcttctgcaccttaccttggaagaggatactgaaggcctgttagaatggtgtaagagaaaccttgggtcaaattgtgatgatgacttctttcaaaagagaattgaagaattcttcataactggtgagggctacttcaatgaagtcctacaatttaaaacactaagcacactaagccccacggagccgtctcatgtcaggctaccaacagcggagcccttcaaatcttactttgctaagggcttcctttcaatagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtactttcataccaggaacttataaaatagtgatagacagaaaaaataagctaaatgaccgatgctcgctagtcactaactgtgtgataaagggaagagaggttcgtaagggccaatcagtgctgaggcagtacaaaacagaaattaagataggcaaggcatcaacaggctctaggaaactactgtccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccattaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccctggatagtcagaaagctattgcaagtgtcagagtccactggtgtggcattgaaacgaagcagttggctgattgtgctgcttgtgttactcacagtctcattgtcaccggtccaatcagcacctgttggtcatggtaagacaatcgaaacatatcagaccagagaaggattcacaagtatctgtctctttatgttaggaagcatcctattcatagtttcttgcctggtaaaggggctggttgacagtgtcagtgacagcttcttccccggcctgtctgtctgtaagacatgctctattggcagcataaatggctttgaaattgaatcgcataaatgctactgtagtttattttgctgcccctactgtaggcactgctctgctgacagagaaattcaccagttgcacttgagtatctgcaaaaaaagaaaaacggggagcaatgtcatgctggctgtctgcaagcgcatgtgctttaaggcaaccatagaagcaagcagaagagccctgctcatccgaagcattatcaataccacttttgtaatatgcattctaacattagcaatctgtgttgttagcacctctgcagtagagatggaagaccttccagcaggcacttgggagagagaggaagacctaacaaatttctgccatcaggaatgccaggtaaccgagacggaatgcctctgtccatacgaagctcttgtgctcaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgttttcgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacaatgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggcataccaggagatctacaaatttaccacattggcaacttgttgaaaggggatagagtaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcggtcaagagttttttttatggattgaagaatatgcttggcagtgtttttggtagttttttcgtaggcattttgttattccttaccccttttgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaaggaaaaaacagactgcttgatggtgagaggttggctgataggaaaattgctgagctgttctctacaaaaacacacattggctaa

SEQ ID NO: 3585 - RNA, 5067 nt, synthetic construct
  misc_feature 1..5067: note = derived and/or modified CDS sequence (wt) from CCHFV(81-R-2014)__KR814865.1__GP
  source 1..5067: mol_type = other RNA
atgcctaccaacattatgcatacactattagtgtgcttcattctttacctacagctgttgggtctaggaggagctcatggacagtcaaacgcaactgaacacaatggaacaaacaccaccacagtacccagcacaagtcaaagccccaagccacttgtgagcacaaccccaccacacgcactggaatcatcaaccatcaaacccaccacaccaacaagcgaaacagaaggctcaggggaaacggccccactcccaaacaccacccagggcccgcctccaccagagaccacaccagaacgccccgcaacaactgtcacaagtacgccaagtacagacaacacgaattccaccatacatgtgaccgacaacaaccccacatcaacaatcagcacaagtccatccagcagccccagcacgccatccacaccacaaggcatacatcatcctgcaaggagtctattgtcagtctcgagccctaagacagcaacaacaccaacaccgacgagccctggggagataaactcagaaaccagcagtctgcactcagccatgagcagaacaccaaccctccacacagcaacccaggtctccactgaaaatgccaaccacagcgcacctagacagtctgagtcctcagcacagccaacaaccacaagcctaatgacttccccagcacagtcaatccttctaatgagtgctgctcctacagctattcagaacacacatcccagcccaacaaataggtctaagaggaaccttgagatggaaataattttaactctgtctcaaggtctaaagaaatactacggtaagatactgaagctactacacctcaccttggaagaggacactgaaggcctgttagaatggtgtaagagaaaccttgggtcaaactgtgatgatgacttctttcaaaagagaataggagaattcttcatgactggtgagggctacttcaatgaagtcttacaatttaaaacactaagcacactaagccccacggagccgtctcatgccaggctaccaacagtggaacccttcaaatcttacttcgctaagggcttcctttcaatagattcaggttacttctctgccaaatgttatccaagatcatctacttcagggctccagctgatcaatgttacccaacacccagctaggatagcagaaacacccggacccaagacaacgagtctgaaaaccatcaactgtataaacctaagagcatcagtcttcaaagaacacagagaaattgagatcaatgtgcttcttcctcagattgcagtcaacctctcaaattgccatgttgtgatcaattcacatgtctgtgattactctttagacactgatgggccagtgaggcttcctcacatttaccatgaagggactttcataccaggaacttataaaatagtgatagacaagaaaaataagctaaatgaccgatgtacactagtcaccaactgtgtgataaaaggaagagaggttcgtaagggccaatcagtgctgaggcagtacaaaacagaaatcaagataggcaaggcatcaacaggctctaggaaactactgtccgaagagccaggtgatgactgcatatcaagaactcagctattgaggacagaaacagcagagatccatgatgacaactatggtggtccaggtgataaaataactatctgcaacggttcaaccattgtagatcagagactgggcagtgaactagggtgttataccatcaacagagtgaagtcattcaagctatgcgaaaacagcgccacagggaaaacctgtgagatagacagcactccggttaagtgcaggcaaggcttttgtttaaaaatcacccaagagggaaggggccacgtaaaattatctagaggctcagaggttgtcttggatgcctgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaactgaaacctcaaacttgtaccatatgtgagacagctcctgtcaatgcaatagatgctgaaatgcatgaccttaactgcagttacaatatatgcccttattgtgcatcaagattgacctccgatgggctagctaggcatgtgccacagtgccccaagcgaaaggaaaaagttgaggagactgagctgtacttgaacctggaaagaattccttggatcgtcagaaagctattgcaagtgtcagaatccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctatttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcaccagttacacttgagcatctgcaaaaaaagaaaaacgggtagcaatgtcatgctggctgtctgcaaacgcatgtgctttagagcaaccatagaggcaagcagaagagccctgctcatccgaagcattatcaataccacttttgtaatatgcattctaacattgacaatctgtgttgttagcacctctgcagtagagatggaaaaccttccagcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaaaaatttgctaaactcaacaagcttagaaacaagcttatcaatcgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaggatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaagtggaaggttgaatatataaaaactgaagccatagtatgtgttgagctcaccagccaagaaagacagtgcagtctgattgaggcaggtaccagattcaacttgggccctgtgactattaccctgtctgagccaagaaacatacagcagaagcttccccctgagattatcacgttgcatcccaaagttgaagagggcttctttgacttgatgcatgtgcaaaaagtgttgtctgcaagtacagtgtgtaaactgcagagttgcacacacggcataccaggagatctacaagtttaccacattggcaacttgctgaaaggagataggataaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcacaccaaaaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagccagcacaagtctcatggcgaggaagcttgagtttgggacagacagtaccttcaaggccttttcagctatgcccaaaacctctttatgtttttacattgtggagagagaatactgtaagagctgcagtgaagaggacacacaaaaatgtgttgacacaagacttgagcagccgcagagcatactaattgagcacaaaggaacgataattgggaagcagaatgatacttgcacagccaaggcaagctgttggttagagtcagtcaagagttttttttatggattgaagaatatgcttggtagtgtctttggtaattttttcataggcattctgttattccttgccccttttgtcctgttggtgcttttctttatgtttgggtggaaaatcttgttttgctttaaatgttgcaggaggaccagaggcttacttaagtatagacacctcaaagacgatgaggaaacaggctacagaaggattattgaaagactgaacaacaaaaaagggaaaaacagactgcttgatggtgaaaggttggctgataggaaaattgctgagctgttctccacaaaaacacacattggttaa

SEQ ID NO: 3586 - RNA, 5067 nt, synthetic construct
  misc_feature 1..5067: note = derived and/or modified CDS sequence (wt) from CCHFV(75-ST-2010)__KR814864.1__GP
  source 1..5067: mol_type = other RNA
atgcctaccaacattatgcatacactattagtgtgcttcattctttacctacagctgttgggtccaggaggagcccatggacagccaaacgcaactgaacacaacagaacaaacaccaccacagcacccagcacaagccaaagccccaagccacccgtgagcacagccccaccacacgcactggaatcacccaccatcaaatccaccacaccaacaagcgaaacagaaggctcaggggaaacgaccccacccccaaacaccacccagggcccgtctctaccagagaccacaccagaacgccccgcaacaactgccacaagtacgccaagcacagacaacacaaattccaccacacatgtgaccgacaacaaccctacatcaacaatcagcacaagtccatccagcagccccagcacgccatccacaccacgaggcatacatcatcctgcaaggaatctattgtcagtctcgagccctaagacagcaacaacaccaacaccaacgagccctggggagataagctcagaaaccagcagtctgcactcagccatgagcagaacatcaaccctctacacagcaacccaggcctccactgaaaatgccaaccacagcgcacctagacagtctgagtccccagcacagccgacaaccacaagcctaatgacctccccagcacaatcaatccttgtaatgagtgctgctcctacagctattcagaacatacatcccagcccaacgaataggtctaagaggaaccttgagatggaaataattttaactctgtctcaaggtctaaagaaatactacggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagatcatctacttcagggcttcagctgatcaatgttacccaacacccagctagaatagcagaaacacctggacccaagacaacgagtctgaaaaccatcaactgtataaacctaagagcatcagtcttcaaagaacacagagaaattgagatcaatgtgcttcttcctcagattgcagtcaacctctcaaattgccatgttgtaatcaattcacatgtctgtgattattctttagacactgatgggccagtgaggcttcctcacatttaccatgaaggaactttcataccaggaacttacaaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggtatcaacaggctctaggaaactactgtccgaagagtcaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagaaggaaggggccacgtaaaattatctagaggctcagaggttgttttggatgcttgcgactcaagctgcgaagtaatgatacctaaaggcactggagatatcttggtggactgttcaggtggacagcaacatttcttaaaagacaacttaattgacctagggtgcccccatatcccgctattgggtaaaatggccatttacatctgcagaatgtcaaatcaccctagaacaactatggcttttctcttctggttcagctttggctatgtgatcacctgtttattttgcaaggctcttttttattcattgataatcattgggacactagggaaaaagatcaagcaatatagggaattgagacctcaaacctgtaccatatgtgagacagctcctgtcaatgcaatagatgctgaaatgcatgaccttaactgcagttacaatatatgtccttattgtgcatcaagattgacctccgatgggctagctaggcatgtgccacaatgccccaagcggaaggaaaaagttgaggagactgagctgtacttgaacctggaaagaataccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctccattggcagtataaatggctttgaaattgaatcgcataaatgctactgtagcctactttgctgcccctactgtaggcactgctctgctgacagagaaatccaccagttacacttgagtatctgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattaacaatctgtgttgttagcacctctgcagtagagatggaaaaccttccatcaggcacttgggagaaagaggaagacctgacaaatttctgtcatcaggaatgccaggtgaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaagtggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtacaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccaacctacggtgcaggtgagatcactgtgctggttgaggttgctgacatggagttgcataccaagaaagttgagatatcaggcctgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggcaactttttcataggcattttgttattccttgccccttttgtcctgttggtgcttttctttatgtttggatggaaaatcttgttttgcttcaaatgttgcaggagggccagaggcttgcttaagtatagacacctaaaagacgatgaggaaacaggctacagaaagattattgaaaggctgaacaacaaaaaaggaaaaaacagactgcttgatggtgaaaggttggctgataggaaaattgctgagctgttctccacaaaaacacacattggttaa

SEQ ID NO: 3587 - RNA, 5067 nt, synthetic construct
  misc_feature 1..5067: note = derived and/or modified CDS sequence (wt) from CCHFV(75-R-2012)__KR814863.1__GP
  source 1..5067: mol_type = other RNA
atgcctaccaacattatgcatacactattagtgtgcttcattctttacctacagctgttgggtctaggaggagctcatagacagtcaaacgcaactggacacaacggaacaaacaccaccacagcacccagcacaagtcaaagccccaagccacttgtgagcacagccccaccacacgcactggaatcatccatcatcaaacacaccacaccagtaagcgaaacagaaggctcaggggaaacgaccccacccccaaacaccacccagggcccgtctccactagagaccacaccagaacgccccgcaacaactgccacaagtacgccaagcacagacaacacgaattccaccacacatgtgaccgacaacaaccctacatcaacaatcagcacaagtccatccagcagccccagcacgccatccacaccacaaggcatacatcatcctgcaaggaatctattgtcagtctcgagccttaagacagcaacaacaccaacaccaacgagcccaggggagataagctcagaaaccagcagtctgcactcagccatgagcagaacatcaaccctctacacagcaacccaggtctccactgaaaatgccaaccacagcgcacctagacagtctgagtcctcagcacagcagacaaccacaagcccaatgacttccccagcacaatcaatccttgtaatgagtgctgctcctacagctattcagaacacacatcccagcccaacgaataggtctaagaggaaccttgagatggaaataattttaactctgtctcaaggtctaaagaaatattatggtaagatactgaagcttctgcacctcaccttggaagaggacactgaaggcctgttagaatggtgtaagagaaaccttggatcaaactgtgatgatgacttctttcagaagagaatagaagaattcttcatgaccggtgagggctacttcaatgaagtcttacaatttaaaacactaagcacacaaagccccacggagccgtctcatgccaggccaccaacagtggagcccttcaaatcttacttcgctaagggcttcctttcaatagattcaggttacttctctgccaaatgttatccaagattatctacttcagggcttcagctgatcaatgtcacccaacacccagctagaatagcagaaacacctggacccaagacaacgagtctgaaaaccatcaactgtataaacctaagagcatcagtcttcaaagaacacagagaaattgagatcaatgtgcttcttcctcagattgcagtcaacctctcaaattgccatgttgtaatcaattcacatgtctgtgattattctttagacactgatgggccagtgaggcttcctcacatttaccatgaagggactttcataccaggaacttataaaatagtgatagacaaaaaaaataagctaaatgaccgatgtacactggtcaccaactgtgtgataaaaggaagagaggttcgtaagggccaatcagtgctgaggcagtacaagacagaaatcaagataggcaaggcatcaacaggctctagaaaactactgtccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcgctccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaacttaattgacctagggtgcccacatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagcccctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctagaaagaattccttggattgtcagaaagctattgcaagtgtcagagtccactggtgtggcattgaagcgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttaacagtgtcagtgacagcttcttccccggcctgtctgtttgtaagacatgctctattggcagtataaatggctttgaaattgaatcgcataaatgctactgtagcctattttgctgcccctactgtaggcactgctctgctgacagagaaattcatcagttacacttgagtatttgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtccgaatcaattatgaaactggaggaaaggacaggagtcagctgggatctaggcgtagaagatgcctctgagtccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggtactggctgcacctgctgcggggtggatgtaaaagacctttttacagatcacatgtttgtcaaatggaaggttgaatatataaaaactgaagccatagtatgtgttgagctcaccagtcaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcaccgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttctttatggattgaaaaatatgcttggtagtgtatttggtaactttttcataggcattttgttattccttgccccttttgtcctgttggtgcttttctttatgtttggatggaaaatcttgttctgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggttaa

SEQ ID NO: 3588 - RNA, 5067 nt, synthetic construct
  misc_feature 1..5067: note = derived and/or modified CDS sequence (wt) from CCHFV(52-R-2014)__KR814862.1__GP
  source 1..5067: mol_type = other RNA
atgcctaccaacattatgcatacgctattagtgtgcttcattctttacctacagctgttgggtctaggaggagctcatagacagtcaaacgcaactgaacacaacggaacaaacaccaccacagcacccagcacaagccaaagccccaagccacctgtgagcacagccccaccacacgcaccagaatcatccaccatcaaacccaccacaccagcaagcgaaacagaaggctcaggggaaacgaccccacccccaaacaccacccagggcccgtctccaccagaggccacaccagaacgccccgcaacaactgccacaagtacgccaagcacagacaacacgaactccaccacacacgcgaccgacaacaaccctacatcaacaatcagcacaagtccatccagcagccccagcacgccatccacaccacaaggcatacatcatcctgcaaggaatctattgtcagtctcgagccctaagacagcaacaacaccaacaccaacgagccctggggatataagctcagaaaccagcagtctgcactcagccatgagcagaacaccaaccctccacacagcaacccaggcctccactgaaaatgccaaccacagcgcacctagacagtctgagtcctcagcacagcagacaaccacaagcccaatgacttccccagcacaaccaatccttgtaatgagtgctgctcctacagctattcagaacatacatcccagcccaacgaataggtctaagaggaaccttgagatggaaataattttaactctgtctcaaggtctaaagaaatactatggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagattatctacttcagggcttcagctgatcaatgtcacccaacacccagctagaatagcagaaacacctggacccaagacaacaagtctgaaaaccatcaactgtataaacctaagagcatcagtcttcaaagaacacagagaaattgagatcaatgtgctccttcctcagattgcagtcaacctctcaaattgccatgttgtaatcaattcacatgtctgtgattattctttagacactgatgggccagtgaggcttcctcacatttaccatgaagggactttcataccaggaacttataaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggcatcaacaggctctaggaaactactgtccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttatactatcaacagggtgaagtcattcaagctatgcgaaaacagcgccacagggaaaacctgtgagatagacagcactccggttaagtgcaggcaaggtttttgtttaaaaatcacccaagagggaagaggccacgtaaaattatctagaggctcagaggttgttttggatgcttgcgacacaagctgcgaagtaatgatacctaaaggcactggagatatcctggtggactgttcaggtggacagcaacatttcttaaaagacaatttaattgacctagggtgcccccatgtcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtgtctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcatcagttacacttgagtatctgcaaaaaaagaaaaatgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagatgatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacttgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaggctgttggctagagtcagtcaagagttttttttatggattgaaaaatatgcttggtagtgtatttggtaactttttcataggcattttgctattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgaactgttctccacaaaaacacacattggttaa

SEQ ID NO: 3589 - RNA, 5067 nt, synthetic construct
  misc_feature 1..5067: note = derived and/or modified CDS sequence (wt) from CCHFV(47-ST-2013)__KR814861.1__GP
  source 1..5067: mol_type = other RNA
atgcccatcaacattatgcatacactattagcgtgcttcattctttacctacagctgtcgggtttaggaggagctcatggacagtcaaacgcaactgaacacaatggaacaaacaccaccacagtacccggcacaagtcaaagccccaaaccacccgcgagcaccactttaccacacacaccagaatcctccaccgtcaaactcaccacaccaacaagcgaaacagaaggctcaggggaaacgaccccacccccaaacaccacccagggcctgcccccaccagggaccacaccagaacgctccgcaacaaccgccacaagcacgtcaagcacagacaacatgaattccaccacacagatgaccggcaacacccccacaccaacagtcaacatgagtccatccagcagccccagcatgccatccacatcacaaggcatacattatcccgtaaggagtctattgtcagtcccgagccccaagacagcaacaacaccgacaccagtgagccctggagagatgagcccggaaaccagcagtcagcactcagccacgagcagaataccaaccctctacacagcaacccaggtttccactgagaacaccaaccgcagcacacctagacaatctaagtcctcagtacagccggcaacccaaagcccaataactcccccagcgcaaacaatccttctgatgagtgctgctcctaaagctattcaggacatgcatcccagcccaacaaacaggtccaagaggaaccttgaggtggaaataattttaactctgtctcaaggtctaaagaaatattacggtaaaatactgaagcttctgcaccttaccttggaagaggatactgaaggcctgttagaatggtgcaagagaaaccttgggtcaaattgtgatgatgacttctttcaaaagagaatagaagaattcttcataactggtgagggctacttcaatgaagtcctacaatttaaaacactaagcacactaagccccacggagccgtctcatgtcaggctaccaacagcggagcccttcaaatcttactacgctaagggcttcctttcattagattcgggttacttctctgccaaatgttatccaagatcatccacttcagggcttcagctgatcaatgtcacccaacacccagctaggatagcagaaacacctggacccaaaacaacaagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattatcctttagacactgacgggccagtgaggcttcctcgcattcaccatgaaggtactttcataccaggaacttataaaatagtgatagacaaaaaaaataagctaaatgaccgatgctcgctagtcactaactgtgtgataaagggaagagaggttcgtaagggccaatcagtgctgaggcagtacaaaacagaaattaagataggcaaggcatcaacaggctctaggaaactactgtccgaagagccaggtgacgactgcatatcaagaactcagctgttgaagacagaaacagcagagatccatgacgacaactatggtggtccaggtgacaaaataactatctgcaatggttcaaccattgtagatcagagactgggtagtgaactagggtgttataccatcaacagggtgaagtcattcaagctatgcaaaaacagtgccacagggaaaacctgtgagatagacagcactccggtcaagtgcaggcaaggtttttgtttgaaaatcacccaagagggaaggggccacgttaaattatccaggggctcagaggttgttttggatgcttgcgactcgagctgtgaaataatgatacctaaaggcactggagatatcctagtagactgctcaggtggacagcaacatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagattgacctctgatgggctagctagacatgtgacacaatgccctaagcgaaaggagaaagttgaggagactgaactgtatttgaacctggaaagaattccttggatagtcagaaagttattgcaagtgtcagagtccactggtgtggcattgaaacgaagcagttggctgattgtgctgcttgtgttactcacagtctcattgtcaccggttcaatcagcacctgttggtcatggtaagacaattgaaacatatcagaccagagaaggattcacaagtatctgtctctttatgttaggaagcatcctattcatagtttcctgcctggtaaaggggctggttgacagtgtcagtgacagcttcttccccggcctgtctgtctgtagaacatgctctattggcagtataaatggctttgaaattgaatcgcacaaatgctactgtagtttattttgctgcccctactgtaggcactgctctgctgacagagaaattcaccagttgcacttgagtatctgcaaaaaaagaaaaacggggagcaatgtcatgctggctgtctgcaagcgcatgtgctttaaggcaaccatagaagcaagcagaagagccctgttcatccggagcattatcaataccacttttgtaacatgcattctaacattagcaatctgtgttgttagcacctctgcagtagagatggaagaccttccagcaggcacttgggagagagaggaagacctgacaaatttctgccatcaggaatgccaggtgaccgagacggaatgcctctgtccatacgaagctcttgtgctcaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcctggtcacaggcaggtctgaatcaattatgaaactagaggaaaggacaggagtcagctgggatctaggtgtagaagatgcctctgaatccaaattacttaccgtctctatcatggatttgtcacaaatgtattcccctgtttttgagtacttatcaggagatagacaggttgaagaatggcccaaggcaacctgcacaggtgaatgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttaggtcctgtgactatcaccctgtctgagccaagaaacattcagcagaagcttccccctgagatcattacgctgcatcccaaaattgaagaaggcttctttgacttgatgcatgtacaaaaagtgttatctgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactactgcaacatgggggattggccttcttgcacatacacaggagtgacccaacataatcatgctgcatttgtaaacttgcttaacattgaaactgattacacaaaaaccttccacttccactctaaaagagtcacagcacatggagacacaccacaattagacttaaaagcaaggccgacctacggtgcaggtgagatcaccgtgctggttgaggttgctgacatggagttgcataccaagaaagttgaggtatcaggcttgaaatttgcaagtctggcttgcacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagtacattcaaggcattttcagctatgcctaaaacctctttatgcttttacattgtggagagggaatactgcaaaagctgcagtgaagatgatacaaaaaaatgtgttgacacaaaacttgaacagccacagagcatactaattgagcacaaagggacaataattggaaagcagaatgatacttgcacagccaaggcaagttgttggctagagtcagtcaagagttttttttatggattgaagaatatgcttggcagtgtttttggtaatttttttgtaggcattttgttattccttgccccttttgtcttgttggtgcttttctttatgtttggatggaaaatcttgttttgctttaagtgttgcaggaggaccagaggcttgtttaagtatagacacctcaaagatgatgaggaaacaggctacagaaggattattgaaagactgaacagcaaaaaagggaaaaacagactgcttgatggtgagaggttggctgataggaaaattgctgagctgttctctacgaaaacacacattggctaa

SEQ ID NO: 3590 - RNA, 5067 nt, synthetic construct
  misc_feature 1..5067: note = derived and/or modified CDS sequence (wt) from CCHFV(46-ST-2012)__KR814860.1__GP
  source 1..5067: mol_type = other RNA
atgcctaccaacattatgcatacactattagtgtgcttcattctttacctacagctgttgggtctaggaggagctcatggacagtcaaacgcaactgaacacaatggaacaaacaccaccacagtacccagcacaagtcaaagccccaagccacttgtgagcacaaccccaccacatgcactggaatcatcaaccatcaaacccaccacaccaacaagcgaaacagaaggctcaggggaaacggccccactcccaaacaccacccagggcccgcctccaccagagaccacaccagaacgccccgcaacaactgtcacaagtacgccaagtacagacaacacgagttccaccatacatgtgaccgacaacaaccccacatcaacaatcagcacaagtccatccagcagccccagcacgccatccacaccacaaggcatacatcatcctgcaaggagtctattgtcagtctcgagccctaagacagcaacaacaccaacaccgacgagccctggggagataaactcagaaaccagcagtctgcactcagccatgagcagaacaccaaccctccacacagcaacccaggtctccactgaaaatgccaaccacagcgcacctagacagtctgagtcctcagcacagccaacaaccacaagcctaatgacttccccagcacaatcaatccttctaatgagtgctgctcctacagctattcagaacatacatcccagcccaacaaataggtctaagaggaaccttgagatggaaataattttaactctgtctcagggtctaaagaaatactacggtaagatactgaagctactacacctcaccttggaagaggacactgaaggcctgttagaatggtgtaagagaaaccttgggtcaaactgtgatgatgacttctttcaaaagagaatagaagaattcttcatgactggtgagggctacttcaatgaagtcttacaatttaaaacactaagcacactaagccccacggagccgtctcatgccaggctaccaacagtggaacccttcaaatcttacttcgctaagggcttcctttcagtagattcaggttacttctctgccaaatgttatccaagatcatctacttcagggctccagctgatcaatgttacccaacacccagctaggatagcagaaacacccggacccaagacaacgagtctgaaaaccatcaactgtataaacctaagagcatctgtcttcaaagaacacagagaaattgagatcaatgtgcttcttcctcagattgcagtcaacctctcaaattgccatgttgtgatcaattcacatgtctgtgattactctttagacactgatgggccagtgaggcttcctcacatttaccatgaagggactttcataccaggaacttataaaatagtgatagacaagaaaaataagctaaatgaccgatgtacactagtcaccaactgtgtgataaaaggaagagaggttcgtaagggccaatcagtgctgaggcagtacaaaacagaaatcaagataggcaaggcatcaacaggctctaggaaactactgtccgaagagccaggtgatgactgcatatcaagaactcagctattgaggacagaaacagcggagatccatgatgacaactatggtggtccaggtgataaaataactatctgcaacggttcaaccattgtagatcagagactgggcagtgaactagggtgttataccatcaacagagtgaagtcattcaagctatgcgaaaacagcgccacagggaaaacctgtgagatagacagcactccggttaagtgcaggcaaggcttttgtttaaaaatcacccaagagggaaggggccacgtaaaattatctagaggctcagaggttgtcttggatgcctgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaactgaaacctcaaacttgtaccatatgtgagacagctcctgtcaatgcaatagatgctgaaatgcatgaccttaactgcagttacaatatatgcccttattgtgcatcaagattgacctccgatgggctagctaggcatgtgccacagtgccccaagcgaaaggaaaaagttgaggagactgagctgtacttgaacctggaaagaattccttggatcgtcagaaagctattgcaagtgtcagaatccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctatttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcaccagttacacttgagcatctgcaaaaaaagaaaaacgggtagcaatgtcatgctggctgtctgcaaacgcatgtgctttagagcaaccatagaggcaagcagaagagccctgctcatccgaagcattatcaatgccacttttgtaatatgcattctaacattgacaatctgtgttgttagcacctctgcagtagagatggaaagccttccagcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaaaaatttgctaaactcaacaagcttagaaacaagcttatcaatcgaggcaccatggggagcaataaatgtccagtcaacctttaaaccaacagtatcgactgcaaacatagcactcagttggagctcagtggagcacagaggcaacaagatcttagtcacaggcaggtctgaatcaattatgaaactggaggaaaggacaggagtcagctgggatctaggcgtagaggatgcctctgaatccaaattacttaccgtctctatcatggatctgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaagtggaaggttgaatatataaaaactgaagccatagtatgtgttgagctcaccagccaagaaagacagtgcagtctgattgaggcaggtaccagattcaacttgggccctgtgactattaccctgtctgagccaagaaacatacagcagaagcttccccctgagattatcacattgcatcccaaagttgaagagggcttctttgacttgatgcatgtgcaaaaagtgttgtctgcaagtacagtgtgtaaactgcagagttgcacacacggtataccaggagatctacaagtttaccacattggcaacttactgaaaggagataggataaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcacaccaaaaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagccagcacaagtctcatggcgaggaagcttgagtttgggacagacagtaccttcaaggccttttcagctatgcccaaaacctctttatgtttttacattgtggagagagaatactgtaagagctgcagtgaagaggacacacaaaaatgtgttgacacaagacttgagcagccgcagagcatactaattgagcacaaaggaacgataattggaaagcagaatgatacttgcacagccaaggcaagctgttggttagagtcagtcaagagttttttttatggattgaagaatatgcttggtagtgtctttggtaattttttcataggcattctgttattccttgccccttttgtcctgttggtgcttttctttatgtttgggtggaaaatcttgttttgctttaaatgttgcaggaggaccagaggcttacttaagtatagacacctcaaagacgatgaggaaacaggctacagaaggattattgaaagactgaacaacaaaaaagggaaaaacagactgcttgatggtgaaaggttggctgataggaagattgctgagctgttctccacaaaaacacacattggttaa

SEQ ID NO: 3591 - RNA, 5067 nt, synthetic construct
  misc_feature 1..5067: note = derived and/or modified CDS sequence (wt) from CCHFV(44-ST-2010)__KR814859.1__GP
  source 1..5067: mol_type = other RNA
atgcccatcaacattatgcatacactattagtgtgcttcattctttacctacagctatcgggtttaggaggagctcatggacagtcaaacgcaactgaacacaatggaacaaacaccaccacagtacccggcacaagtcaaagccccaagccacccgcgagcaccactctaccacacacaccagaatcctccaccgtcaaactcaccacaccaacaagcgaaacagaaggctcaggggaaacgaccccacccccaaacaccacccagggcctgcccccaccagggaccacaccagaacgccccgcaacaaccgccacaagcatgtcaagcacagacaacatgaattccaccacacaggtgaccgacaacacccccacatcaacagtcagcataagtccatccagcagccccagcatgccatccacatcacaaggcatacattatcccgtaaggagtctattgtcagtctcgagccctaagacagtaacaacaccgacaccaatgagccctggagagatgagcccggaaaccagcagtcaacactcagccatgagcagaataccaaccctctacacagcaacccaggtctccactgagaacaccaaccgcagcacacctagacaatccgagtcctcagcacagccggcaacccaaagcccaacaacttccccaacgcaaacaatccttctgatgagtgctgctcctaaagctattcaggacatgcatcccagcccaacaaacaggtccaagaggaaccttgaggtggaaataattttaactctgtctcaaggtctaaagaagtattacggtaaaatactgaagcttctgcaccttaccttggaagaggatactgaaggcctgttagaatggtgtaagagaaaccttgggtcaaattgtgatgatgacttctttcaaaagagaatagaagaattcttcataactggtgagggctacttcaatgaagtcctacaatttaaaacactaagcacactaagccccacggagccgtctcatgtcaggctaccaacagcggagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctaaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtactttcataccaggaacttataaaatagtgatagacaaaaaaaataagctaaatgaccgatgctcgctagtcactaactgtgtgataaagggaagagaggttcgtaaaggccaatcagtgctgaggcagtacaaaacagaaattaagataggcaaggcatcaacaggctctaggaaactactgtccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtaaagtcattcaagctatgcgaaaacagtgccacagggaaaacctgtgagatagacagcactccggtcaagtgcaggcaaggtttttgtttgaaaatcacccaagaggggaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaagatggccatttacatttgcagaatgtcaaatcatcccaggacaaccatggctttcctcctctggttcagttttggctatgtaatcacctgtatattttgcaaagctcttttttattcattgataattattgggacactaggaaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgaagcagctggctgattgtgctgcttgtgttactcacagtctcattgtcaccggttcaatcagcacctgttggtcatggtaagacaattgaaacatatcagaccagagaaggattcacaaatatctgtctctttatgttaggaagcatcctattcatagtttcttgcctggtaaaggggctggttgacagtgtcagtgacagctttttccccggcctgtctgtctgtaagacatgctcttttggcagtataaatggctttgaaattgaatcgcataaatgctactgtagtttattttgctgcccctactgtaggcactgctctgctgacagagaaattcaccagttgcacttgggtatctgcaaaaaaagaaaaacggggagcaatgtcatgctggctgtctgcaagcgcatgtgctttaaggcaaccatagaagcaagcagaagagccttgctcatccgaagcattatcaataccacttttgtaatatgcatcctaacattagcaatctgtgttgttagcacttctgcagtagagatggaaaatcttccagcaggcacttgggagagagaggaagacctgacaaatttctgccatcaggaatgccaggtaagcgagacggaatgcctctgtccatacgaagctcttgtgctcaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccattctaaaagagtcacagcacatggagacacaccacaattagacttaaaagcaaggccgacttacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgatcagccacagagcatactaattgagcacaaagggaccataattggaaagcagaatgacacttgcacagccaaggcaagttgttggctagagtcagtcaagagttttttttatggattgaagaatatgcttggcagtgtttttggtaattttttcgtaggcattttgttattccttgccccctttgtcttgttggtgcttttctttatgtgtggatggaaaatcttgttttgctttaagtgttgcaggaggaccagaggcttgtttaagtatagacacctcaaagatgatgaggaaacaggctacagaaggattattgaaagactgaacagcaaaaaaggaaagaacagactgcttgatggtgagaggttggctgataggaaaattgctgagctgttctctacaaaatcacacattggctaa

SEQ ID NO: 3592 - RNA, 5067 nt, synthetic construct
  misc_feature 1..5067: note = derived and/or modified CDS sequence (wt) from CCHFV(37-R-2013)__KR814858.1__GP
  source 1..5067: mol_type = other RNA
atgcctaccaacattatgcatacgctattagtgtgcttcattctttacctacagctgttgggtctaggaggagctcatagacagtcaaacgcaactgaacacaacggaacaaacaccaccacagcacccagcacaagccaaagccccaagccacctgtgagcacagccccaccacacgcaccagaaacatccaccatcaaacccaccacaccagcaagcgaaacagaaggctcaggggaaacgaccccacccccaaacaccacccagggcccgtctccaccagaggccacaccagaacgccccgcaacaactgtcacaagtacgccaagcacagacaacacgaactccaccacacacgcgaccgacaacaaccctacatcaacaatcagcacaagtccatccagcagccccagcacgccatccacaccacaaggcatacatcatcctgcaaggaatctattgtcagtctcgagccctaagacagcaacaacaccaacaccaacgagccctggggatataagctcagaaaccagcagtctgcactcagccatgagcagaacaccaaccctccacacagcaacccaggcctccactgaaaatgccaaccacagcgcacctagacagtctgagtcctcagcacagcagacaaccacaagcccaatgacttccccagcacaaccaatccttgtaatgagtgctgctcctacagctattcagaacatacatcccagcccaacgaataggtctaagaggaaccttgagatggaaataattttaactctgtctcaaggtctaaagaaatactatggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagattaactacttcagggcttcagctgatcaatgtcacccaacacccagctagaatagcagaaacacctggacccaagacaacaagtctgaaaaccatcaactgtataaacctaagagcatcagtcttcaaagaacacagagaaattgagatcaatgtgctccttcctcagattgcagtcaacctctcaaattgccatgttgtaatcaattcacatgtctgtgattattctttagacactgatgggccagtgaggcttcctcacatttaccatgaagggactttcataccaggaacttataaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggcatcaacaggctctaggaaactactgtccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgacacaagctgcgaagtaatgatacctaaaggcactggagatatcctggtggactgttcaggtggacagcaacatttcttaaaagacaatttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtgtctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcatcagttacacttgagtatctgcaaaaaaagaaaaatgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagatgatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacttgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgttacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggttaa

SEQ ID NO: 3593 - RNA, 5067 nt, synthetic construct
  misc_feature 1..5067: note = derived and/or modified CDS sequence (wt) from CCHFV(36-ST-2014)__KR814857.1__GP
  source 1..5067: mol_type = other RNA
atgcccatcaacattatgcatacactattagtgtgcttcattctttacctacagctgtcgggtttaggaggagctcatggacagtcaaacgcaactgaacacaatggaacaaacaccaccacagtacccggcacaagtcaaagccccaagccacccgcgagcaccactctaccacacacaccagaatcctccaccgtcaaactcaccacaccaacaagcgaaacagaaggctcaggggaaacgaccccacccccaaacaccacccagggcctgcccccaccagggaccacaccagaacgccccgcaacaaccgccacaagcatgtcaagcacagacaacatgaattccaccacacaggtgaccgacaacacccccacatcaacagtcagcataagtccatccagcagccccagcatgccatccacatcacaaggcatacattatcccgtaaggagtctattgtcagtctcgagccctaagacagtaacaacaccgacaccaatgagccctggagagatgagcccggaaaccagcagtcaacactcagccatgagcagaataccaaccctctacacagcaacccaggtctccactgagaacaccaaccgcagcacacctagacaatccgagtcctcagcacagccggcaacccaaagcccaacaacttccccaacgcaaacaatccttctgatgagtgctgctcctaaagctattcaggacatgcatcccagcccaacaaacaggtccaagaggaaccttgaggtggaaataattttaactctgtctcaaggtctaaagaagtattacggtaaaatactgaagcttctgcaccttaccttggaagaggatactgaaggcctgttagaatggtgtaagagaaaccttgggtcaaattgtgatgatgacttctttcaaaagagaatagaagaattcttcataactggtgagggctacttcaatgaagtcctacaatttaaaacactaagcacactaagccccacggagccgtctcatgtcaggctaccaacagcggagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctaaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtactttcataccaggaacttataaaatagtgatagacaaaaaaaataagctaaatgaccgatgctcgctagtcactaactgtgtgataaagggaagagaggttcgtaaaggccaatcagtgctgaggcagtacaaaacagaaattaagataggcaaggcatcaacaggctctaggaaactactgtccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtaaagtcattcaagctatgcgaaaacagtgccacagggaaaacctgtgagatagacagcactccggtcaagtgcaggcaaggtttttgtttgaaaatcacccaagaggggaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaagctcttttttattcattgataattattgggacactaggaaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgaagcagctggctgattgtgctgcttgtgttactcacagtctcattgtcaccggttcaatcagcacctgttggtcatggtaagacaattgaaacatatcagaccagagaaggattcacaaatatctgtctctttatgttaggaagcatcctattcatagtttcttgcctggtaaaggggctggttgacagtgtcagtgacagctttttccccggcctgtctgtctgtaagacatgctctattggcagtataaatggctttgaaattgaatcgcataaatgctactgtagtttattttgctgcccctactgtaggcactgctctgctgacagagaaattcaccagttgcacttgggtatctgcaaaaaaagaaaaacggggagcaatgtcatgctggctgtctgcaagcgcatgtgctttaaggcaaccatagaagcaagcagaagagccttgctcatccgaagcattatcaataccacttttgtaatatgcatcctaacattagcaatctgtgttgttagcacttctgcagtagagatggaaaatcttccagcaggcacttgggagagagaggaagacctgacaaatttctgccatcaggaatgccaggtaagcgagacggaatgcctctgtccatacgaagctcttgtgctcaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccattctaaaagagtcacagcacatggagacacaccacaattagacttaaaagcaaggccgacttacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgatcagccacagagcatactaattgagcacaaagggaccataattggaaagcagaatgacacttgcacagccaaggcaagttgttggctagagtcagtcaagagttttttttatggattgaagaatatgcttggcagtgtttttggtaattttttcgtaggcattttgttattccttgccccctttgtcttgttggtgcttttctttatgtgtggatggaaattcttgttttgctttaagtgttgcaggaggaccagaggcttgtttaagtatagacacctcaaagatgatgaggaaacaggctacagaaggattattgaaagactgaacagcaaaaaaggaaagaacagactgcttgatggtgagaggttggctgataggaaaattgctgagctgttctctacaaaatcacacattggctaa

SEQ ID NO: 3594 - RNA, 5067 nt, synthetic construct
  misc_feature 1..5067: note = derived and/or modified CDS sequence (wt) from CCHFV(24-R-2012)__KR814856.1__GP
  source 1..5067: mol_type = other RNA
atgcctaccaacattatgcatacgctattagtgtgcttcattctttacctacagctgttgggtctaggaggagctcatagacagtcaaacgcaactgaacacaacggaacaaacaccaccacagcacccagcacaagccaaagccccaagccacctgtgagcacagccccaccacacgcaccggaatcatccaccatcaaacccaccacaccagcaagcgaaacagaaggctcaggggaaacgaccccacccccaaacaccacccagggcccgtctccaccagaggccacaccagaacgcaccgcaacaactgccacaagtacgccaagcacagacaacacgaactccaccacacacgcgaccgacaacaaccctacatcaacaatcagcacaagtccatccagcagccccagcacgccatccacaccacaaggcatacatcatcctgcaaggaatctattgtcagtctcgagccctaagacagcaacaacaccaacaccaacgagccctggggatataagctcagaaaccagcagtctgcactcagccatgagcagaacaccaaccctccacacagcaacccaggcctccactgaaaatgccaaccacagcgcacctagacagtctgagtcctcagcacagcagacaaccacaagcccaatgacttccccagcacaaccaatccttgtaatgagtgctgctcctacagctattcagaacatacatcccagcccaacgaataggtctaagaggaaccttgagatggaaataattttaactctgtctcaaggtctaaagaaatactatggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagattatctacttcagggcttcagctgatcaatgtcacccaacacccagctagaatagcagaaacacctggacccaagacaacaagtctgaaaaccatcaactgtataaacctaagagcatcagtcttcaaagaacacagagaaattgagatcaatgtgctccttcctcagattgcagtcaacctctcaaattgccatgttgtaatcaattcacatgtctgtgattattctttagacactgatgggccagtgaggcttcctcacatttaccatgaagggactttcataccaggaacttataaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggcatcaacaggctctaggaaactactgtccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgacacaagctgcgaagtaatgatacctaaaggcactggagatatcctggtggactgttcaggtggacagcaacatttcttaaaagacaatttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtgtctgtctctttatgttaggaagcatcctgtttttagtctcttgcttggtgaaggggctggttgacagtgtcagtgacagcttcttccctggcctgtctgtctgtaagacatgctctattggcagtataaatggctttgaaattgaatcgcataaatgctactgtagcctattttgctgcccctactgtaggcactgctctgctgacagagaaattcatcagttacacttgagtatctgcaaaaaaagaaaaatgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacttgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggttaa

SEQ ID NO: 3595 - RNA, 5064 nt, synthetic construct
  misc_feature 1..5064: note = derived and/or modified CDS sequence (wt) from CCHFV(Oman-199809166)__KR864901.1__GP
  source 1..5064: mol_type = other RNA
atgcccgtcaacactatgcacacactgctagtgtatgctgtcttttgcttgcagctatggagtccaggaggaactcgtggactgtcaaatgaaactcaacacaatgaaacaggtatcacaagagcacctgaagggagccaaggacccagtttgcctgtaagcacagcatcacccatcatgtcagacccctccatcaccacactctcagcgtcgaccagtggactagaaggctcaggggacacgactcccccagccatcacacaaggcccgaccctaccagagaccacgccggaaccctccacaacaaccggcacaaacgcattcagcacagccattgccaatgtcagtacacagacagtcaaggacacccccacaccgacagtacaaacaagtccacctagcactcccgacgcatctaccataccacagggcacacatcacaccgcaaggggtctgctgtcagtcaccgtcacaaagccagaagaagtaccaacaccaacaggcccagaacaagcaagcatagagaccaatagctcacgcctagcaactagcaagacaccgtccccctctccaacagctcaggttaccactgaaaacagcaaccctaatacctccagacagctcgtgctctcaacacaaccagcaacctcaagcccagtgacctctccagcacagctgaacttcgtgcagagtgctactaccatagccgttcaagatgcacacccaagcccaacaaacaggtccaagagaaaccttgagatggaagtaattttgactttatctcaaggtttaagaaagtactacggcagaatactgaaacttctggaccttaccttagaagaagacaccgaaggactgctggagtggtgtaagagaaatcttggtctaacctgtgacgataacttctttcagaagaggatagaagagttcttcttgactggtgagggtcacttcaatgaagttttacagttcaaaaccccaagcacactgagccctacagaatctgctagtgtagggttaccaacagttgagcccttcaaatcttactttgctaaaggctttctttcaatagactcaggttacttctctgccaagtgttatccaagggcgtctaactcagggcttcagttaatcaatgtcactcaacattcagctagaatagcagacacacctggacctaagatcacaaatctgaaaaccatcaattgcataaacctaaaggcattggtctttaaagagcatagagagattgaaatcaatgttcttctccctcaagtcgcagtcaatctctcaaactgccatgtccacatcaaatcgcatgtctgtgattattctttagacatcgacggaacagtcaggctaccccgtatccaccatgaaggaactttcataccaggaacttacaaaatagtgatagacaaaaaaaacaaacaaaacgatagatgcaacttggttaccaattgtgtaataaaaggaagggaagtgcgtaaaggccagtcagtgttaagacagtacagaacagaaatcaggatcggcaaggcatcttctggctccagaagactgctgtccgaagagtctggtgaagactgtatatcaaggactcagctgttgaggacagaaactgcagaaatccatggtgataactatggtggtccaggtgacaaaataaccatctgcaatggttcaaccattgtagatcaaaggctgggtagtgaactggggtgttacactatcaatagggtgaagtcatttaagctatgcgaaaacagtgccacaggtaagtcctgtgaaatagataacactccagtaaaatgcaagcaaggtttttgcttgaaaataacccaagaaggaaggggccacgtgaagctttcaagagactcagaagttgtcctggacgcctgcgattcaagctgtgaaataatgataccaaagggcactggagacatcctggttgactgctcaggtgggcagcagcacttcttaaaagacaacctgattgatctgggatgccccaacatcccattattaggcaaaatggcaatctacatttgtagaatgtcaaatcatcctaaaacaactatggcttttcttttttggtttagctttggttatgtgataacctgcatactttgtaaagtcattttttatctattgatagttgttggaactttagggaaaaagtttaaacagtatagagagttaaaacctcagacctgcacaatatgtgaaacaactcctgtcaatgcaatagatgctgagatgcacgatctcaattgtagttacaatatatgtccttattgtgcatctaggttaacttcagatggtcttgccagacatgtaatgcagtgtcctaagcggaaggaaaaaatagaagaaaccgaattatacctgaacttagaaagaatcccttgggttgtcagaaaactactgcaggtatcagaatccactggtgtagcactaaagaggagcagttggctgattgtgctacttgtgcttctcacagtttcattgtcaccagtacaatcagcacctatcggtcatgggaagaccatagaaacgtatcaaactagagaagggtacacaagtatttgtctttttgtgctaggaagcattttgtttatagtttctcacctaatgaaggggctggttgacagtgttggtaacagttttttccctgggttatctatctgcaagacatgctctattggcagtataaatggctttgaaattgaatctcacaaatgttactgtagcctattttgttgcccctactgtagacactgctctgccgataaagaaatccataagttgcatttgagcatctgcaaaaaaagaaaagctgggagtaatgtcatgttggccgtctgtaagcgcatgtgttttagggcaactatggaagtgagcaacaaggctctactcatccgaagtgtcatcaacactacttttgttgtatgcatactaatattagcagtttgtgttgttagcacctccgcagtagagatggaaagcctgccagctggcacttgggagagagaggaagacctaacaaacttctgccatcaagaatgccaggtcactgaaactgaatgtctctgtccctatgaagctcttgtactcagaaagcccttatttttagacagtattgctaagggtatgaagaacctgctgaattcaacaagcttagaaacaagcttatcaattgaggcaccatggggagcaataaacgtccaatctactttcaaacctactgtgtcaactgcaaacatagcacttagttggagctcagtggaacacagaggtaataagatcttggtttcaggcagatcagagtcaatcatgaagctagaagaaagaacaggaatcagctgggatttgggagtagaagatgcctctgagtccaaattacttactgtttccgtcatggacttatcacagatgtactctcctgtctttgagtacctatcaggtgacagacaagtagaggaatggccaaaggcaacctgtacaggcgattgcccggaaagatgtggctgcacatcatcaacctgcctacacaaggaatggcctcactcaagaaactggagatgcaaccccacttggtgttggggagtcggcaccggatgcacctgttgtggactagatgtaaaggacctttttacagattacatgtttgttaaatggaaggtcgaatatataaaaacagaggctatagtgtgtgttgagcttactagccaagaaagacaatgtagcttgattgaggcaggcacaagattcaacttaggtcctgtgactatcacattatcagagccaagaaacattcagcaaaagctccctccagaaattgtcacattacatcctagaattgaagaaggtttttttgacttaatgcatgtacagaaggtactatcagcaagcacagtgtgcaagctacagagttgcacacatggcgtaccaggagacttacaggtctaccacatcggaaacttactaaaaggagacaaagtgaatgggcatctgatacataaagttgaaccacatttcaacacctcctggatgtcttgggacggctgtgacctagattactactgcaatatgggggattggccctcttgcacgtatactggagttacccaacataatcatgctgcatttgtaaacctacttaacattgaaactgattacacaaagaacttccactttcactctaagagagtcactgcacatggggacactccacaattagatttaaaagccagaccaaattatggtgcaggtgaaatcactgtgctggtggaagttgctgacatggagttacacacaaagaaaattgagatatcaggtttgaagtttgcaagcctaacctgcacaggttgttatgcttgtagctctggcatctcatgtaaggttaggatccatgtagatgaaccagatgagcttacagtacatgtgaagagtgaagacccagacatagttgctgctagctcaagtctcatggcaagaaagcttgaattcgggacggatagtacattcaaagccttctcagccatgcctaaaacctccttgtgcttttacattgttgagagagaatactgtaaaagctgcagtaaagaagacacacaaaagtgtgttaacgcaaagcttgagcgaccacagagcattttaattgagcacaaaggaacgataattggaaagcagaacgacacttgcacagctaaagcaagctgctggctagagtcagtcaagagtttcttttatggactaaagaacatgcttagtggcatttttggcaatgttttcatagggattttcttattccttgctccttttatcctgttaatacttttctttatgtttgggtggagaatcctattctgctttaagtgctgcaggagaactagaggcctatttaagtacagacacctcaaagatgatgaagaaaccggttataggaaaatcattgagagactaaacaacaaaaaaggtaaaaacaagctgcttgacggtgaaagattagctgatagaaagatcgctgagctgttctctacaaaaacacacattggctga

SEQ ID NO: 3596 - RNA, 5064 nt, synthetic construct
  misc_feature 1..5064: note = derived and/or modified CDS sequence (wt) from CCHFV(Oman_812956)__KY362518.1__GP
  source 1..5064: mol_type = other RNA
atgcccgtcaacactatgcacacactgctagtgtatgctgtcttttgcttgcagctatggagtccaggaggaactcgtggactgtcaaatgaaactcaacacaatgaaacaggtatcacaagagcacctgaagggagccaaggacccagtttgcctgtaagcacagcatcacccatcatgtcagacccctccatcaccacactctcagcgtcgaccagtggactagaaggctcaggggacacgactcccccagccatcacacaaggcccgaccctaccagagaccacgccggaaccctccacaacaaccggcacaaacgcattcagcacagccattgccaatgtcagtacacagacagtcaaggacacccccacaccgacagtacaaacaagtccacctagcactcccgacgcatctaccataccacagggcacacatcacaccgcaaggggtctgctgtcagtcaccgtcacaaagccagaagaagtaccaacaccaacaggcccagaacaagcaagcatagagaccaatagcccacgcctagcaactagcaagacaccgtccccctctccaacagctcaggttaccactgaaaacagcaaccctaatacctccagacagctcgtgctctcaacacaaccagcaacctcaagcccagtgacctctccagcacagctgaacttcgtgcagagtgctactaccatagccgttcaagatgcacacccaagcccaacaaacaggtccaagagaaaccttgagatggaagtaattttgactttatctcaaggtttaagaaagtactacggcagaatactgaaacttctggaccttaccttagaagaagacaccgaaggactgctggagtggtgtaagagaaatcttggtctaacctgtgacgataacttctttcagaagaggatagaagagttcttcttgactggtgagggtcacttcaatgaagttttacagttcaaaaccccaagcacactgagccctacagaatctgctagtgtagggttaccaacagttgagcccttcaaatcttactttgctaaaggctttctttcaatagactcaggttacttctctgccaagtgttatccaagggcgtctaactcagggcttcagttaatcaatgtcactcaacattcagctagaatagcagacacacctggacctaagatcacaaatctgaaaaccatcaattgcataaacctaaaggcattggtctttaaagagcatagagagattgaaatcaatgttcttctccctcaagtcgcagtcaatctctcaaactgccatgtccacatcaaatcgcatgtctgtgattattctttagacatcgacggaacagtcaggctaccccgtatccaccatgaaggaactttcataccaggaacttacaaaatagtgatagacaaaaaaaacaaacaaaacgatagatgcaacttggttaccaattgtgtaataaaaggaagggaagtgcgtaaaggccagtcagtgttaagacagtacagaacagaaatcaggatcggcaaggcatcttctggctccagaagactgctgtccgaagagtctggtgaagactgtatatcaaggactcagctgttgaggacagaaactgcagaaatccatggtgataactatggtggtccaggtgacaaaataaccatctgcaatggttcaaccattgtagatcaaaggctgggtagtgaactggggtgttacactatcaatagggtgaagtcatttaagctatgcgaaaacagtgccacaggtaagtcctgtgaaatagataacactccagtaaaatgcaagcaaggtttttgcttgaaaataacccaagaaggaaggggccacgtgaagctttcaagagactcagaagttgtcctggacgcctgcgattcaagctgtgaaataatgataccaaagggcactggagacatcctggttgactgctcaggtgggcagcagcacttcttaaaagacaacctgattgatctgggatgccccaacatcccattattaggcaaaatggcaatctacatttgtagaatgtcaaatcatcctaaaacaactatggcttttcttttttggtttagctttggttatgtgataacctgcatactttgtaaagtcattttttatctattgatagttgttggaactttagggaaaaagtttaaacagtatagagagttaaaacctcagacctgcacaatatgtgaaacaactcctgtcaatgcaatagatgctgagatgcacgatctcaattgtagttacaatatatgtccttattgtgcatctaggttaacttcagatggtcttgccagacatgtaatgcagtgtcctaagcggaaggaaaaaatagaagaaaccgaattatacctgaacttagaaagaatcccttgggttgtcagaaaactactgcaggtatcagaatccactggtgtagcactaaagaggagcagttggctgattgtgctacttgtgcttctcacagtttcattgtcaccagtacaatcagcacctatcggtcatgggaagaccatagaaacgtatcaaactagagaagggtacacaagtatttgtctttttgtgctaggaagcattttgtttatagtttctcacctaatgaaggggctggttgacagtgttggtaacagttttttccctgggttatctatctgcaagacatgctctattggcagtataaatggctttgaaattgaatctcacaaatgttactgtagcctattttgttgcccctactgtagacactgctctgccgataaagaaatccataagttgcatttgagcatctgcaaaaaaagaaaagctgggagtaatgtcatgttggccgtctgtaagcgcatgtgttttagggcaactatggaagtgagcaacaaggctctactcatccgaagtgtcatcaacactacttttgttgtatgcatactaatattagcagtttgtgttgttagcacctccgcagtagagatggaaagcctgccagctggcacttgggagagagaggaagacctaacaaacttctgccatcaagaatgccaggtcactgaaactgaatgtctctgtccctatgaagctcttgtactcagaaagcccttattttttgacagtattgctaagggtatgaagaacctgctgaattcaacaagcttagaaacaagcttatcaattgaggcaccatggggagcaataaacgtccaatctactttcaaacctactgtgtcaactgcaaacatagcacttagttggagctcagtggaacacagaggtaataagatcttggtttcaggcagatcagagtcaatcatgaagctagaagaaagaacaggaatcagctgggatttgggagtagaagatgcctctgagtccaaattacttactgtttccgtcatggacttatcacagatgtactctcctgtctttgagtacctatcaggtgacagacaagtagaggaatggccaaaggcaacctgtacaggcgattgcccggaaagatgtggctgcacatcatcaacctgcctacacaaggaatggcctcactcaagaaactggagatgcaaccccacttggtgttggggagtcggcaccggatgcacctgttgtggactagatgtaaaggacctttttacagattacatgtttgttaaatggaaggtcgaatatataaaaacagaggctatagtgtgtgttgagcttactagccaagaaagacaatgtagcttgattgaggcaggcacaagattcaacttaggtcctgtgactatcacattatcagagccaagaaacattcagcaaaagctccctccagaaattgtcacattacatcctagaattgaagaaggtttttttgacttaatgcatgtacagaaggtactatcagcaagcacagtgtgcaagctacagagttgcacacatggcgtaccaggagacttacaggtctaccacatcggaaacttactaaaaggagacaaagtgaatgggcatctgatacataaagttgaaccacatttcaacacctcctggatgtcttgggacggctgtgacctagattactactgcaatatgggggattggccctcttgcacgtatactggagttacccaacataatcatgctgcatttgtaaacctacttaacattgaaactgattacacaaagaacttccactttcactctaagagagtcactgcacatggggacactccacaattagatttaaaagccagaccaaattatggtgcaggtgaaatcactgtgctggtggaagttgctgacatggagttacacacaaagaaaattgagatatcaggtttgaagtttgcaagcctaacctgcacaggttgttatgcttgtagctctggcatctcatgtaaggttaggatccatgtagatgaaccagatgagcttacagtacatgtgaagagtgaagacccagacatagttgctgctagctcaagtctcatggcaagaaagcttgaattcgggacggatagtacattcaaagccttctcagccatgcctaaaacctccttgtgcttttacattgttgagagagaatactgtaaaagctgcagtaaagaagacacacaaaagtgtgttaacgcaaagcttgagcgaccacagagcattttaattgagcacaaaggaacgataattggaaagcagaacgacacttgcacagctaaagcaagctgctggctagagtcagtcaagagtttcttttatggactaaagaacatgcttagtggcatttttggcaatgttttcatagggattttcttattccttgctccttttatcctgttaatacttttctttatgtttgggtggagaatcctattctgctttaagtgctgcaggagaactagaggcctatttaagtacagacacctcaaagatgatgaagaaaccggttataggaaaatcattgagagactaaacaacaaaaaaggtaaaaacaagctgcttgacggtgaaagattagctgatagaaagatcgctgagctgttctctacaaaaacacacattggctga

SEQ ID NO: 3597 - RNA, 5064 nt, synthetic construct
  misc_feature 1..5064: note = derived and/or modified CDS sequence (wt) from CCHFV(Oman)__DQ211632.1__GP
  source 1..5064: mol_type = other RNA
atgcccgtcaacactatgcacacactgctagtgtatgctgtcttttgcttgcagctatggagtccaggaggaactcgtggactgtcaaatgaaactcaacacaatgaaacaggtatcacaagagcacctgaagggagccaaggacccagtttgcctgtaagcacagcatcacccatcatgtcagacccctccatcaccacaccctcagcgtcgaccagtggactagaaggctcaggggacacgactcccccagccatcacacaaggcccgaccccaccagagaccacgccggaaccctccacaacaaccggcacaaacgcattcagcacagccattgccaatgtcagtacacagacagtcaaggacacccccacaccgacagtccaaacaagtccacctagcactcccgacgcatctaccataccacagggcacacatcacaccgcaaggggtctgctgtcagtcaccgtcacaaagccagaagaagtaccaacaccaacaggcccagaacaagcaagcatagagaccaatagcccacgcctagcaactagcaagacaccgtccccctctccaacagctcaggttaccactgaaaacagcaaccctaatacctccagacagctcgtgctctcaacacaaccagcaacctcaagcccagtgacctctccagcacagctgatcttcgtgcagagtgctactaccgtagccgttcaagatgcacacccaagcccaacaaacaggtccaaaagaaaccttgagatggaagtaattttgactttatctcaaggtttaagaaagtactacggcagaatactgaaacttctggaccttaccttagaagaagacaccgaaggactgctggagtggtgtaagagaaatcttggtctaacctgtgacgataacttctttcagaagaggatagaagagttcttcttgactggtgagggtcacttcaatgaagttttacagttcaaaaccccaagcacactgagctctacagaatctgctagtgtagggttaccaacagttgagcccttcaaatcttactttgctaaaggctttctttcaatagactcaggttacttctctgccaagtgttatccaagggcgtctaactcagggcttcagttaatcaatgtcactcaacattcagctagaatagcagacacacctggacctaagatcacaaatctgaaaaccatcaattgcataaacctaaaggcattggtctttaaagagcatagagagattgaaatcaatgttcttctccctcaagtcgcagtcaatctctcaaactgccatgtccacatcaaatcgcatgtctgtgattattctttagacatcgacggaacagttaggctaccccgtatccaccatgaaggaactttcataccaggaacttacaaaatagtgatagacaaaaaaaacaaacaaaacgatagatgcaacttggttaccaattgtgtaataaaaggaagggaagtgcgtaaaggccagtcagtgttaagacagtacagaacagaaatcaggatcggcaaggcatcttctggctccagaagactgctgtccgaagagtctggtgaagactgtatatcaaggactcagctattgaggacagaaactgcagaaatccatggtgataactatggtggtccaggtgacaaaataaccatctgcaatggttcaaccattgtagatcaaaggctgggtagtgaactggggtgttacactatcaatagggtgaagtcatttaagctatgcgaaaacagtgccacaggtaagtcctgtgaaatagataacactccagtaaaatgcaagcaaggtttttgcttgaaaataacccaagaaggaaggggccacgtgaagctttcaagagactcagaagttgtcctggacgcctgcgattcaagctgtgaaataatgataccaaagggcactggagacatcctggttgactgctcaggtgggcagcagcacttcttaaaagacaacctgattgatctgggatgccccaacatcccattattaggcaaaatggcaatctacatttgtagaatgtcaaatcatcctaaaacaactatggcttttcttttttggtttagctttggttatgtgataacctgcatactttgtaaagtcattttttatctattgatagttgttggaactttagggaaaaagtttaaacagtatagagagttaaaacctcagacctgcacaatatgtgaaacaactcctgtcaatgcaatagatgctgagatgcacgatctcaattgtagttacaatatatgtccttattgtgcatctaggttaacttcagatggtcttgccagacatgtaatgcagtgtcctaagcggaaggaaaaaatagaagaaaccgaattatacctgaacttagaaagaatcccttgggttgtcagaaaactactgcaggtgtcagaatccactggtgtagcactaaagaggagcagttggctgattgtgctacttgtgcttctcacagtttcattgtcaccagtacaatcagcacctatcggtcatgggaagaccatagaaacgtatcaaactagagaagggtacacaagtatttgtctttttgtgctaggaagcattttgtttatagtttctcacctaatgaaggggctggttgacagtgttggtaacagtttttttcctgggttatctatctgcaagacatgctctattggcagtataaatggctttgaaattgaatctcacaaatgtttctgtagcctattttgttgcccctactgtagacactgctctgccgataaagaaatccataagttgcatttgagcatctgcaaaaaaagaaaagctgggagtaatgtcatgttggccgtctgtaagcgcatgtgttttagggcaactatggaagtgagcaacaaggctctactcatccgaagtgtcatcaacactacttttgttgtatgcatactaatattagcagtttgtgttgttagcacctctgcagtagagatggaaagcctgccagctggcacttgggagagagaggaagacctaacaaacttctgccatcaagaatgccaggtcactgaaactgaatgtctctgtccctatgaagctcttgtactcagaaagcccttatttttagacagtattgctaagggcatgaagaacctgctgaattcaacaagcttagaaacaagcttatcaattgaggcaccatggggagcaataaacgttcaatctactttcaaacctactgtgtcaactgcaaacatagcacttagttggagctcagtggaacacagaggtaataagatcttggtttcaggcagatcagagtcaatcatgaagctagaagaaagaacaggaatcagctgggatttgggagtagaagatgcctctgagtccaaattacttactgtttccgtcatggacttatcacagatgtactctcctgtctttgagtacctatcaggtgacagacaagtagaggaatggccaaaggcaacctgtacaggcgattgcccggaaagatgtggctgcacatcatcaacctgcctacacaaggaatggcctcactcaagaaactggagatgcaaccccacttggtgttggggagtcggcaccggatgcacctgttgtggactagatgtaaaggacctttttacagattacatgtttgttaaatggaaggtcgaatatataaaaacagaggctatagtgtgtgttgagcttactagccaagaaagacaatgtagcttgattgaggcaggcacaagattcaacttaggtcctgtgactatcacattatcagagccaagaaacattcagcaaaagctccctccagaaattgtcacattacatcctagaattgaagaaggtttttttgacttaatgcatgtacagaaggtactatcagcaagcacagtgtgcaagctacagagttgcacacatggcgtaccaggagacttacaggtctaccacatcggaaacttactaaaaggagacaaagtgaacgggcatctgatacataaagttgaaccacatttcaacacctcctggatgtcttgggacggctgtgacctagattactactgcaatatgggggattggccctcttgcacgtatactggagttacccaacataatcatgctgcatttgtaaacctacttaacattgaaactgattacacaaagaacttccactttcactctaagagagtcactgcacatggggacactccacaattagatttaaaagccagaccaaattatggtgcaggtgaggtcactgtgctggtggaagttgctgacatggagttacacacaaagaaaattgagatatcaggtttgaagtttgcaagcctaacttgcacaggttgttatgcttgtagctctggcatctcatgtaaggttaggatccatgtagatgaaccagatgagcttacagtacatgtgaagagtgaagacccagacatagttgctgctagctcaagtctcatggcaagaaagcttgaattcgggacggatagtacattcaaagccttctcagccatgcctaaaacctccttgtgcttttacattgttgagagagaatactgtaaaagctgcagtaaagaagacacacaaaagtgtgttaacgcaaagcttgagcgaccacagagcattttaattgagcacaaaggaacgataattggaaagcagaacgacacttgcacagctaaagcaagctgctggctagagtcagtcaagagtttcttttatggactaaagaacatgcttagtggcatttttggcaatgttttcatagggattttcttattccttgctccttttatcctgttaatacttttctttatgtttgggtggagaatcctattctgctttaagtgctgcaggagaactagaggcctatttaagtacagacacctcaaagatgatgaagaaaccggttataggaaaatcattgagagactaaacaacaaaaaaggtaaaaacaagctgcttgacggtgaaagattagctgatagaaagatcgctgagctgttctctacaaaaacacacattggctga

SEQ ID NO: 3598 - RNA, 5064 nt, synthetic construct
  misc_feature 1..5064: note = derived and/or modified CDS sequence (wt) from CCHFV(3820-ST-2007)__KR814868.1__GP
  source 1..5064: mol_type = other RNA
atgcccatcaacattatgcatacactattagtgtgcttcattctttacctacagctgtcgggtttaggaggagctcatggacagtcaaacgcaactgaacacaatggaacaaacaccaccacagtacccggcacaagtcaaagccccaagccacccgcgagcaccactctaccacacacaccagaatcctccaccgtcaaactcaccacaccaacaagcgaaacagaaggctcaggggaaacgacccccccaaacaccacccagggcctgcccctaccagggaccacaccagaacgctccgcaacaaccgccacaagcacgtcaagcacagacaacatgaattccaccacacaggtgaccgataacacccccacatcaacagtcagcataagtccatccagcagctccagcatgccatccacatcacaaggcatacatcatcccgtaaggagtctattgtcagtctcgagccctaagacagtaacaacaccgacaccaatgagccctggagagatgagcccggaaaccagcagtcagcactcagccatgagcagagtaccaaccctctacacagcaacccagatctccactgagaacaccgaccgcagcacacctagacaatctgagtcctcagtacagccggcaacccaaagcccaataacttccccagcgcaaacaatccttctgatgagtgctgctcctaaagctattcaggacatgcatcccagcccaacaaacaggtccaagaggaaccttgaggtggaaataattttaactctgtctcaaggtctaaagaaatattacggtaaaatactgaagcttctgcaccttaccttggaagaggatactgaaggcctgttagaatggtgtaagagaaaccttgggtcaaattgtgatgatgacttctttcaaaagagaatagaagaattcttcataactggtgagggctacttcaatgaagtcctacaatttaaaacactaagcacactaagccccacggagccgtctcatgtcaggctaccaacagcggagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtactttcataccaggaacttataaaatagtgatagacagaaaaaataagctaaatgaccgatgctcgctagtcactaactgtgtgataaagggaagagaggttcgtaagggccaatcagtgctgaggcagtacaaaacagaaattaagataggcaagacatcaacaggctctaggaaactactgtccgaagagccaggtgacgactgcatatcaagaactcagctattgaagacagaaacagcagagatccatgacgacaactatggtagtccaggtgacaaaatcactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcactgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctggctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcgcagtctcattgtcaccggtccaatcagcacctgttggtcatggtaagacaatcgaaacatatcagaccagagagggattcacaagcatctgtctctttatgttaggaagcatcctattcatagtttcttgcctggtaaaggggctggttgacagtgtcagtgacagcttcttccccggcctgtctgtctgtaagacatgctctattggcagtataaatggctttgaaattgaatcgcataaatgctactgtagtttattttgctgcccctactgtaggcactgctctgctgacagagaaattcaccagttgcacttgagtatctgcaaaaaaagaaaaacggggagcaatgtcatgctggctgtctgcaagcgcatgtgctttaaggcaaccatagaagcaagcagaagagccctgctcatccgaagcattatcaataccacttttgtaatgtgcattctaacattagcaatctgtgttgttagcacctctgcagtagagatggaagaccttccagcaggcacttgggagagagaggaagacctaacaaatttctgccatcaggaatgccaggtgaccgagacggaatgcctctgtccatacgaagctcttgtgctcaggaaaccccttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggacctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagagtaaacggccatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaaaaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtagttttttcgtaggcattttgttattccttgcccctttcgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaaggaaaaaacagactgcttgatggtgagaggttggctgataggaaaattgctgagctgttctctacaaaaacacacattggctaa

SEQ ID NO: 3599 - RNA, 5058 nt, synthetic construct
  misc_feature 1..5058: note = derived and/or modified CDS sequence (wt) from CCHFV(SR3)__AJ538199.1__GP
  source 1..5058: mol_type = other RNA
atgcatatatcattgatgtatgcagttttctgcttgcaactgtgcggtctagggaagactaacggaccacacaatgggactgaacacaataatacacacgttatgacaacgcctgatgacagtcagagccctgaaccgccagtgagcacagccttacctgtcacaccggacccttcaactgtcacaccttcaacaccagccagcggattagaaggctcaggagaggtttacacatcctctccaatcaccaccaagggtttgtctctgccggaggccacatctgagccccctgcgactaccagcgtggtcacttcaagtgcaagtgataccgattctagcacacaggcagccggagacacccccacaccaacagtccgcacgagtctgcccagcagccctagcacaccatccacatcacaaggcacacactatcccgtgaggagtctgctttcagtcacgagccctaagccagaagaaacaccaacaccgtcaaaatcaggcaaagatgacttagcaaccaacagcccccacccagccaccagcagaccaacaacccctcccacaacagcccagaaacccactgaaaacaacagccacaacaccaccgaacagcttgagtccttaacacacttagcaactttaggtttaatgatctctccaacacagacagtcctcccacagagtgttacctctatagccattcaagacattcataacagcccaacaaataggtctaaaagaaaccttgatatggaaataatcttaacgttatctcagggtctgaaaaagtattatggcaaaatacttaagctcctgcatctcaccttagaagaagacactgaaggcttgttagagtggtgcaagagaaatctcggtcttgactgtgatgacaccttcttccaaaaaagaatcgaagaattcttcataactggtgagggtcatttcaatgaagttttacaatttagaacactaggcacattgagtaccacagagtcaacgcatgctggatcaccgacagttgaacccttcaaatcctactttgctaaaggtttcctttcaatagattcaggttatttctctgccaaatgttattcaagaacatccaattcagggctccaattgattaatgttacccgacattcaactaggatagctgacacgcctgggcccaagatcactaacctgaagaccatcaattgcatgaacttaaaagcatccgtctttaaagaacatagagaggttgaaatcaatgtgcttctccctcaagtagcagtcaacctctcaaactgtcatgttgcaatcaaatcacatatctgtgactattctttagacaccgacggggcgattaggcttcctcaaattcatcatgaaggcacttttatcccaggtacttacaaaatagtgatagacaaaaaaagtaggctgaatgacaggtgtaccctattcaccaactgtgtgataaaaggaagagaagttcgtaaaggccagtcagtcctaaggcaatacaagacagaaattagaattggcagggcatcaactggttctaggagattgctttccgaagaatctggtgatgactgcatatcaagaactcagctattgaggacagagactgcagaggtccatggcgacaactacggtggtccaggtgataagataaccatctgtaatggttcaactgttgtagatcaaagactgggtagtgaactagggtgttacactatcaatagagtgaggtcattcaagctatgcgaaaacagtgccacagggaagagctgtgaaatagacagtatcccagtcaagtgtaagcagggttattgccttaaaatcactcaggaaggaaggggccatgtgaagttatctagaggctcagaagttgtcttggatgtatgtgattcaagctgtgaagtgatgatacctaagggcactggtgacattctagtagattgttcaggtgggcagcaacattttttaaaagacaacctggttgacctagggtgtcccaaaattccgttactgggcaaaatggctatttatatctgcaggatgtcgaatcaccccaagacaaccatggccttcctcttttggttcagctttggctatgtgataacttgtatactttgcaaggccatttttttcttattaataatttttggaacactagggaaaaggttcaagcagtacagagagttgaaaccccagacctgcaccatatgtgagacaacacctgtaaatgcaatagatgctgaaatgcatgatctcaactgcagttacaatatatgtccctattgtgcgtctagactgacttcagatgggcttgctaggcatgtaacacaatgtcctagacggaaggagaaagtggaggaaaccgaattatacctgaatttagagagaattccctgggttgtaagaaagctattgcaggtgtcagagtccactggtacagtattaaaaaggagcagctggctaattgtattacttgtgctgttcacagtttcattgtcaccagttcaatcagcacccattggtcacgggaaaacaattgaaacataccgggttagggaagaatacacaagtatttgcctctttgtactagggagtatcctgtttatagtctcttttctaatgaaaggactggttgacggtgttggcaacatcttctttcctgggctgtccgtctgtaagacatgctctataggtagcattaatggctttgaaattgagtctcataagtgctactgtagcttgttttgttgcccttactgtaggcactgctctgctgatggagaaatccatcagctgcacttgagcatctgcaaaaaaaggaagacaggaagtaatgttatgctggctgtttgcaaacgcatgtgtttcagggcaactatggaagtaagcaacaaagccctatttatccgtagcatcatcaacaccacttttgttatgtgcatactgaagggcgaattcgcggccgttaaatcaattcaccctatagagatggaaagcctaccagctgggacctgggaaagagaagaagacctaacaaatttctgccatcaggaatgccaggttacagagactgagtgcctctgcccttatgaagctctagtgctcagaaggcccctatttctagatagtatagtcaaaggtatgaaaaatctgctaaactcaacaagtctagaaacaagcttatcaattgaggcaccgtggggagcaatcaatgttcagtcaacctacaaaccaactgtctcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagttatggacttgtctcagatgtactctcctgtcttcgagtacttatcaggtgacagacaagtggaagagtggcctaaagcaacctgcacaggtgactgcccagaaagatgtggctgcacatcatcaacctgcttacacaaagagtggccccactcaaggaattggagatgtaatcctacttggtgctggggtgtagggactggctgcacctgttgtggtttagatgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagaaccaaggaacattcaacaaaagctccctcctgaaataatcacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacctgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacaactagatctgaaggcaaggccaacctatggtgcaggtgagatcaccgtgctggtggaagttgctgacatggagttacacacaaagaagattgaaatatcaggcttaaaatttgcaggcctaacttgcacaggttgttatgcttgtagttctggcatctcttgtaaagttagaattcatgtagatgaaccagatgaacttacagtacatgttaaaagtgatgacccagatgtagttgcagctagctcaagtctcatggcgaggaagcttgaatttggaacagacagtacatttaaagctttctcagccatgcctaaaacctccctatgtttctacattgtggaaagggaatactgtaaaagctgcaataaagaagatacacaaaaatgtgttaacacgaaactcgaacaaccacagagcattttgatcgaacataagggaactataattggaaagcaaaacaatacttgcacggctaaagcgagttgctggttagagtcagttaagagtttcttttatggtctgaagaatatgctcggtggcatatttggcaatgtttttataggcattttcacatttcttaccccctttatcttgttaatacttttctttatgtttgggtggaggatcctgttttgcttcaagtgttgcagaaggaccagaggcctattcaagtacagacacctcaaagacgatgaagaaactggttacagaaagatcattgaaagactgaacaacaaaaaaggaaaaaacaggctgcttgatggtgaaagacttgctgacagaaagattgctgaactgttctccacaaaaacacacattggctag

SEQ ID NO: 3600 - RNA, 5055 nt, synthetic construct
  misc_feature 1..5055: note = derived and/or modified CDS sequence (wt) from CCHFV(SPU 187/90)__KJ682814.1__GP
  source 1..5055: mol_type = other RNA
atgcatatatcattaatgtatgcagtcctttgcctacagctgtgtagtctgggagaaactcatagatcacacaatgaaattggacacaataaaacagacgttatgacaacgcccggtgataacctgagctctgaacagccagtgagcacggccttgtctatcacacctgacccctccactgttacacccacaacaccagccagtggatcagaaggctcaggggaagtttacacatcctctccgatcaccaccgagagcttgtccctgccagaaaccacaccggagctccctgctacaactggtatagactcttcaagtgcaagtggtgtcgattctagtacgcaagcagccggaggcacctccgcactaacagtccgcacaagtctgcccaacagccctagcacaccatctacaccacaagacacataccatcctgtgagaattctactttcagtcacgggccctgggccagaagaaacatcaacaccttcgggatcaggcaaagagagctcagcaactagtagccttcatccaatctccgacagactaccaacccctcccgcaacagctcagggacctactgaaaataacagtcacaacgccactgaacaccccaagcccctgacacagtcagcaaccccaggcctaatgacctctccaacacagatagtccacccacaaagtgccacctccataaccgttcaagacacataccccagtccaaagaacaggtctaaaagaaaccttgagatggaaataatcttgactttgtctcagggcttaaaaaaatactatggcaaaatattaaggcttctgcgtctcaccttagaggaggacactgaaggtctactggaatggtgtaagagaaatcttggtcttgattgtgatgacactttctttcaaaagagaattgaggaattcttcataactggtgagggccattttaatgaagttctacaatttaaaacgccaggcacgttgagtactacagagtcaacacctgctgagctgccaacagctgaaccttttaagtcctacttcgccaaaggcttcctttcaatagattcaggttactattcagccaaatgttactcaggaacatctaattcagggcttcaattgattaatattacccgacattcaactagaatagttgacacacctgggcctaagatcactaatttaaagaccatcaactgcataaacttaaaggcatcgatcttcaaagaacatagagaggttgaaatcaatgtgcttctccctcaaattgcagttaatctctcaaactgtcacgttgtaatcaaatcacatgtctgtgactattctttagacattgacggtacggtgaggcttcctcacatttaccatgaaggagttttcattccaggaacttacaaaatagtgatagataaaaaaaataagttgaatgacagatgcaccttatttaccaactgtgtgataaaaggaagggaggttcgtaagggtcagtcagttttgaggcagtacaagacggaaatcaggattggcaaagcatcaaccggctctagaagactgctttccgaagaacctagtgatgactgcatatcgagaactcaactattgaggacagagactgcagagatccacggcgacaactatggtggcccgggtgacaaaataaccatctgcaacggctcaactattgtagaccaaagactgggcagtgagctagggtgttacactatcaatagagtgaagtcattcaagctatgcgaaaatagtgccacagggaagagctgtgaaatagacagtgtcccagttaaatgcaggcagggttattgcctaagaatcactcaggaagggaggggccatgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcgaatcaccccaaaacaaccatggctttccttttctggttcagctttggctacgtaataacttgtatactttgcaaggccatcttttacttgttaataattattggaacgctagggaagaggttcaagcagtatagagagttaaaacctcagacctgcaccatatgtgagacaactcctgtaaatgcaatagatgctgagatgcatgacctcaactgcagttacaacatttgtccctactgtgcatctagactaacctcagatgggcttgctaggcatgtgacacaatgccctaagcggaaggagaaagtggaagaaactgaactatacttgaacttagaaagaattccttgggttgtaagaaagctgttgcaggtatcagagtccactggtgtggcattgaaaagaagcagctggctgattgtgctgcttgtgctgttcacggtttcattgtcaccagttcaatcagcacccattggtcacgggaagacaattgaggcataccgggccagggagggatacacaagtatatgtctctttgtactaggaagtatcctatttgtagtctcttgcctaatgaaagggctggttgacagtgttggcaactccttcttccctggactgtccatttgcaaaacgtgctccataggcagcattaatggctttgaaattgagtcccataagtgctattgcagcttattctgttgcccttattgtaggcactgctctgctgataaagaaattcataagctgcacttgagcatctgcaaaaaaagaaaaacaggaagtaatgtcatgttggctgtctgcaagcgcatgtgtttcagggccaccatggaagtaagtaacagagccctgtttatccgtagcatcatcaacaccacttttgttttatgtatactgatactagcagtttgtgttgttagtacctcagcagtggagatggaaaacctaccagccgggacctgggaaagagaagaggacctaacaaatttctgtcatcaggaatgccaggttacagagactgaatgcctctgcccttatgaagctctagtactcagaaggcctctattcctagatagtatagttaaaggtatgaaaaatctgctaaattcaacaagtttagaaacaagtttatcaattgaggcaccatggggggcaataaatgttcagtcaacctacaaaccaactgtgtcaactgcaaacatagcactcagttggagctctgtggaacacagaggcaataagatcttggtttcaggcagatcagaatcaattatgaagctggaagaaaggacaggaatcagctgggacctcggcgtggaagacgcctctgagtctaaactgcttacagtctctgtcatggacttgtctcagatgtactctcctgtcttcgagtacttatcaggagacagacaggtggaagagtggcccaaggcaacttgtacaggtgactgcccagaaagatgtggctgcacatcatcaacatgtttacacaaagaatggccccactcaagaaattggaggtgcaatcccacttggtgctggggtgtagggactggctgcacctgttgtggattagatgtgaaggacctttttacagattatatgtttgtcaagtggaaagttgaatatattaagacagaagccatagtgtgtgtagaacttaccagtcaggaaaggcagtgtagcttgattgaagcaggcacaaggttcaatttaggtcctgtaaccatcacactgtcagaaccacgaaacatccaacagaagctccctcctgaaataatcacactgcatcccaggatcgaagaaggtttttttgacctgatgcatgtacagaaagtgttatcggcaagcacagtgtgtaagttgcagagttgcacacatggtgtgccaggagacctacaggtctaccacatcgggaatttattaaaaggggataaggtgaatggacatctaattcataaaattgagccacacttcaacacttcctggatgtcctgggatggttgtgacctagactactactgcaacatgggagattggccttcttgcacatacacaggagtcacccaacacaatcatgcttcatttgtaaacctgctcaacattgaaactgattacacaaaaaacttccactttcactctaaaagggtcactgcacacggagacacaccacaactagatcttaaggcaagaccaacctatggtgcaggtgagatcactgtactggtagaagttgctgacatggagttacacacaaagaagattgaaatatcaggcttaaaatttgcaagcttgacttgcacaggctgttatgcttgtagctctggcatctcatgcaaagttagaattcatgtggatgaaccagatgaacttacagtacatgttaaaagtgatgatccagatgtagttgcagctagctcaagtctcatggcaagaaagcttgaatttggaacagacagtatatttaaagctttctcagccatgcctaaaacttctctatgtttctacattgttgaaagagaacactgtaagagctgcagcgaagaagacactaaaaaatgtgttaacacaaaacttgagcaaccacaaagcattttgatcgaacacaagggaactataatcggaaagcaaaacagcacttgcacagccaagacgagttgctggttagagtcagtcaaaagttttttttatggtctaaagaacatgcttagtggcatttttggaaatgtttttataggtattttcttgttccttgcccccttcatcctgttaatactgttctttatgtttgggtggaggatcctattttgctttaaatgttgcagaagaactagaggcctgttcaagtatagacacttaaaggacgatgaagaaactggttatagaaggattattgaaagattaaacaataaaaaaggaaaaaacaaactgcttgatggtgaaagacttgctgatagaagaattgccgaactgttctctacaaaaacacacattggctag

SEQ ID NO: 3601 - RNA, 5055 nt, synthetic construct
  misc_feature 1..5055: note = derived and/or modified CDS sequence (wt) from CCHFV(SPU 48/90)__KJ682813.1__GP
  source 1..5055: mol_type = other RNA
atgcatatatcgttaatgtatgcagtcctttgcctacagctgtgtggtctgggagagactcatagatcacacaatgaaactggacacaataaaacagacgttgcgacaacgcccggtgataacctgagctctgaacagctagtgagcacggccttgtccattacacctgacccctccactgttacgcccacaacatcagccagtggattagaaggctcgggggaagtttacacatcctctctgatcaccaccgagagcttgtccttgctggaaaccacaccgaagctccctactacaactggtatagacacttcaagtgcaagtgatgtcgattccagtacgcaggcagccggagacacctccgcactaacagtccgcacaagtccacccagcaaccccagcacaccatctacaccacaagacacgcaccatcccatgagaaatctactttcagtcacgagccctgggccagaagaaacatctacaccctcaggatcaggcaaagagagcccagcaaccagtagccctcatccagtctccaacagatcacaaacccctcccgcaacggcccaaggacctactgaagataacagttacaacgccactgaacaccccgagcacctgacacagtcagcaacctcaggcctaatgacctctccaacacagatagtccacccacaaagtgccacctccataaccgttcaagacacataccccagtccaacgaacaggtccaaaagaaaccttgagatggaaataatcttgactttgtctcagggtttaaaaaagtactatggcaaaatattaaggcttctgcgtctcaccttagaggaggacactgaaggtctactggaatggtgtaagagaaatcttggtcttgattgtgatgacactttctttcaaaagagaattgaagaattcttcataactggtgagggccattttaatgaagttttacaatttaaaacgccaggcacgttgagcactacagagtcaacacctgctgagccgccaacagctgaaccttttaagtcctacttcgccaagggcttcctttcaatagattcaggttactattcagccaaatgttactcaggaacatctaattcagggcttcaattgattaatattacccgacattcaactaaaatagctgacacacctgggcctaagatcactaacttaaagaccatcaactgcataaacctgaaggcatcgatcttcaaagaacacagagaggttgaaatcaatgtgcttctcccccaagttgcagttaatctctcaaactgtcacgttgtaatcaaatctcatgtctgtgactatcctttagacattgacggtacggtgaggcttcctcacatttaccatgaaggggttttcattccaggaacttacaaaatagtgatagataaaaaaaccaagttgaatgacagatgcaccttgtttaccgactgtgtgataaaaggaagggaggttcgtaaaggtcagtcagttttgaggcagtacaagacggaaatcaggattggcaaaacatcaaccggctctagaagattgctttccgaagaacccagtgatgactgcatatcaagaactcagctattgaggacagagactgcagagatccacggcgacaactatggtggcccgggtgacaaaataactatctgcaatggctcaactattgtagaccaaagactgggcagtgagctagggtgttacactatcaacagagtgaagtcattcaagctatgcgaaaatagtgccacagggaagagctgtgtaatagacagtgtcccagttaaatgcaggcaaggttattgtctaagaatcactcaggaaggaaggggccatgtaaaattatctaggggctcagaggttgtcttagatgcatgcgatacaagctgtgaaataatgatacctaagggcaccggtgacatcctagttgactgttcaggtgggcagcaacattttctaaaggacaatttgatagatctaggatgccccaaaattccattattgggcaaaatggctatctacatttgcagaatgtcgaatcaccccacaacaaccatggctttcctcttctggttcagctttggctatgtaataacttgtatactttgcaaggccatcttttacttgttaataattattggaacactagggaaaaggttcaggcagtatagagagttaaaacctcagacctgcaccatatgtgagacaactcctgtaaatgcaatagatgctgagatgcatgacctcaattgcagttacaacatttgtccctactgtgcatctagactaacctcagatgggcttgctaggcatgtgacacagtgccctaagcggaaggagaaagtggaagaaactgaactgtacttgaacttagaaagaattccttgggttgtaagaaagctattgcaggtatcagagtccaccggtgtggcattgaaaagaagcagctggctgattgtgctgcttgtgctgttcacggtttcattgtcgccagttcaatcagcacccattggtcacgggaagacaattgaggcataccgtgccagggagggatacacaagtatatgtctctttgtactaggaagtatcctatttgtagtctcttgcctaatgaaaaggttggttgacagtgttggcaactccttcttccctggactgtccatttgcaaaacgtgctccataagcagcattaatggctttgaaattgagtcccataagtgctattgcagcttattctgctgcccctattgtaggcactgctctgctgataaagaaattcacaagctgcacttgagcatctgcaaaaaaagaaaaacaggaagtaatgtcatgttggctgtctgcaagcgcatgtgtttcagggccaccatggaagtaagtgacagagccctgtttattcgtagcatcatcaataccacttttgttttgtgcatactgatactagcagtttgtgttgttagcacctcagcagtggagatggaaaacctaccagccgggacttgggaaagagaagaagacctaacaaatttctgtcatcaggaatgccaggttacagagactgaatgcctctgcccttatgaagctctagtactcagaaagcctctattccgagacagtatagttaaaggcatgaaaaatctgctaaactcaacaagtttagaaacaagtctatcaattgaggcaccatggggggcaataaatgttcagtcaacctacaagccaactgtgtcgactgcaaacatagcactcagctggagctcagtggaacacagaggcaataagatcttggtttcaggcagatcagaatcaattatgaagctggaagaaaggacagggatcagctgggatctcggcgtagaagacgcctctgagtccaaactgcttacagtctctgtcatggacttgtctcagatgtactctcctgtcttcgagtacttatcaggagacagacaggtggaagagtggcccaaagcaacttgtacaggtgactgcccagaaagatgtggctgcacatcatcaacatgtttgcacaaagaatggccccactcaagaaattggagatgcaatcctacttggtgctggggtgtagggactggctgcacctgttgtggattagatgtgaaagacctttttacagattatatgtttgtcaagtggaaagttgaatacatcaagacagaggccatagtgtgtgtagaacttaccagtcaggaaaggcagtgtagcttgattgaagcgggcacaaggttcaatttaggtcctgtgaccatcacactgtcagaaccaagaaacatccaacagaagctccctcctgaaataatcacactacatcctaggattgaagaaggtttttttgacctgatgcacgttcagaaagtgttatcagcaagcacagtgtgtaagttgcagagttgcacacatggtgtaccaggagacctacaggtctaccacatcggaaatttattaaaaggggacaaggtaaatggacatctaattcataaaattgagccacacttcaacacttcctggatgtcctgggatggttgtgacctagactactactgcaacatgggagattggccttcttgcacatacacaggagtcacccaacacaatcgtgcttcatttgtaaacctgctcaacattgaaactgattacacaaaaaacttccattttcactctaaaagggtcactgcacacggagacacaccacaactggatcttaaggcaagaccaacctatggtgcaggtgagattactgtactggtagaagttgctgacatggagttacacacaaagaagattgaaatatcaggcttaaaatttgcaagcttgacttgcacaggttgttatgcttgtagctctggcatctcatgcaaagttagaattcatgtggacgaaccagatgaacttacagtgcatgttaaaagtgatgatccagatgtagttgcagctagctcaagcctcatggcaagaaagcttgaatttggaacagacagcacatttaaagctttctcagccatgcctaaaacttcgctatgtttctacattgttgaaaaagaatactgcaagagctgcagtgaagaagacacaaaaaaatgtgttaacacaaaacttgagcaaccacaaagcattttgatcgaacacaagggaactataatcggaaagcaaaacagcacttgcacagccaaagtgagttgctggttagagtcagccaagagttttttttatggtctaaaggacatgcttagtggcatttttggcaatgtctttataggtattttcttgttccttgcccccttcatcctgttaatactattctttatgtttgggtggaggatcctactttgctttaaatgttgtagaagaactagaggcctgttcaagtatagacacctcaaggacgatgaagaaactggttatagaaggattattgaaagactaaacaataaaaaaggaaaaaacaaattgcttgatggtgaaagacttgctgatagaagaattgctgaactgttctccacaaaaacacacattggctag

SEQ ID NO: 3602 - RNA, 5055 nt, synthetic construct
  misc_feature 1..5055: note = derived and/or modified CDS sequence (wt) from CCHFV(Sudan AB1-2009)__HQ378187.1__GP
  source 1..5055: mol_type = other RNA
atgcatatatcattaatatatgcaatcctttgcctacagctgtgtggtctgggagagactcatggatcacacaatgaaactagacacaataaaacagacaccataacaacacccggtgataacctgagctctgaaccgtcagtgagcacggccttgtctattacacctgacccctccactgtcacacccacaacaccagccagtggattagaaggctcaggggaagtttacacatcccctccgatcaccaccgggagcttgcccctgccggggacaacaccggagctccctgctacaaccggcacagacacttcaagtgcaagtgatgtcgattctagtacgcagacagccggaggcaccttcacactaacagtccgcacaagtctacccagaagccctagcacaccatctacaccacaagacacacaccatcctgtgagaaatctactttcagtcacgagtcctgggccagatgaaacatcaacaccttcgggaacaggcaaagagagcccagcaaccagtagccctcatccagtctccaacagaccaccaacccctcccgcaacagcccagggacctactgaaaatgacagtcacaatgccactgaacaccctgagtccctgacacagtcagcaaccacaggcccaatgacctctccaacacagatagtccatccacaaagtgccacccccataaccgttcaagacacacatcctagcccaacgaacaggtctaaaagaaaccttgagatggaaataatcttgactttgtctcagggtttaaaaaagtactatgggaagatattaaggcttctgcatctcaccttagaggaggacactgaaggtctactggagtggtgtaagagaaatcttggtcttgattgtgatgacactttctttcaaaagagaattgaagaattcttcataactggtgagggccattttaatgaagttttacaatttagaacgccaggcacgttgagcactacagagtcaacacctgccgggctgccaacagctgaaccttttaagtcctacttcgccaaaggcttcctttcaatagattcaggttactactcagccaaatgttactcaggaacatctaattcagggcttcaattgattaacattacccggcattcaactagaatagttgacacacctgggcctaaaattactaacttaaagaccatcaactgcataaacttgaaggcatcgatctttaaagaacatagagaggttgaaatcaatgtgcttctcccccaagttgcagttaatctctcaaactgtcacgttgtaatcaaatcacatgtctgtgactactctttagacattgacggtgcggtgaggcttcctcacatttaccatgaaggagttttcattccaggaacttacaaaatagtgatagataaaaaaaacaagttgaatgacagatgcaccttattcaccaactgtgtgataaaaggaagggaggttcgtaaaggtcagtcagttttgagacagtacaagacggaagtcaggattggcaaagcatcaaccggctccagaagattgctttctgaagaacccagtgatgactgtatatcaagaactcaactactgaggacagagactgcagagatccacggcgataactatggtggcccgggtgacaaaataaccatctgcaatggctcaactattgtagaccaaagactgggcagtgaactagggtgttacaccatcaatagagtaaagtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgacacaagctgtgaaataatgatacctaagggcactggtgacatcctagttgactgttcaggcgggcagcaacattttctaaaggacaatttgatagatctaggatgccccaaaattccattattgggcaaaatggctatttacatttgcagaatgtcgaaccaccccaaaacaaccatggctttcctcttctggttcagctttggctatttaataacctgcatactttgcaaggccattttttacttgttgataattattggaacactagggaaaaggctcaagcagtatagagagttgaaacctcagacctgcaccatatgtgagacaactcctgtaaatgcaatagatgctgagatgcatgacctcaattgcagttacaacatttgcccctactgtgcatctagactaacctcagatgggcttgctaggcatgtgatacaatgccctaagcggaaggagaaagtggaagaaactgaactgtacttgaacctagaaagaattccttgggttgtaagaaagctgttgcaggtgtcagagtcaactggtgtagcattgaaaagaagcagttggctgattgtgctgcttgtgctattcactgtttcattgtcaccagttcaatcagcacccattggtcaagggaagacaattgaagcataccgggccagggaggggtacacaagtatatgtctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgttctaccgataaagaaattcataagctgcacttgagcatctgcaaaaaaaggaaaacaggaagtaatgtcatgttggctgtctgcaagcgcatgtgtttcagggccaccatggaagtaagcaacagagccctgtttatccgtagcatcatcaacaccacttttgttttgtgcatactgatactagcagtttgtgttgttagtacctcagcagtggagatggaaaacctaccagcagggacctgggaaagagaagaagacctgacaaatttctgtcatcaggaatgtcaggttacagagactgaatgcctctgcccttatgaagctctagtactcagaaagcctttattcttagatagtatagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatcttggcgtagaagatgcctctgagtctaaactgcttacagtctctgtcatggacttgtctcagatgtactctcctgtcttcgagtacttatcaggtgacagacaggtggaagagtggcccaaagcaacctgtacaggtgactgcccagaaagatgtggctgcacatcatcaacctgtttgcacaaagaatggcctcactcaagaaattggagatgcaatcccacctggtgctggggtgtagggactggctgcacctgttgtggattagatgtgaaggacctttttacagattacatgtttgtcaagtggaaagttgaatacatcaagacagaggccatagtgtgtgtagaacttactagtcaggaaaggcagtgtagcttgattgaagcgggcacaaggttcaatttgggtcctgtgaccatcacactgtcagaaccaagaaacatccaacaaaaactccctcctgaaataatcacactacatcctaggatcgaagaaggtttttttgacctgatgcatgtacaaaaggtgttatcggcaagcacagtgtgtaagttgcagagttgcacacatggtgtgccaggagacctacaggtctaccacatcggaaatttattaaaaggggataaggtaaatgggcatctaattcataaaattgagccacacttcaacacctcctggatgtcctgggatggttgtgacctagactactactgcaacatgggagattggccttcctgcacatacacaggggtcacccaacacaatcatgcttcatttgtaaacttactcaacattgaaactgattacacaaagaatttccactttcactctaaaagggtcactgcacacggagatacaccacaactagatcttaaggcaagaccaacctatggtgcaggtgagatcactgttctggtagaagttgctgacatggagttacatacaaagaagattgagatatcaggcttaaaatttgcaagcttgacttgcacaggttgttatgcttgcagctctggtatctcatgcaaagttagaattcatgtggatgaaccagatgaacttacagtacatgttaaaagtgatgatccagatgtggttgcagctagctcaagtctcatggcaagaaagcttgaatttggaacagacagtacatttaaagctttctcggccatgcctaaaacttctttatgtttctacattgttgaaagggaacactgtaagagctgcaatgaagaagacacaaaaaaatgtgttaacacaaaacttgagcaaccacaaagcattttgatcgaacacaagggaaccataatcggaaagcagaacagcacttgcacggctagggcgagttgctggttggagtcagtcaagagtttcttttatggcctaaagaacatgcttagtggcatttttggcaatgtctttatgggcatcttcttattccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaagactaaacaataaaaaaggaaaaaacaaactgcttgatggtgaaagacttgctgatagaagaattgccgaactgttctctacaaaaacacacattggctag

SEQ ID NO: 3603 - RNA, 5055 nt, synthetic construct
  misc_feature 1..5055: note = derived and/or modified CDS sequence (wt) from CCHFV(Sudan Al-Fulah 9-2008)__HQ378185.1__GP
  source 1..5055: mol_type = other RNA
atgcatatatcattaatgtatgcagtcctttgcctacagctgtgtggtctaggagagactcatagatcacacaatgaaactgtacacaataaaacagacattgtgacaacgcccagtgatgacctgagttctgaacagctagtgagcacggccttgtcaattacacctgacccctccactgttacgcccacaacatcagccagtggattagaaggctcgggggaagtttacacatcctctccgatcaccaccgagagcttgtcccagccggaaaccacaccgaagctccctgccacaactggtatagacacctcaagtgcaagtgatgttgattccagtacgcaggcagccggagacacttccacactaacagtccgcacaagtccacccaacagccctagcacaccatccacaccacaagacacacaccatcctatgagaaatctactttcagtcacgagccctgggccagaagaaacatctacaccttccggatcaggcaaagagagctcagcaactagtagccctcatccagtctccaacagaccacaaactcctcccgcaacggcccaaggacctactgaagataacagtcacaacgccactgaacaccccgagcacctgacacagtcagcaacctcaggcccaatgacctctccaacacagatagtccacccacaaagtgccaccaccataaccgttcaagacacataccccagtccaacgaacaggtccaaaagaaaccttgagatggaaataatcttgactctgtctcagggtttaaaaaagtactatggcaaaatattaaggcttctgcgtctcaccttagaggaggacactgaaggtctactggaatggtgtaagagaaatcttggtcttgattgtgatgacactttctttcaaaagagaattgaagaattcttcataactggtgaaggccattttaatgatgttttacaatttaaaacgccaggcacgttgagcactacagagtcaacacctgctaagccgccaacagctgaaccttttaagtcctacttcgccaaaggcttccttacaatagattcaggttactattcagccaaatgttactcaggaacatctaattcagggctccaattgattaatattaccagacattcaactagaatagttgacacacctgggcctaagatcaccaacttaaagaccatcaactgcattaacctgaaggcatcaatcttcaaggaacatagagaggttgaaatcaatgtgcttctcccccaagttgcagttaatctctcaaactgtcacgttgtaatcaaatcacatgtctgtgactatcctttagacattgacggtacggtgaggcttcctcacatttaccatgaaggggttttcattccaggaacttacaaaatagtgatagacaaaaaaaataagttgaatgacagatgcaccttgtttaccgactgtgtaataaaaggaagggaggttcgtaaaggtcagtcagttttgaggcagtacaagacggaaatcaggattggcaaggcatcaaccggctctagaagattgctttccgaagaacccagtgatgactgcatatcaagaactcaactattgaggacagagactgcagaaatccacggcgacaactatggtggcccgggtgacaaaataaccatctgcaacggctcaactattgtagaccaaagactgggcagtgagttagggtgttacactatcaatagagtgaagtcattcaagctatgtgaaaatagtgccactgggaagagctgtgtgatagacagtgtcccagttaaatgcaggcagggttattgcctaaggattactcaagaaggaaggggccatgtaaaattatctaggggctcagaggttgtcttagatgcatgcgatacaagctgtgaaataatgatacctaagggcaccggtgacatcctagttgactgttcaggtgggcagcaacattttctaaaggacaatttggtagatctaggatgccccaaaatcccattactgggcaaaatggctatctacatttgcagaatgtcgaatcaccccaaaacaaccatggctttcctcttctggttcagctttggctatgtaataacttgtatactttgcaaggccatcttttacttgttaataattattggaacactagggaaaaggttcaggcagtatagagagttaaagcctcagacctgcaccatatgtgagacaactcctgtaaatgcaatagatgctgagatgcatgacctcaattgcagttacaacatttgtccctactgtgcatctagactaacctcggatgggcttgctaggcatgtgacacagtgccctaagcggaaggagaaagtggaagaaactgaactgtacttgaacttagaaagaattccttgggttgtgagaaagctgttgcaggtatcagagtccaccggtgtggcattgaaaagaagcagctggctgattgtgctgcttgtgctgttcacggtttcattgtcgccagttcaatcagcacccattggtcacgggaagacgattgaggcataccgtgccagggagggatacacaagtatatgtctctttgtactaggaagtatcctatttatagtctcttgcctaatgaaagggttggttgacagtgttggcaactccttcttccctggactgtccatttgcaaaacgtgctccataagcagcattaatggctttgaaattgagtcccataagtgctattgcagcttgttctgttgcccctattgtaggcactgctctgctgataaagaaattcacaagctgcacttgagcatctgcaaaaaaaggaaaacaggaagtaatgtcatgttggctgtttgcaagcgcatgtgtttcagggccaccatggaagtaagtaacagagccctgtttattcgtagcatcatcaataccacttttgttttgtgcatactgatactagcagtttgtgttgttagcacctcagcagtggagatggaaaacctaccagccgggacttgggaaagagaagaagacctaacaaatttctgtcatcaggaatgccaagttacagagactgaatgcctctgcccttatgaagctctagtactcagaaggcctctattcctagacagtatagttaaaggcatgaaaaatctgctaaactcaacaagtttagaaacaagtctgtcaattgaggcaccatggggggcaataaatgttcagtcaacctacaagccaactgtgtcgactgcaaatatagcactcagctggagctcagtggaacacagaggcaataagatcttggtttcaggcagatcagaatcaattatgaagctggaagaaaggacagggatcagctgggatctcggcgtagaagacgcctctgagtctaaactgcttacagtctctgttatggatttgtctcagatgtactctcctgtcttcgagtacttatcaggagacagacaggtggaggagtggcccaaagcaacttgcacaggtgactgcccagaaagatgtggctgcacatcatcaacatgtctgcacaaagaatggccccactcaagaaattggagatgcaatcccacttggtgctggggtgtagggactggctgcacctgctgtggattagatgtgaaagacctttttacagattatatgtttgtcaagtggaaagttgaatacatcaagacagaggccatagtgtgtgtagaactcaccagtcaggaaaggcagtgtagcttgattgaagcaggcacaaggttcaatttaggtcctgtgaccatcacactgtcagaaccaagaaacatccaacagaagctccctcctgaaataatcacactacatcctaggattgaagaaggtttttttgacctgatgcacgttcagaaagtgttatcagcaagcacagtgtgtaagttgcagagttgcacacatggtgtaccaggagacctacaggtctaccacatcggaaatttattaaaaggggacaaggtaaatggacatctaattcataaaattgagccacacttcaacacttcctggatgtcctgggatggttgtgacctagactactactgcaacatgggagattggccttcttgcacatacacaggagtcacccaacacaatcatgcttcatttgtaaacctgctcaacattgaaactgattacacaaaaaacttccactttcactctaaaagggtcactgcacacggagacacaccacaactggatcttaaggcaagaccaacctatggtgcaggtgagattactgtactggtagaagttgctgacatggagttacacacaaagaagattgaaatatcaggcttaaaatttgcaagcttgacttgcacaggttgttatgcctgtagctctggcatctcatgcaaagttagaattcatgtagacgaaccagatgaacttacagtgcatgttaaaagtgatgatccagatgtagttgcagctagctcaagcctcatggcaagaaagcttgaatttggaacagacagtacatttaaagctttttcagccatgcctaaaacttcgctatgtttctacattgttgaaaaagaatactgcaagagctgcagtgaagaagacacaaaaaaatgtgttaacacaaaacttgagcaaccacagagcattttgatcgaacacaagggaactataatcggaaagcaaaacagcacttgcacagccaaggtgagttgctggttagagtcagccaagagttttttttatggtctaaaggacatgcttagtggcatttttggcaatgtctttataggtattttcttattccttgcccccttcgtcctgttagtgctgttctttatgtttgggtggaggatcctactttgctttagatgttgtagaagaactagaggcctgttcaagtatagacacctcaaggacgatgaagaaactggttatagaaggattattgaaagactaaacaataaaaagggaaaaaacaaactgcttgatggtgaaagacttgctgatagaaaaattgctgaactgttctccacaaaaacacacattggttag

SEQ ID NO: 3604 - RNA, 5055 nt, synthetic construct
  misc_feature 1..5055: note = derived and/or modified CDS sequence (wt) from CCHFV(SPU4/81)__DQ157175.1__GP
  source 1..5055: mol_type = other RNA
atgcatatatcattaatgtatgcagtcctttgcctacagctgtgtggtctgggagagactcatggatcatacaatgaaactggacacaataaaacagacgttatgacaacgcccggtgataacctgagctctgaacagccagtgagtacggccttgtctatcacacctgacccctccactgttacacccacaacaccagccaatggattagaaggctcaggggaagtttacacatcctctccgatcaccaccgagagcttgtccctgccagaaaccacaccagagctccctgctacagctggtatagacacttcaagtgcaagtgatgtcgactccagtacgcaagcagccggaggcacctccgcaccaacagtccgcacaagtctacccaacagccctagcacaccatctacaccacaagaaacacaccatcctgtgaggaatctactttcagtcacgagccttgggccagaagaaacatcaacaccttcgggaccaggcaaagagagctcagcaactagtagcccccatccagtctccaacaaaccaccaacccctcccgcaagagcccagggacctactgaaaataacagtcacaacgccactgaacaccccgagcccctgacacagtcagcaaccccaggcctaatgacctctccaacacaggtagtccacccacaaagtgccacctccataaccgttcaagacacataccccagtccaacgaacaggtctaaaagaaaccttgagacggaaataatcttgactttgtctcagggtttaaaaaagtactatggcaaaatattgaggcttctgcgtctcaccttagaggaggacactgaaggtctactggaatggtgtaagagaaatcttggtcttgattgtgatgacactttctttcaaaagagaattgaggaattcttcataactggtgagggccattttaatgaagtcttacaatttaaaacgccaggcacgttgagtactacagagtcaacacctgctgagctgccaacagctgaaccatttaagtcctacttcgccaaaggcttcctttcaatagattcaggttactattcagccaaatgttactcaggaacatctaattcagggcttcaattgattaatattacccgacattcaactagaatagttgacacacctgggcctaagatcaccaacttaaagaccatcaactgcataaacttgaaggcatcgatcttcaaagaacatagagaggttgaaatcaatgtgcttctccctcaagccgcagttaatctctcaaactgtcacgttgtaatcaaatcacatgtctgtgactattctttagacattgacggtacggtgaggcttcctcacatttaccatgaaggagttttcattccaggaacttacaaaatagtgatagataaaaaagataagttgaatgacagatgcaccttatttaccgactgtgtgataaaaggaagggaggttcgtaaaggtcaatcagttttgaggcagtacaagacggaaattaggattggcaaagcatcaatcggctctagaagattgctttccgaagaacccagtgatgactgcatatcaagaactcaactattgaggacagagactgcagagatccacggcgacaactatggtggcccgggtgacaaaataaccatctgcaacggctcaactattgtagaccaaagactaggcagtgagctagggtgttacactatcaacagagtgaagtcattcaagctatgcgaaaatagtgccacagggaagagctgtgaaatagaaagtgtcccagttaaatgcaggcagggttattgcctgagaatcactcaggaagggaggggccatgtaaaattatctaggggctcagaggttgtcttagatgcatgtgatacaagctgtgaaataatgatacctaagggcactggtgacatcttggttgactgttcaggtgggcagcaacattttctaaaggacaatttgatagatctaggatgccccaaaattccattattgggcaaaatggctatttacatttgcagaatgtcgaatcaccccaaaacaaccatggctttcctcttctggttcagctttggctacgtaataacttgtatactttgcaaggccatcttctacttgttaataattattggaacactagggaaaaggttcaagcagtatagagagttaaaacctcagacctgcaccatatgtgagacaactcctgtaaatgcaatagatgctgagatgcacgacctcaattgcagttacaacatttgtccctactgtgcatctagactaacctcagatgggcttgctaggcatgtgacacaatgccctaagcggaaggagaaagtggaagaaactgaactgtacttgaacttagaaagaattccttgggttgtaagaaagctgttgcaggtatcagagtccactggtgtggcattgaaaagaagcagctggctgattgtgctgcttgtgctgttcacggtttcattgtcaccagttcaatcagcacccattggtcacgggaagacaattgaggcataccgggccagggagggatacacaagtatatgtctctttgtactaggaagtatcctattcatagtctcttgcctaatgaaagggctggttgacagtgttggcaactccttcttccctggactgtccatttgcaagacgtgctccataagcagcattaatggctttgaaattgagtcccataagtgctattgcagcttattctgttgcccctattgtaggcactgctctgctgataaagaaattcataagctgcacttgagcatctgcaaaaaaagaaaaacaggaagtaatgtcatgttggctgtctgcaagcgcatgtgtttcagggccaccatggaagtaagtaacagagccctgtttatccgtagcatcatcaacaccacttttgttttgtgtatactgatactagcagtttgtgttgttagcacgtcagcagtggagatggaaaacctaccagccgggacctgggaaagagaagaagacctaacaaatttctgtcatcaggaatgtcaggttacagagactgaatgcctctgcccttatgaagctctagtactcagaaagcctctattcctagatagtatagttaaaggcatgaaaaatctgctaaactcaacaagtttagaaacaagtttatcaattgaggcaccatggggggcaataaatgttcagtcaacctacaaaccaactgtgtcaactgcaaacatagcactcagttggagctctgtggaacacagaggcaataagatcttggtttcaggcagatcagaatcaattatgaagctggaagaaaggacaggaatcagctgggatctcggcgtagaagacgcctctgagtctaaactgcttacagtctctgtcatggacttgtctcagatgtactctcctgtcttcgagtacttatcaggagacagacaggtggaagagtggcccaaagcaacttgtacaggtgactgcccagaaagatgcggctgcacatcatcaacgtgtttgcacaaagaatggccccattcaagaaattggagatgcaatcccacttggtgctggggtgtagggactggctgcacctgttgtggattagatgtgaaagacctttttacagattatatgtttgtcaagtggaaagttgaatatattaagacagaggccatagtgtgtgtagaacttaccagtcaggaaaggcagtgtagcttgattgaagcgggcacaaggttcaatttaggtcctgtgaccatcacactgtcagaaccaagaaacatccaacagaagctccctcctgaaataatcacactgcatcccaggatcgaagaaggtttttttgacttgatgcatgtacagaaagtgttatcggcaagcacagtatgtaagttgcagagttgcacacatggtgtaccaggagacctacaggtctaccacatcggaaatttattgaaaggggataaggtaaatggacatctaattcataaaattgagccacacttcaacacttcctggatgtcctgggatggttgtgacctggactactactgcaacatgggagattggccttcttgcacatacacaggagtcacccaacacaatcatgcttcatttgtaaacctgctcaacattgagactgattacacaaaaaacttccactttcactctaaaagggtcactgcacacggagacacaccacaactagatcttaaggcaagaccaacctatggtgcaggtgagatcactgtactggtagaagttgctgacatggagttacacacaaagaagattgaaatatcaggcttaaaatttgcaagcttgacttgcacaggttgttatgcttgtagctctggcatctcatgcaaagttagaattcatgtggatgaaccagatgaacttacagtacatgttaaaagtgatgatccagatgtagttgcagctagctcaagtctcatggcaagaaagcttgaatttggaacagacagtacatttaaagctttctcagccatgcctaaaacttctctatgtttctacattgttgaaagagaacactgtaagagctgcagcgaagaagacacaaaaaaatgcgtcaacacaaaacttgagcaaccacaaagcattttgatcgaacacaagggaactataatcggaaagcaaaacagcacttgcacagccaaggcgagttgctggttagagtcagtcaaaagttttttttatggtctaaagaacatgcttagtggtatttttggcaatgtttttataggtattttcttgttccttggccccttcatcttgttaatactattctttatgtttgggtggaggatcctattttgctttaaatgttgtagaagaactagaggcctgctcaagtatagacacctcaaggaagatgaagaaactggttatagaaggattattgaaagactaaacaataaaaaaggaaaaaacaaactgcttgatggtgaaagacttgctgatagaagaattgccgaactgttctctacaaaaacacacattggctag

SEQ ID NO: 3605 - RNA, 5055 nt, synthetic construct
  misc_feature 1..5055: note = derived and/or modified CDS sequence (wt) from CCHFV(NIV 11703)__JN572086.1__GP
  source 1..5055: mol_type = other RNA
atgcatacatctttgatatatgtagttctctgcttgcagctgtgtagtctagggaaaactcacggatcacataatggaactgaacacaataaaacagacgttatgacaacgcccggtgataaccagagccctgaaccgctagtgagcacggccctgcctgtcacaccggacccttccactgtcacacctacagcaccagccagcggattagaaggctcaggggaagtttatacatcttcctcaatcaccaccaagggcttatctctgccgaaggctacgtctgagctccttgcgactaccggcatggtcacttcaagtgcaagcgatatcgatcctagcacacaggcagccggagacacccccacaccaacagtccgcacaagtctgcccaacagccccagcacaccatctacatcgcaagacacacaccatcctgtaaggaatctactttcagtcacgagccctaagccagaagaaacaccaacaccgtcaaaatctgacaaagatagctcagcaaccaacagccctcacccagccgccagcagactatcaacccctcccacaacagaccagggacccactgaaaacaacaaccacaactccaccgaacagcttgagtccttaacacgatcagcaacttcaagctcaatggtctctctaacacagacagtacttccacagagtgccacctctatagccactcaagacacacatcccagcccaacgaacaggtctaaaagaaaccttgaaatggaaataatcttgacattgcctcaaggtttaaaaaaatattatggcaaaatacttaagctcctgcatcttactttagaagaagacactgaaggcttgctagaatggtgtaaaaggaatctcggtcttgactgtgatgacaccttctttcaaaaaagaattgaagaattctttataactggtgagggtcatttcaatgaagttttacaatttagagcaccaggcacattgagcaccacagagccaacacatgctgggtcgccaacagctgaaccctttaaatcctactttgctaaaggtttcctttcaatagattcaggttatttctctgccaaatgttattcaagaacatccaattcagggcttcagttgattaatgttacccgacactcaactaggatagctgacacgcccggacccaagatcactaacttaaagactatcaattgcataaacttaaaagcatccgtatttaaagaacatagagaggttgaaatcaatgtgcttctccctcaagttgcagttaacctttcaaattgtcacgttgcaatcaaatcacatgtctgcgattattctttggacactgacggggcgattaggctacctcatattcattatgaaggaacttttattccaggaacttacaagatagtgatagataaaaaaaacaagctgaatgacaggtgtaccctattcaccaactgtgtgataaaaggaagagaagttcgtaagggccagtcagtcctaaggcaatataagacagaaattagaattggtagagcatcaactggttctaggagactgctttccgaagaatctggtgatgactgcatatcaagaactcagctattaaggacagagactgcagaggtccatggcgacaactatggtggtccgggtgataagataaccatctgcaatggttcaactgttgtagatcaaagactgggtagtgaactggggtgttacactatcaatagagtgaagtcctttaagctatgcgaaaacagtgccacagggaagagctgtgaaatagacagtatcccagttaagtgtaggcagggttattgcctaaaaatcactcaggaaggaaggggccatgttaaattatctaggggttcagaagttgtcttggatgcatgtgactcaagctgtgaagtgatgatacctaagggcactggtgacattctagtagattgttcaggtgggcagcaacattttttaaaggacaacctgattgatctaggatgtcccaaaattccattattgggcaaaatggctatttatatctgcagaatgtcgaatcaccccaaaacaaccatggcctttctcttttggttcagcttcggctatgtgataacttgtatactttgcaaggtaattttttacttattaataatttttggaacactagggaaaaggttcaagcagtacagagagttgaaaccccagacctgcaccatatgtgagacaacacctgtgaatgcaatagatgctgaaatgcatgatcttaactgcagttacaatatatgtccctattgtgcgtctaggctaacttcagatgggctcgctaggcatgtaacacaatgccctaagcggaaggagaaggtggaagagaccgaattgtacttgaacttagagagaattccttgggttgtaagaaagctattgcaggtgtcagagtccactggcatagcattaaaaaggagcagctggctaattgtgctgcttgtgttattcacagtatcaataacaccggttcaatcagcgcccattggtcacgggaagacaattgaagcgtaccgggctagggaggaatacacaagcatttgtctctttgtgctgggaagtgtcttgtttgtggtctcttgtctaatgaaaggactggttgacagtgttggcaatatcttctttcctgggctgttcatttgtaagacatgttctataggtagcattaatggctttgaaattgagtctcataagtgctattgtagcttgttttgttgcccttactgtaggcactgctctgctgatagagaaattcatcagctgcacttgagcatctgcaaaaaaaggaagacaggaagtaatgtcatgctggctgtttgcaaacgcatgtgtttcagaacaactatggaagtaagcaacaaagccctatttgtccgaagcatcatcaacaccacttttgttgtgtgcatactgatactagcagtctgtgttgttagcacttcagcagtagagatggaaagcctaccagctgggacctgggaaagagaagaagaccttacaaatttctgccatcaggaatgccaggtcacggagactgagtgcctctgcccctatgaagctctagtgctcagaaggcccctatttctagatagtatagtcaaaggtatgaaaaatctgctaaactcaacaagtctagaaacaagcttatcaattgaggcaccgtggggagcaattaatgttcagtcaacctacaaaccaactgtatcagcagcaaacatagcactcagttggagctcagtggaacacagaggcaataagattttggtctcaggcagatcagaatcaattatgaagctggaagaaaggacaggaatcagctgggatctcggcgtagaagatgcctctgagtctaagctacttacagtctcagtcatggacttgtctcagatgtactctcctgtcttcgagtatttatcaggtgacagacaagtggaagagtggcctaaagcgacctgtacaggtgactgcccagaaagatgtggctgcacatcatcaacctgcttacacaaagagtggccccactcaaggaattggagatgtaatcctacttggtgctggggtgtagggactggctgcacctgctgtggattggatgtgaaagaccttttcacagattacatgttcgtcaagtggaaagttgagtacattaagacagaggccatagtatgtgtagaactaaccagtcaggaaagacagtgtagcttgattgaggcgggcacaagatttaatttaggttctgtgaccattacattgtcagaaccaaggaacattcaacaaaagctccctcctgaaataatcacactgcatcctagaattgaggaaggtttttttgacctaatgcatgtgcaaaaagtgctatcagcaagcacagtgtgtaagttacaaagctgcacacatggtgtgccaggagatctacaggtctaccacattggaaacctattaaaaggggacagagtaaacggacacctaattcacaaaattgaacaacacctcaacacttcttggatgtcctgggatggttgtgatctagactactactgcaatatgggagactggccttcttgcacatatacaggagtcacccaacataatcatgcttcatttgtaaacctgctcaacattgaaactgattacacaaaaaccttccactttcactctaaaagggttactgcacatggagacacaccacagctagatctgaaggcaaggccaacctatggtgcaggtgagatcactgtactggtggaagttgccgatatggagttacacacaaagaagattgaaatatcaggcttgaagtttgcaagcctatcctgcacaggttgttatgcttgtagttctggcatctcctgcaaagtcagaattcatgtagatgaaccagatgaacttacagtacatgttaaaagtgatgatccagatgtagttgcagctagctcaagtctcatggcaaggaagcttgaatctggaacagacagtacatttaaagctttttcagccatgcctaaaacttccttgtgcttctacattgtagagagagaatactgtaagggctgcagtaaagaagacacacaaaaatgtgttaacacgaaactcgagcaaccacagagcattttgatcgaacacaagggaactataattggaaagcaaaacaatacttgcacagctaaggcaagttgctggttagagtcagttaagagttttttttatggtctgaagaatatgcttagtggcatttttggcaatgtttttttaggcattttctcatttcttgccccctttgtcctattaatacttttctttatgtttgggtggaggatcctgttttgcttcaagtgttgcagaagaaccagaggcctattcaagtacagacacctcaaagacgatgaagaaactggttacagaaagatcattgaaagactgaacaacaaaaaggggaaaaacaaactgcttgatggtgaaaggcttgctgacagaaaaattgccgaactgttctccacaaaaacacacattggctag

SEQ ID NO: 3606 - RNA, 5055 nt, synthetic construct
  misc_feature 1..5055: note = derived and/or modified CDS sequence (wt) from CCHFV(NIV 112143)__JN572085.1__GP
  source 1..5055: mol_type = other RNA
atgcatacatctttgatatatgtagttctctgcttgcagctgtgtagtctagggaaaactcacggatcacataatggaactgaacacaataaaacagacgttatgacaacgcccggtgataaccagagccctgaaccgctagtgagcacggccctgcctgtcacaccggacccttccactatcacacctacagcaccagccagcggattagaaggctcaggggaagtttatacatcttcctcaatcaccaccaagggcttatctctgccgaaggctacgtctgagctccttgcgactaccggcatggtcacttcaagtgcaagcgatatcgatcctagcacacaggcagccggagacacccccacaccaacagtccgcacaagtctgcccaacagccccagcacaccatctacatcgcaagacacacaccatcctgtaaggaatctactttcagtcacgagccctaagccagaagaaacaccaacaccgtcaaaatctgacaaagatagctcagcaaccaacagccctcacccagccgccagcagactatcaaccccccccacaacagaccagggacccactgaaaacaacaaccacaactccaccgaacagcttgagtccttaacacgatcagcaacttcaagctcaatggtctctctaacacagacagtacttccacagagtgccacctctatagccactcaagacacacatcccagcccaacgaacaggtctaaaagaaaccttgaaatggaaataatcttgacattgcctcaaggtttaaaaaaatattatggcaaaatacttaagctcctgcatcttactttagaagaagacactgaaggcttgctagaatggtgtaaaaggaatctcggtcttgactgtgatgacaccttctttcaaaaaagaattgaagaattctttataactggtgaaggtcatttcaatgaagttttacaatttagagcaccaggcacattgagcaccacagagccaacacatgctgggtcgccaacagctgaaccctttaaatcctactttgctaaaggtttcctttcaatagattcaggttatttctctgccaaatgttattcaagaacatccaattcagggcttcagttgattaatgttacccgacactcaactaggatagctgacacgcccggacccaagatcactaacttaaagactatcaattgcataaacttaaaagcatccgtatttaaagaacatagagaggttgaaattaatgtgcttctccctcaagttgcagttaacctttcaaattgtcacgttgcaatcaaatcacatgtctgcgattattctttggacactgacggggcgattaggctacctcatattcattatgaaggaacttttattccaggaacttacaagatagtgatagataaaaaaaacaagctgaatgacaggtgtaccctattcaccaactgtgtgataaaaggaagagaagttcgtaaaggccagtcagtcctaaggcaatataagacagaaattagaattggtagagcatcaactggttctaggagactgctttccgaagaatctggtgatgactgcatatcaagaactcagctattaaggacagagactgcagaggtccatggcgacaactatggtggtccgggtgataagataaccatctgcaatggttcaactgttgtagatcaaagactgggtagtgaactggggtgttacactatcaatagagtgaagtcctttaagctatgcgaaaacagtgccacagggaagagctgtgaaatagacagtatcccagttaagtgtaggcagggttattgcctaaaaattactcaggaaggaaggggccatgttaaattatctaggggctcagaagttgtcttggatgcatgtgactcaagctgtgaagtgatgatacctaagggcactggtgacattctagtagattgttcaggtgggcagcaacattttttaaaggacaacctgattgatctaggatgtcctaaaatcccattattgggcaaaatggctatttatatctgcagaatgtcgaatcaccccaaaacaaccatggcctttctcttttggttcagcttcggctatgtgataacttgtatactttgcaaggtaattttttacttattaataatttttgggacactagggaaaaggttcaagcagtacagagagttgaaaccccagacctgcaccatatgtgagacaacacctgtgaatgcaatagatgctgaaatgcatgatcttaactgcagttacaatatatgtccctattgtgcgtctaggctaacttcagatgggctcgctaggcatgtaacacaatgccctaagcggaaggagaaggtggaagagaccgaattgtacttgaacttagagagaattccttgggttgtaagaaagctattgcaggtgtcagagtccactggcatagcattaaaaaggagcagctggctaattgtgctgcttgtgttattcacagtatcaataacaccggttcaatcagcgcccattggtcacgggaagacaattgaagcgtaccgggctagggaggaatacacaagcatttgtctctttgtgctgggaagtgtcttgtttgtggtctcttgtctaatgaaaggactggttgacagtgttggcaatatcttctttcctgggctgttcatttgtaagacatgttctataggtagcattaatggctttgaaattgagtctcataagtgctattgtagcttgttttgttgcccttactgtaggcactgctctgctgatagagaaattcatcagctgcacttgagcatctgcaaaaaaaggaagacaggaagtaatgtcatgctggctgtttgcaaacgcatgtgtttcagagcaactatggaagtaagcaacaaagccctatttgtccgcagcatcatcaacaccacttttgttgtgtgcatactgatactagcaatctgtgttgttagcacttcagcagtagagatggaaagcctaccagctgggacctgggaaagagaagaagaccttacaaatttctgccatcaggaatgccaggtcacggagactgagtgcctctgcccctatgaagctctagtgctcagaaggcccctatttctagatagtatagtcaaaggtatgaaaaatctgctaaactcaacaagtctagaaacaagcttatcaattgaggcaccgtggggagcaattaatgttcagtcaacctacaaaccaactgtatcagcagcaaacatagcactcagttggagctcagtggaacacagaggcaataagattttggtctcaggcagatcagaatcaattatgaagctggaagaaaggacaggaatcagctgggatctcggcgtagaagatgcctctgagtctaagctacttacagtctcagtcatggacttgtctcagatgtactctcctgtcttcgagtatttatcaggtgacagacaagtggaagagtggcctaaagcgacctgtacaggtgactgcccagaaagatgtggctgcacatcatcaacctgcttacacaaagagtggccccactcaaggaattggagatgtaatcctacttggtgctggggtgtagggactggctgcacctgctgtggattggatgtgaaagaccttttcacagattacatgttcgtcaagtggaaagttgagtacattaagacagaggccatagtatgtgtagaactaaccagtcaggaaagacagtgtagcttgattgaggcgggcacaagatttaatttaggttctgtgactattacattgtcagaaccaaggaacattcaacaaaagctccctcctgaaataatcacactgcatcctagaattgaggaaggtttttttgacctaatgcatgtgcaaaaagtgctatcagcaagcacagtgtgtaagttacaaagctgcacacatggtgtgccaggagatctacaggtctaccacattggaaacctattaaaaggggacagagtaaacggacacctaattcacaaaattgaacaacacctcaacacttcttggatgtcctgggatggttgtgatctagactactactgcaatatgggagactggccttcttgcacatatacaggagtcacccaacataatcatgcttcatttgtaaacctgctcaacattgaaactgattacacaaaaaccttccactttcactctaaaagggttactgcacatggagacacaccacagctagatctgaaggcaaggccaacctatggtgcaggtgagatcactgtactggtggaagttgccgatatggagttacacacaaagaagattgaaatatcaggcttgaagtttgcaagcctatcctgcacaggttgttatgcttgtagttctggcatctcctgcaaagttagaattcatgtagatgaaccagatgaacttacagtacatgttaaaagtgatgatccagatgtagttgcagctagctcaagtctcatggcaaggaagcttgaatttggaacagacagtacatttaaagctttttcagccatgcctaaaacttccttgtgcttctacattgtagagagagaatactgtaagggctgcagtaaagaagacacacaaaaatgtgttaacacgaaactcgagcaaccacagagcattttgatcgaacacaagggaactataattggaaagcaaaataatacttgcacagctaaggcaagttgctggttagagtcagttaagagttttttttatggtctgaagaatatgcttagtggcatttttggcaatgtttttttaggcattttctcatttcttgccccctttgtcctattaatacttttctttatgtttgggtggaggatcctgttttgcttcaagtgttgcagaagaaccagaggcctattcaagtacagacacctcaaagacgatgaagaaactggttacagaaagatcattgaaagactgaacaacaaaaaggggaaaaacaaactgcttgatggtgaaaggcttgctgacagaaaaattgccgaactgttctccacaaaaacacacattggctag

SEQ ID NO: 3607 - RNA, 5055 nt, synthetic construct
  misc_feature 1..5055: note = derived and/or modified CDS sequence (wt) from CCHFV(NIVA 118594)__JN572084.1__GP
  source 1..5055: mol_type = other RNA
atgcatacatctttgatatatgtagttctctgcttgcagctgtgtagtctagggaaaactcacggatcacataatggaactgaacacaataaaacagacgttatgacaacgcccggtgataaccagagccctgaaccgctagtgagcacggccctgcctgtcacaccggacccttccactgtcacacctacagcaccagccagcggattagaaggctcaggggaagtttatacatcttcctcaatcaccaccaagggcttatctctgccgaaggctacgtctgagctccttgcgactaccggcatggtcacttcaagtgcaagcgatatcgatcctagcacacaggcagccggagacacccccacaccaacagtccgcacaagtctgcccaacagccccagcacaccatctacatcgcaagacacacaccatcctgtaaggaatctactttcagtcacgagccctaagccagaagaaacaccaacaccgtcaaaatctgacaaagatagctcagcaaccaacagccctcacccagccgccagcagactatcaacccctcccacaacagaccagggacccactgaaaacaacaaccacaactccaccgaacagcttgagtccttaacacgatcagcaacttcaagctcaatggtctctctaacacagacagtacttccacagagtgccacctctatagccactcaagacacacatcccagcccaacgaacaggtctaaaagaaaccttgaaatggaaataatcttgacattgcctcaaggtttaaaaaaatattatggcaaaatacttaagctcctgcatcttactttagaagaagacactgaaggcttgctagaatggtgtaaaaggaatctcggtcttgactgtgatgacaccttctttcaaaaaagaattgaagaattctttataactggtgagggtcatttcaatgaagttttacaatttagagcaccaggcacattgagcaccacagagccaacacatgctgggtcgccaacagctgaaccctttaaatcctactttgctaaaggtttcctttcaatagattcaggttatttctctgccaaatgttattcaagaacatccaattcagggcttcagttgattaatgttacccgacactcaactaggatagctgacacgcccggacccaagatcactaacttaaagactatcaattgcataaacttaaaagcatccgtatttaaagaacatagagagtttgaaatcaatgtgcttctccctcaagttgcagttaacctttcaaattgtcacgttgcaatcaaatcacatgtctgcgattattctttggacactgacggggcgattaggctacctcatattcattatgaaggaacttttattccaggaacttacaagatagtgatagataaaaaaaacaagctgaatgacaggtgtaccctattcaccaactgtgtgataaaaggaagagaagttcgtaagggccagtcagtcctaaggcaatataagacagaaattagaattggtagagcatcaactggttctaggagactgctttccgaagaatctggtgatgactgcatatcaagaactcagctattaaggacagagactgcagaggtccatggcgacaactatggtggtccgggtgataagataaccatctgcaatggttcaactgttgtagatcaaagactgggtagtgaactggggtgttacactatcaatagagtgaagtcctttaagctatgcgaaaacagtgccacagggaagagctgtgaaatagacagtatcccagttaagtgtaggcagggttattgcctaaaaatcactcaggaaggaaggggccatgttaaattatctaggggttcagaagttgtcttggatgcatgtgactcaagctgtgaagtgatgatacctaagggcactggtgacattctagtagattgttcaggtgggcagcaacattttttaaaggacaacctgattgatctaggatgtcccaaaattccattattgggcaaaatggctatttatatctgcagaatgtcgaatcaccccaaaacaaccatggcctttctcttttggttcagcttcggctatgtgataacttgtatactttgcaaggtaattttttacttattaataatttttggaacactagggaaaaggttcaagcagtacagagagttgaaaccccagacctgcaccatatgtgagacaacacctgtgaatgcaatagatgctgaaatgcatgatcttaactgcagttacaatatatgtccctattgtgcgtctaggctaacttcagatgggctcgctaggcatgtaacacaatgccctaagcggaaggagaaggtggaagagaccgaattgtacttgaacttagagagaattccttgggttgtaagaaagctattgcaggtgtcagagtccactggcatagcattaaaaaggagcagctggctaattgtgctgcttgtgttattcacagtatcaataacaccggttcaatcagcgcccattggtcacgggaagacaattgaagcgtaccgggctagggaggaatacacaagcatttgtctctttgtgctgggaagtgtcttgtttgtggtctcttgtctaatgaaaggactggttgacagtgttggcaatatcttctttcctgggctgttcatttgtaagacatgttctataggtagcattaatggctttgaaattgagtctcataagtgctattgtagcttgttttgttgcccttactgtaggcactgctctgctgatagagaaattcatcagctgcacttgagcatctgcaaaaaaaggaagacaggaagtaatgtcatgctggctgtttgcaaacgcatgtgtttcagaacaactatggaagtaagcaacaaagccctatttgtccgaagcatcatcaacaccacttttgttgtgtgcatactgatactagcagtctgtgttgttagcacttcagcagtagagatggaaagcctaccagctgggacctgggaaagagaagaagaccttacaaatttctgccatcaggaatgccaggtcacggagactgagtgcctctgcccctatgaagctctagtgctcagaaggcccctatttctagatagtatagtcaaaggtatgaaaaatctgctaaactcaacaagtctagaaacaagcttatcaattgaggcaccgtggggagcaattaatgttcagtcaacctacaaaccaactgtatcagcagcaaacatagcactcagttggagctcagtggaacacagaggcaataagattttggtctcaggcagatcagaatcaattatgaagctggaagaaaggacaggaatcagctgggatctcggcgtagaagatgcctctgagtctaagctacttacagtctcagtcatggacttgtctcagatgtactctcctgtcttcgagtatttatcaggtgacagacaagtggaagagtggcctaaagcgacctgtacaggtgactgcccagaaagatgtggctgcacatcatcaacctgcttacacaaagagtggccccactcaaggaattggagatgtaatcctacttggtgctggggtgtagggactggctgcacctgctgtggattggatgtgaaagaccttttcacagattacatgttcgtcaagtggaaagttgagtacattaagacagaggccatagtatgtgtagaactaaccagtcaggaaagacagtgtagcttgattgaggcgggcacaagatttaatttaggttctgtgaccattacattgtcagaaccaaggaacattcaacaaaagctccctcctgaaataatcacactgcatcctagaattgaggaaggtttttttgacctaatgcatgtgcaaaaagtgctatcagcaagcacagtgtgtaagttacaaagctgcacacatggtgtgccaggagatctacaggtctaccacattggaaacctattaaaaggggacagagtaaacggacacctaattcacaaaattgaacaacacctcaacacttcttggatgtcctgggatggttgtgatctagactactactgcaatatgggagactggccttcttgcacatatacaggagtcacccaacataatcatgcttcatttgtaaacctgctcaacattgaaactgattacacaaaaaccttccactttcactctaaaagggttactgcacatggagacacaccacagctagatctgaaggcaaggccaacctatggtgcaggtgagatcactgtactggtggaagttgccgatatggagttacacacaaagaagattgaaatatcaggcttgaagtttgcaagcctatcctgcacaggttgttatgcttgtagttctggcatctcctgcaaagtcagaattcatgtagatgaaccagatgaacttacagtacatgttaaaagtgatgatccagatgtagttgcagctagctcaagtctcatggcaaggaagcttgaatctggaacagacagtacatttaaagctttttcagccatgcctaaaacttccttgtgcttctacattgtagagagagaatactgtaagggctgcagtaaagaagacacacaaaaatgtgttaacacgaaactcgagcaaccacagagcattttgatcgaacacaagggaactataattggaaagcaaaacaatacttgcacagctaaggcaagttgctggttagagtcagttaagagttttttttatggtctgaagaatatgcttagtggcatttttggcaatgtttttttaggcattttctcatttcttgccccctttgtcctattaatacttttctttatgtttgggtggaggatcctgttttgcttcaagtgttgcagaagaaccagaggcctattcaagtacagacacctcaaagacgatgaagaaactggttacagaaagatcattgaaagactgaacaacaaaaaggggaaaaacaaactgcttgatggtgaaaggcttgctgacagaaaaattgccgaactgttctccacaaaaacacacattggctag

SEQ ID NO: 3608 - RNA, 5055 nt, synthetic construct
  misc_feature 1..5055: note = derived and/or modified CDS sequence (wt) from CCHFV(UCCR4448)__KY484042.1__GP
  source 1..5055: mol_type = other RNA
atgcatatatcattaatgtatgcagtcctttgcctacagctgtgtggtctgggagagactcatggatcacacaatgaaactggacacaataaaacagacgttatgacaactcccggtgataacctgagctctgaacagccagtgagtacggccttgtctatcacacctgacccctccactgttacacccacaacaccagccagtggattagaaggctcaggggaagtttacacatcccctccgatcatcaccgagagcttgtccctgccagaaaccacaccagagctctctgctacagccggtatagacacttcaagtgcaagtgatgtcgattctagtacgcaagcagccagaggcacctccgcactaacagtccgcacaagtctacccaacagccctagcacaccatctacaccacaagaaacacaccatcctgtgagaaatctactttcagtcacgagtcctaggccagaagaaacatcaacaccttcgggatcaggcaaagagagctcagcaactagtggccctcatccagtctccaacaaaccaccaacccctcccgcaaaaacccagggacctactgaaaataacagtcacaacgccactgaacaccccgagcccctgacacagtcagcaaccctaggcctaatgacctctccaacacagatagtccacccacaaagtgccacctccataaccgttcaagacacataccccagtccaacaaacaggtctaaaagaaaccttgagatggaaataatcttgactttgtctcagggtttaaaaaagtactatggcaaaatattgaggcttctgcgtctcaccttagaggaggacactgaaggtctactggaatggtgtaagagaaatcttggtcttgattgtgatgacactttctttcaaaagagaattgaggaattcttcataactggtgagggccattttaatgaagttttacaatttaaaacgccaggcacgttgagtactacagagtcgacacctgctgagctgccaacagctgaaccttttaagtcctacttcgccaaaggcttcctttcaatagattcaggttactattcagccaaatgttactcaggaacatctaattcagggcttcaattgattaatattacccgacattcagctagaatagttgacacacctgggcctaaggtcaccaacttaaagaccatcaactgcataaacttgaaggcatcgatcttcaaagaacatagagaggttgaaatcaatgtgcttctccctcaagttgcagttaatctctcaaactgtcacgttataatcaaatcacatgtctgtgactattctttagacattgacggtacggtgaggcttcctcacatttaccatgaaggagttttcattccaggaacttacaaaatagtgatagataaaaaagataagttgaatgacagatgcaccttatttaccgactgtgtgataaaaggaagggaggttcgtaaaggtcagtcagttttgaggcagtacaagacggaaatcaggattggcaaagcatcaaccggctctagaagattgctttccgaagaaaccagtgatgactgcatatcaagaactcaactattgaggacagagactgcagagatccacggcgacaactatggtggcccgggtgacaaaataaccatctgcaacggctcaactattgtagaccaaagactaggcagtgagctagggtgttacactatcaacagagtgaagtcattcaagctatgcgaaaatagtgccacagggaagagctgtgaaatagacagtgtcccagttaaatgcaggcagggttattgcctaagaatcactcaggaagggaggggccatgtaaaattatctaggggctcagaggttgtcttagatgcatgtgatacaagctgtgaaataatgatacctaagggcactggtgacatcttggttgactgttcaggtgggcagcaacattttctaaaggacaatttgatagatctaggatgccccaaaattccattattgggcaaaatggctatttacatttgcagaatgtcgaatcaccccaaaacaaccatggctttcctcttctggttcagctttggctacgtgataacttgtatactttgcaaggccatcttctacttgttaataattattggaacactagggaaaaggttcaagcagtatagagagttaaaaccccagacctgcaccatatgtgagacaactcctgtaaatgcaatagatgctgagatgcacgacctcaattgcagttacaacatttgtccctactgtgcatctagactaacctcagatgggcttgctaggcatgtaacacaatgccctaagcggaaggagaaagtggaagaaactgaactgtacttgaacttagaaagaattccttgggttgtaagaaagctgttgcaggtatcagagtccactggtgtggcattgaaaagaagcagctggctgattgtgctgcttgtgctgttcacgatttcattgtcaccagttcaatcagcacccattagtcacgggaagacaattgaggcataccgggccagggagggatacacaagtatatgtctctttgtactaggaagtatcctattcatagtctcttacctaatgaaagggctggttgacagtgttggcaactccttcttccctggactgtccatttgcaagacgtgctccacaagcagcattaatggctttgaaattgagtcccataagtgctattgcagcttattctgttgcccttattgtaggcactgctctgctgataaagaaattcataagctgcacctgagcatctgcaaaaaaagaaaaacaggaagcaatgtcatgttggctgtctgcaagcgcatgtgtttcagggccaccatggaagtaagtaacagagccctgtttatccgtagcatcatcaacaccacttttgttttgtgtatactgatactagcagtttgtgttgttagcacctcagcagtggagatggaaaacctaccagccgggacctgggaaagagaagaagacctaacaaatttctgtcatcaggaatgtcaggttacagagactgaatgcctctgcccttatgaagctctagtactcagaaagcctctattcctagatagtatagttaaaggcatgaaaaatctgctaaactcaacaagtttagaaacaagtttatcaattgaggcaccatggggggcaataaatgttcagtcaacctacaaaccaactgtgtcaactgcaaacatagcactcagttggagctctgtggaacacagaggtaataagatcttggtttcaggcagatcagaatcaattatgaagctggaagaaaagacaggaatcagctgggatctcggcgtagaagacgcctctgagtctaaactgcttacagtctctgtcatggacttgtctcagatgtactctcctgtcttcgagtacttatcaggagacagacaggtggaagagtggcccaaagcaacttgtacaggtgactgcccagaaagatgcggctgcacatcatcaacgtgtttgcacaaagaatggccccactcaagaaattggagatgcaatcccacttggtgctggggtgtagggactggctgcacctgttgtggattagatgtgaaagacctttttacagattatatgtttgtcaagtggaaagttgaatatattaagacagaggccatagtgtgtgtagaacttaccagtcaggaaaggcagtgtagcttgattgaagcgggcacaaggttcaatttaggtcctgtgaccatcacactgtcagaaccaagaaacatccaacagaagctccctcctgaaataatcacactgcatcccaggatcgaagaaggtttttttgacctgatgcatgtacaaaaagtgttatcggcaagcacagtatgtaagttgcagagttgcacacatggtgtaccaggagacctacaggtctaccacatcggaaatttattgaaaggggataaggtaaatggacatctaattcataaaattgagccacacttcaacacttcctggatgtcctgggatggttgtgacctggactactactgcaacatgggagattggccttcttgcacatatacaggagtcacccaacacaatcatgcttcatttgtaaacctgctcaacattgaaactgattacacaaaaaacttccactttcactctaaaagggtcactgcacatggagacacaccacaactagatcttaaggcaagaccaacctatggtgcaggtgagatcactgtactggtagaagttgctgacatggaattacacacaaagaagattgaaatatcaggcttaaaatttgcaagcttgacttgcacaggttgttatgcttgtagctctggcatctcatgcaaagttagaattcatgtggatgaaccagatgaacttacagtacatgttaaaagtgatgatccagatgtagttgcagctagctcaagtctcatggcaagaaagcttgaatttggaacagacagtacatttaaagctttctcagccatgcctaaaacttctctatgtttctacattgttgaaagagaacactgtaagagctgcagcgaagaagacacaaaaaaatgtgttaacacaaaacttgagcaaccacaaagcattttgatcgaacacaagggaactataatcggaaagcaaaacagcacttgcacagccaaggcgagttgctggttagagtcagtcaaaagtttcttttatggtctaaagaacatgcttagtggtatttttggcaatgtttttataggtattttcttgttccttgcccccttcatcctattaatactattctttatgtttgggtggaagatcctattttgctttaaatgttgtagaagaactagaggcctattcaagtatagacacctcaaggacgatgaagaaactggttatagaaggattattgaaagactaaacaataaaaaaggaaaaaacaaactgcttgatggtgaaatacttgctgatagaagaattgccgaactgttctctacaaaaacacacattggctag

SEQ ID NO: 3609 - RNA, 5055 nt, synthetic construct
  misc_feature 1..5055: note = derived and/or modified CDS sequence (wt) from CCHFV(UCCR4401)__KY484035.1__GP
  source 1..5055: mol_type = other RNA
atgcatatatcattaatgtatgcaatcctttgcctacagctgtgtggtctgggagagactcatggatcacacaatgaaactagacacaataaaacagacaccatgacaacacccggtgataacccgagctctgaaccgccagtgagcacggccttgtctattacacttgacccctccactgtcacacccacaacaccagccagtggattagaaggctcaggggaagtctacacatcccctccgatcaccaccgggagcttgcccctgtcggagacaacaccagaactccctgttacaaccggcacagacaccttaagcgcaggtgatgtcgatcccagcacgcagacagccggaggcacctccgcaccaacagtccgcacaagtctacccaacagccctagcacaccatctacaccacaagacacacaccatcctgtgagaaatctactttcagtcacgagtcctgggccagatgaaacatcaacaccctcgggaacaggcaaagagagctcagcaaccagtagccctcatccagtctccaacagaccaccaacccctcctgcaacagcccagggacccactgaaaatgacagtcacaactccactgaacaccctgagtccctgacacagtcagcaaccccaggcctaatgacctctccaacacagatagtccacccacaaagtgccacccccataaccgttcaagacacacatcccagtccaacgaacaggtctaaaagaaaccttaagatggaaataatcttgactttatctcagggtttaaaaaagtactatgggaaaatattaaggcttctgcaactcaccttagaggaggacactgaaggtctactggaatggtgtaagagaaatcttggtcttgattgtgatgacactttctttcaaaagagaattgaagaattctttataactggtgagggccattttaatgaagttttacaatttagaacgccaggcacgttgagcaccacagagtcaacacctgctgggctgccaacagctgaaccttttaagtcctacttcgccaaaggcttcctctcgatagattcaggttactactcagccaaatgttactcaggaacatccaattcagggcttcaattgattaacattacccgacattcaactagaatagttgacacacctgggcctaagatcactaacctaaagaccatcaactgcataaacttgaaggcatcgatcttcaaagaacatagagaggttgaaatcaatgtgcttctcccccaagttgcagttaatctctcaaactgtcacgttgtaatcaaatcacatgtctgtgactactctttagacattgacggtgcggtgaggcttcctcacatttaccatgaaggagttttcatcccaggaacttacaaaatagtgatagataaaaaaaataagttgaatgacagatgcaccttatttaccgactgtgtgataaaaggaagggaggttcgtaaaggacagtcagttttgaggcagtacaagacggaaatcaggattggcaaggcatcaaccggctctagaagattgctttcagaagaacccagtgatgactgtatatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggccattttttacttgttaataattgttggaacactagggaaaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaacaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctggcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatagaagaattgccgaactgttctctacaaaaacacacattggctag

SEQ ID NO: 3610 - RNA, 5055 nt, synthetic construct
  misc_feature 1..5055: note = derived and/or modified CDS sequence (wt) from CCHFV(IbAn7620)__KX013451.1__GP
  source 1..5055: mol_type = other RNA
atgcatatatcattaatatatgcaatcctttgcctacagctgtgtggtctgggagagacttatggatcacacaatgaaactagacacaataaaacagacaccatgacaacacctggtgataacctgagctctgaaccgccagtgagcacggccttgtttattacacctgacccctccactgtcacacccacaacaccagccagtggattagaaggctcaggggaagtttacacatctcctccgatcaccaccgggagcttgcccctgccagagacaacaccagagctccctgctacaaccggcacagacacttcaagtgcaagtgatgtcgattttagcacgcagacagccggaggcacctccgcactaacagtccgtacaggtctacccgacagccctagcacaccatctacaccacaagacacacaccatcctatgagaaatctactttcagtcacgagtcctgggccagatgaaacatcaacaccttcgggaacaggcagagagagctcagcaactagtagccctcatccagtttccaacagaccaccaacccctcccgcaacagcccagggacctactgaaaatgacagtcacaacgccactgaacatcctgagtccctgacacagtcagcaaccccaggcctaatgacctctccaacacagacaatccacccacaaagtgccacccccataaccgttcaagacaaacagcctagtccaacgaacaggtctaaaagaaaccttgaaatggaaataatcttgactttgtctcaggggttaaaaaaatactatgggaaaatattaaggcttctgcatctcaccttagaggaggacactgaaggtctactggaatggtgtaagagaaatcttggtcttgattgtgatgacaatttctttcaaaagagaattgaagaattcttcataactggtgagggccattttaatgaagttttacaatttagaacgccaggcacgttgagcactacagagtcaacacctgctgggctgccaacagctgaaccttttaagtcctacttcgccaaaggcttcctttcaatagattcaggctactactcagccaaatgttactcgggaacatccaattcagggcttcaattgattaacattacccgacattcaactagaatagttgacacacctgggcctaagatcactaacttaaagaccatcaactgcataaacttgaaggcatcgatcttcaaagaacatagagaggttgaaatcaatgtgcttctcccccaagttgcagttaatctctcaaactgtcacgttgtaatcaaatcacatgtctgtgactactctttagacattgacggtgcggtgaggcttcctcacatttaccatgaaggagttttcattccaggaacttacaaaatagtgatagataaaaaaaataagttgaatgacagatgcaccttatttaccgactgtgtgataaaaggaagggaggttcgtaaaggtcagtcagttttgaggcagtacaagacggaaatcaggattggcaaagcatcaaccggctctagaagattgctttccgaagaacccagtgatgactgtatatcaagaactcaactattgaggacagagactgcagagatccacggcgacaactatggtggcccgggtgataaaataaccatctgcaatggctcaactattgtagaccaaagactgggcagtgaactagggtgttacaccatcaatagagtgaagtcattcaagctatgcgaaaacagtgccacagggaagaattgtgaaatagacagtgtcccagttaaatgcaggcagggttattgcctaagaatcactcaagaagggaggggccacgtaaaattatctaggggctcagagattgtcttagatgcatgcgatacaagctgtgaaataatgatacctaagggcactggtgacatcctagttgactgttcaggtgggcagcaacattttctaaaggacaatttgatagatctaggatgccctaaaattccattattgggcaaaatggctatttacatttgcagaatgtcgaaccaccccaaaacaaccatggctttcctcttctggttcagctttggttatgtaataacctgtatactttgcaaggccattttttacttgttaataattattggaacactagggaaaaggctcaagcagtatagagagttgaaacctcagacctgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtcaagggaagacaactgaggcataccgggccagggaagggtacacaagtatatgtctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaagaggaaaacaggaagtaatgtcatgttggctgtctgcaagcgcatgtgtttcagggccaccatggaagtgagtaacagagccctgtttatccgtagcatcatcaacaccacttttgtcttgtgcatactgatactagcagtttgtgttgttagcacctcagcagtggagatggaaaacctaccagcagggacctgggaaagagaagaagatctgacaaatttctgtcatcaggaatgccaggttacagagactgaatgcctctgcccttatgaagctctagtactcagaaagcctttgttcctagatagtatagctaaaggcatgaaaaatccgctaaattcaacaagtttagaaacgagtttatcaattgaggcaccatggggagcaatagatgttcagtcaacctacaaaccaactgtgtcaactgcaaacatagcactcagttggagctcagtggaacacagaggtaataagatcttggtttcaggcagatcagaatcaattatgaagctagaagaaaggacgggaatcagctgggatctcggcgtagaagatgcctctgagtctaaactgcttacagtctctgtcatggacctgtctcagatgtactctcctgtcttcgagtacttatcaggggacagacaggtggaagagtggcccaaagcaacttgtacaggtgattgcccagaaagatgtggttgcacatcatcaacctgtttgcacaaagaatggcctcactcaagaaattggagatgcaatcccacttggtgctggggagtagggactggctgcacctgttgtggattagatgtgaaagacctttttacagattatatgtttgtcaagtggaaagttgaatacatcaagacagaggccatagtgtgtgtagaacttaccagtcaggaaaggcagtgtagcttgattgaagcgggcacgaggttcaatttaggtcctgtgaccatcacactgtcagaaccaagaaacatccaacaaaaactccctcctgaaataatcacactgcatcctaggatcgaagaaggtttttttgatctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacttcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagacacaccacaactagatcttaaggcaagaccaacctatggtgcaggcgagatcactgttctggtagaagttgctaacatggagttacatacaaagaagattgaaatatcaggcttaaaatttgcaagcttgacttgtacaggttgttatgcttgtagctctggcatctcatgcaaagttagaattcatgtggatgaaccagatgaacttacagtacatgttaaaagtgatgatccagatgtggttgcagctagctcaagtctcatggcaagaaagcttgaatttggaacagacagtacatttaaagctttctcggccatgcccaaaacttctctatgtttctacattgttgaaagagaacactgtaagagctgcagtgaagaagatacaaaaaaatgtgttaacacaaagcttgagcaaccacaaagcattttgatcgaacacaagggaactataataggaaagcaaaacagcacttgcacggctaaggcgagttgctggttggagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtacagacacctcaaagacgatgaagaaactggttatagaaggattattgaaagactaaacaataaaaaaggaaaaaacaagctgcttgatggtgaaagacttgctgatagaagaattgccgaactgttctctacaaaaacacacattggctag

SEQ ID NO: 3611 - RNA, 5055 nt, synthetic construct
  misc_feature 1..5055: note = derived and/or modified CDS sequence (wt) from CCHFV(Zahedan 2007)__KC867273.1__GP
  source 1..5055: mol_type = other RNA
atgcatatatcattgatgtatgcagttttctgcttgcaactgtgcggtctagggaagactaacggaccacacaatgggactgaacacaataatacacacgttatgacaacgcctgatgacagtcagagccctgaaccgccagtgagcacagccttacctgtcacaccggacccttcaactgtcacaccttcaacaccagccagcggattagaaggctcaggagaggttcacacatcctctccaatcaccaccaagggtttgtctctgccggaggccacatctgagcccccttcgactaccagcgtggtcacttcaagtgcaagtgataccgattctagcacacaggcagccggagacacccctacaccaacagtccgcacgagtctgcccagcagccctagcacaccatccacatcacaaggcacacactatcccgtgaggagtctgctttcagtcacgggccctaagcctgaagaaacaccaacaccgtcaaaatcaggcaaagataacttagcaaccaacagcccccacccagccaccagcagaccaacaaccccttccacaatagcccagaaacccactgaaaacaacagccacaacaccaccgaacagcttgaatccttaacacacttagcaactttaggttcaaagatctctccaacacagacagtcctcccacagagtgttacctctatagccattcaagacattcataccagcccaacaaataggtctaaaagaaaccttgatatggaaataatcttaacgttatctcaaggtctgaaaaagtattatggcaaaatacttaagctcctgcgtctcaccttagaggaagacactgaaggcttgttagagtggtgcaagagaaatctcggtcttgactgtgatgacaccttcttccaaaaaagaatcgaagaattcttcataactggtgagggtcatttcaatgaagttttacaatttagaacactaggcacattgagtaccacagagtcaacgcatgctggatcaccaacagttgaacccttcaaatcctactttgctaaaggtttcctttcaatagattcaggttatttctctgccaaatgttattcaagaacatccaattcagggctccaattgattaatgttacccgacattcaactaggatagctgacacgcctgggcccaagatcactaacctaaagaccatcaattgcataaacttaaaagcatccgtctttaaagaacatagagaggttgaaatcaatgtgcttctccctcaagttgcagtcaacctctcaaactgtcatgttgcaatcaaatcacatatctgtgactattctttagacaccgacggggcgattaggcttcctcaaattcatcatgaaggcacttttatcccaggtacttacaaaatagtgatagacaaaaaaagtaagctgaatgacaggtgtaccctattcaccaactgtgtgataaaaggaagagaagttcgtaaaggccagtcagtcctaaggcaatataagacagaaattagaattggcagggcatcaactggttctaggagactgctttccgaagaatctggtgatgactgcatatcaagaactcagctattgaggacagagactgcagaggtccatggcgataactatggtggtccaggtgataagataaccatctgtaatggttcaactgttgtagatcaaagactgggtagtgaactggggtgttacactatcaatagagtgaggtcattcaagctatgcgaaaacagtgccacagggaagagctgtgaaatagacagtatcccagtcaagtgtaagcagggtttttgcctaaaaatcactcaggaaggaaggggccatgtgaagttatctagaggctcagaagttgtcttggatgtatgtgattcaagctgtgaagtgatgatacctaagggcactggtgacattctagtggattgttcaggtgggcagcaacattttttaaaagacaacctggttgacctagggtgtcccaaaattccgttactgggcaaaatggctatttatatctgcaggatgtcgaatcatcccaagacaaccatggccttcctcttttggttcagctttggctatgtgataacttgtatactttgcaaggccatttttttcttattaataatttttggaacactagggaaaaggttcaagcagtacagagagttgaaaccccagacctgcaccatatgtgagacaacacctgtaaatgcaatagatgctgaaatgcatgatctcaactgcagttacaatatatgtccctattgtgcgtctagactgacttcagatggacttgctaggcatgtgacacaatgtcctagacggaaggagaaagtggaggaaaccgaattatacctgaatttagaaagaattccctgggttgtaagaaagctattgcaggtgtcagagtccactggtacagtattaaaaaggagcagctggctaattgtattacttgtgctgttcacagtttcattgtcaccagttcaatcagcacccattggtcacgggaaaacaattgaaacataccgggttagggaagaatacacaagtatttgcctctttgtactaggaagtatcctgtttatagtctcttttctaatgaaaggactggttgacggtgttggcaacatcttctttcctgggctgtccgtctgtaagacatgctctataggtagcattaatggctttgaaattgagtctcataggtgctactgtagcttgttttgttgcccttactgtaggcactgctctgctgatggagaaatccatcagctgcacttgagcatctgcaaaaaaaggaagacaggaagtaacgttatgctggctgtttgcaaacgcatgtgtttcagggcaactatggaagtaagcaacaaagtcctatttatccgtagcattatcaacaccacttttgttgtgtgcatactgatactagcggtttgtgttgttagcacctcagcagtagagatggaaagcctaccagctgggacctgggaaagagaagaagacctaacaaatttctgccatcaggaatgccaggtcacagagactgagtgcctctgcccttatgaagctctagtgctcagaaggcccctatttctagatagtatagtcaaagatatgaaaaatctgctaaactcaacaagtctagaaacaagcttatcaattgaggcaccatggggagcaattaatgttcagtcaacctacaaaccaactgtatcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagtcatggacttgtctcagatgtactctcctgtcttcgagtacttatcaggtgacagacaagtggaagagtggcctaaagcaacctgcacaggtgactgcccagaaagatgtggctgcacatcatcaacctgcttacacaaagagtggccccactcaaggaattggagatgtaatcctacttggtgctggggtgtagggactggctgcacctgttgtggtttagacgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagagccaaggaacattcaacaaaagctccctcctgaaataatcacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacttgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacaactagatctgaaggcaaggccaacctatggtgcaggtgagatcaccgtgcttgtggaagttgctgacatggagttacacacaaagaagattgaaatatcaggcttaaaatttgcaggcctaacttgcacaggttgttatgcttgtagttctggcatctcttgtaaagttagaattcatgtagatgaaccagatgaacttacagtacatgttaaaagtgatgacccagatgtagttgcagctagctcaagtctcatggcgaggaagcttgaatttggaacagacagtacatttaaagctttctcagccatgcctaaaacctccctatgtttctacattgtggaaagagaatactgtaagagctgcagtaaagaagatacacaaaaatgtgttaacacgaaactcgaacaaccacagagcattttgatcgaacataagggaactataattggaaagcaaaacaatacttgcacggctaaagcgagttgctggttagagtcagttaagagttttttttatggtctgaagaatatgctcggtggcatatttggcaatgtttttataggcattttcacatttcttaccccctttatcttgttaatatttttctttatgtttgggtggaggatcctgttttgcttcaagtgttgcagaagaaccagaggcctattcaagtacagacacctcaaagacgatgaagaaactggttacagaaagatcattgaaagactgaacaacaaaaagggaaaaaacaggctgcttgatggtgaaagacttgctgacagaaagattgctgaactgttctccacgaaaacacacattggctag

SEQ ID NO: 3612 - RNA, 5055 nt, synthetic construct
  misc_feature 1..5055: note = derived and/or modified CDS sequence (wt) from CCHFV(Afg09-2990)__HM452306.1__GP
  source 1..5055: mol_type = other RNA
atgcatatatcattgatgtatgcagttttctgcttgcaactgtgcggtctagggaagactaacggaccacacaatgggactgaacacaataatacacacgttatgacaacgcctgatgacagtcagagccctgaaccgccagtgagcacagccttacctgtcacgccggatccttcaactgtcacaccttcaacaccagccagcggattagaaggctcaggagaggtttacacatcctctccaatcaccaccaagggtttgtctctgccggaggccacatctgagccccctgcgactaccagcgtggtcacttcaagtgcaagtgataccgattctagcacacaggcagccggagacacccccacaccaacagtccgcacgagtctgcccagcagccctagcacaccatccacatcacaaggcacacactatcccgtgaggagtctgctttcagtcacgagccctaagccagaagaaacaccaacaccgtcaaaatcaggcaaagataacttagcaaccaacagcccccacccagccaccagcagaccaacaacccctcccacaacagcccagaaacccactgaaaacaacagccacaacaccaccgaacagcttgagtccttaacgcatttagcaactttaggttcaatgatctctccaacacagacagtcctcccacagagtgttacctctatagccattcaagacattcataacagcccaacaaataggtctaaaagaaaccttgatatggaaataatcttaacgttatctcagggtctgaaaaagtattatggcaaaatacttaagctcctgcatctcaccttagaggaagacactgaaggcttgttagagtggtgcaagagaaatctcggtcttgactgtgatgacaccttcttccaaaaaagaatcgaagaattcttcataactggtgagggtcatttcaatgaagttttacaatttagaacactaggcacattgagtaccacagagtcaacgcatgctggatcaccaacagttgaacccttcaaatcctactttgctaaaggtttcctttcaatagattcaggttatttctctgccaaatgttattcaagaacatccaattcagggctccaattgattaatgttacccgacattcaactaggatagctgacacgcctgggcccaagatcactaacctaaagaccatcaattgcatgaacttaaaagcatccgtctttaaagaacatagagaggttgaaatcaatgtgcttctccctcaagttgcagtcaacctctcaaactgtcatgttgcaatcaaatcacatatctgtgactattctttagacaccgacggggcgattaggcttcctcaaattcatcatgaaggcacttttatcccaggtacttacaaaatagtgatagacaaaaaaagtaagctgaatgacaggtgtaccctattcaccaactgtgtgataaaaggaagagaagttcgtaaaggccagtcagtcctaaggcaatataagacagaaattagaattggcagggcatcagctggttctaggagattgctttccgaagaatctggtgatgactgcatatcaagaactcagctattgaggacagagactgcagaggtccatggcgataactatggtggtccaggtgataagataaccatctgtaatggttcaactgttgtagatcaaagactgggtagtgaactggggtgttacactatcaatagagtgaggtcattcaagctatgcgaaaacagtgccacagggaagagctgtgaaatagacagtatcccagtcaagtgtaagcagggttattgccttaaaatcactcaggaaggaaggggccatgtgaagttatctagaggctcagaagttgtcttggatgtatgtgattcaagctgtgaagtgatgatacctaagggcactggtgacattctagtagattgttcaggtgggcagcaacattatttaaaagacaacctggttgacctagggtgtcccaaaattccgttactgggcaaaatggctatttatatctgcaggatgtcgaatcaccccaagacaaccatggccttcctcttttggttcagctttggctatgtgataacttgtatactttgcaaggccatttttttcttattgataatttttggaacactagggaaaaggttcaagcagtacagagagttgaaaccccagacctgcaccatatgtgagacaacacctgtaaatgcaatagatgctgaaatgcatgatctcaactgcagttacaatatatgtccctattgtgcgtctagactgacttcagatgggcttgctaggcatgtaacacaatgtcctagacggaaggagaaagtggaggaaaccgaattatacctgaatttagagagaattccctgggttgtaagaaagctattgcaggtgtcagagtccactggtacagtattaaaaaggagcagctggctaattgtattacttgtgctgttcacagtttcattgtcaccagttcaatcagcacccattggtcacgggaaaacaattgaaacataccgggttagggaagaatacacaagtatttgcctctttgtactagggagtatcctgtttatagtctcttttctaatgaaaggactggttgacggtgttggcaacatcttctttcctgggctgtccgtctgtaagacatgctctataggtagcattaatggctttgaaattgagtctcataagtgctactgtagcttgttttgttgcccttactgtaggcactgctctgctgatggagaaatccatcagctgcacttgagcatctgcaaaaaaaggaagacaggaagtaatgttatgctggctgtttgcaaacgcatgtgtttcagggcaactatggaagtaagcaacaaagccctatttatccgtagcattatcaacaccacttttgttgtgtgcatactgatactagcggtttgtgttgttagcacctcagcagtagagatggaaagcttaccagctgggacctgggaaagagaagaagacctaacaaatttctgccatcaggaatgccaggtcacagagactgagtgcctctgcccttatgaagctctagtgctcagaaggcccctatttctagatagtatagtcaaaggtatgaaaaatctgctaaactcaacaagtctagaaacaagcttatcaatagaggcaccgtggggagcaattaatgttcagtcaacctacaaaccaactgtatcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagttatggacttgtctcagatgtactctcctgtcttcgagtacttatcaggtgacagacaagtggaagagtggcctaaagcaacctgtacaggtgactgcccagaaagatgtggctgcacatcatcaacctgcttacacaaagagtggccccactcaaggaattggagatgtaatcctacttggtgctggggtgtagggactggctgcacctgttgtggtttagatgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagaaccaaggaacattcaacaaaagctccctcctgaaataattacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacctgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacaactagatctgaaagcaaggccaacctatggtgcaggtgagatcaccgtgctggtggaagttgctgacatggagttacacacaaagaagattgaaatatcaggcttaaaatttgcaggcctaacttgcacaggttgttatgcttgtagttctggcatctcttgtaaagttagaattcatgtagatgaaccagatgaacttacagtacatgttaaaagtgatgacccagatgtagttgcagctagctcaagtctcatggcgaggaagcttgaatttggaacagacagtacatttaaagctttctcagccatgcctaaaacctccctatgtttctacattgtggaaagagaatactgtaagagctgcagtaaagaagatacacaaaaatgtgttaacacgaaactcgaacaaccacagagcattttgatcgaacataagggaactataattggaaagcaaaacaatacttgcacggctaaagcgagttgctggttagagtcagttaagagtttcttttatggtctgaagaatatgctcggtggcatatttggcaatgtttttataggcattttcacatttcttaccccctttatcttgttaatacttttctttatgtttgggtggaggatcctgttttgcttcaagtgttgcagaagaaccagaggcctattcaagtacagacacctcaaagacgatgaagaaactggttacagaaagatcattgaaagactgaacaacaaaaaaggaaaaaacaggctgcttgatggtgaaagacttgctgacagaaagattgctgaactgttctccacaaaaacacacattggctag

SEQ ID NO: 3613 - RNA, 5055 nt, synthetic construct
  misc_feature 1..5055: note = derived and/or modified CDS sequence (wt) from CCHFV(SPU41/84)__AY900142.1__GP
  source 1..5055: mol_type = other RNA
atgcatatatcattaatgtatgcagttctttgcctacagctgtgtggtctgggggagactcatggatcacataatggaactagatacaataatacagacgctacgacaacgcccggtgatagccagagccctgaaccgccagtgagcacggcctcgtccatcacacacaacccctccactgtcacatccacaacaccaaccagcggatctgaaggctcaggggaagtttacacatcctctccaatcaccaccgagggcctatctccaccggggaccactccagagctcccagccacaaccggtatagacacttcaggtgcaagtgatgccaaccccagcacacaggcagccagaggcacctctgcactaacagtccacacaagtttgcccagcagccctagcacaccacctatatcacaagacacacaccaccctgtgaggaacctactttcagttacgagccctatgccagaagagacaacagcaccttcgggttcaggcaaggagagctcagcaaccagcagcccccatccagcttccgacagaccaccaacccctcccgcaacagcccaggggctcactgaaagtaacagtcacaacgccaccgaacatcttgagtccctgacacagtcagcaaccccaggcctagtaacctctccagcacagacagtccacccacatagcgcaacctccatagccgctccagacacacaccccaacccaacaaacagatctaaaagaaaccttgaaatggaaataatcttgaccttgtctcagggcttaaaaaaatactacggcaaaatactcagacttctgcatcttaccttggaagaagacactgaaggtctactggaatggtgtaagaggaatcttggtcttgattgtgatgacaccttctttcaaaagaggattgaagaattcttcataactggtgagggccattttaatgaagttttacaatttagaacgccaggcacagtgagcactacagagtcaacacatgctggaccgccaacagctgaaccctttaagtcctatttcgctaaaggctccctttcaatagattcaggttactattcagccaaatgttactcaggaacatctaattcagggcttcagctgatcaacattacccgacattcaactaaaatagctgacacacctgggcctaagatcactaacttgaagaccatcaactgcataaacttaaaggcattgaccttcaaagaacacagagaggttgaaatcaatgtacttctccctcaagttgcagttaatctctcaaattgtcatgttgtaatcaaatcacatgtctgtgactactctttggacattgacgggacggtgaggctccctcacattcatcatgaaggtattttcattccaggaacttataaaatagtgatagataagaaaaacaagatgaatgacagatgtaccctattcaccaactgtgtgataaaagggagggaggttcgtaaaggccagtcagttttgaagcagtacaagacagaaatcaggattggcaaggcatcaaccggctctagaagattgctctccgaggagtctagcgacgactgcatatcaagaactcaactattgaggacagagactgcagagatccacggcgataactatggtggcccaggtgacaagataaccatctgcaatggctcaactgttgtagaccagagactgggtagtgagctggggtgttacactatcaatagagtaaagacattcaaactatgcgaaaacagtgctacagggaagagttgtgagatagatagtgtcccagttaaatgcaggcagggttattgcctaaaaatcactcaggaaggaaggggccatgtaaaattatctagaggctcagaggttgtcttggatgcatgtgatacaagctgtgaagtaatgatacccaaaggcactggtgacatcctagttgactgttcaggtgggcagcaacattttctaaaagacaatctaatagacctaggatgccccaaaattccattactgggtaaaatggctatttacatttgcagaatgtcgaatcaccccaaaacaactatggctttcctcttctggttcagctttggctatgtgataacttgtataatttgtaaggtcattttttacttgttaataattgttggaacactaggaaaaaggttcaagcagtacagagagttaaaacctcagacctgcaccatatgtgagacaactcctgtgaatgcaatagatgctgagatgcatgacctcaattgcagttacaacatatgtccctattgtgcatctagactaacctcagacgggcttgctaggcatgtgacacagtgccctaagcggaaggaaaaagtggaggaaactgaattgtacttgaacttggagagaattccctgggttgtgagaaagctgttgcaggtatcagagtccactggtgtggcattgaaaaggagcagctggctggttgtgctgctggtgctgttgacggtttcattgtcaccggttcagtcagcgcccattagtcatgggaagacagttgaggcataccgggcaagagaggggtacacaagtatgtgtctctttgtgctgggaagtgtcctgtttttagtctcctgtctaatgaaaggactggttgacagtgtcggcaacaccttcttccctggactgtccatttgcaaaacgtgctctataagcagcattaatggctttgaaattgagtctcataggtgctattgcagcttgttttgttgcccatattgtaggcactgctctgctaataaagaaattcatcagctgcacttgagcatctgcaaaaaaaggaaagcaggaagtaatgtcatgctggctgtctgcaagcgcatgtgctttagggccaccatggaagtaagcaacagagccctgtttatccgtagcatcatcaacaccacttttgttttatgcatactgatactagcagcctgtgttgtcagcacctcagcagtggagatggaaagcctaccagccgggacctgggagagagaagaagacctaacaaacttctgtcatcaggaatgccaagttgcggatactgaatgcctctgcccttatgaagctctagtgctcagaagacctctattcttagatagtatagttaagggcatgaaaaatttgctaaactcaacaagtttagagacaagtttatcaattgaggcaccatggggagcaataaatgttcagtcaacctacaaaccaactgtatcaactgcaaacatagcgcttagttggagctcagtggaacacagaggcaataagatactggtttcaggcagatcagaatcaattatgaagctggaagaaaggacaggaataagctgggatctcggtgtggaagacgcctctgagtctaaactgcttacagtctctgtcatggacttgtctcagatgtactcacctgtcttcgagtacttatcaggagacagacaggtggaggagtggcccaaagcaacttgtacgggtgactgcccagaaagatgtggctgcacatcatcaacctgcttgcacaaagaatggccccactcaagaaattggagatgtaatcccacttggtgctggggtgtaggaactggctgcacctgttgtggattagacgtgaaagacctctttacagattatatgtttgtcaagtggaaagttgaatacattaagacagaagcaatagtgtgtgtagaacttactagtcaggaaagacagtgtagcttgattgaagcgggcacaaggttcaacttgggtcctgtgaccatcacattgtcagaaccaagaaacatccagcaaaagctcccacctgaaataatcacactgcatcccaggattgaggagggtttttttgacctgatgcatgtacaaaaagtgttgtcggcaagcacagtgtgtaagttgcagagttgcacacatggtgtgccaggagatctacaggtctaccacatcggaaatttactaaaaggggataaggtaaatgggcacctagttcataaaattgagccacacttcaatacttcttggatgtcctgggatggttgtgatctagactattattgcaacatgggagattggccttcttgcacatacacaggagttacccagcacaatcatgcctcatttgtaaacatgctcaacattgaaactgattacacaaaaaacttccactttcactctaaaagggtcactgcacacggagacacaccacaactagatcttaaagcaagaccaacctatggtgcaggtgagatcactgtattggtggaggttgctgacatggagttacacacaaagaagattgaaatatcaggcttaaaatttactagcttgacttgtacaggttgttatgcttgtagttctggcatctcatgcaaagttagaattcatgtggatgaaccagatgagcttacagtgcatgttaaaagtgaagatccagatgttgttgcagctagctcaagtctcatggcaagaaagcttgaatttggaacagacagtacatttaaagctttttcagccatgcctaaaacttctctatgtttctacattgtggaaagagaatactgtaagagctgcagtgaagaagacacacaaaaatgtgttaacacaaaacttgagcagccacagagcattttgatcgaacgtaagggaactataatcgggaagcaaaacaacacttgcaaggctaaggcgggttgctggttagagtcagttaagagttttttttacggcctaaagaacatgctcagtggcatttttggcaatgtatttataggcattttcttattccttgcccccttcatcctgttaatactattctttatgtttgggtggaggatcttgttttgttttaagtgttgtagaagaaccagaggcctgttcaagtacagacacctgaaagacgatgaagaaactggttatagaaagatcattgaaagactaaacaacaaaaaagggaaaaataaactgcttgatggtgaaagacttgctgatagaagaattgccgaactgttctctacaaaaacacacattggctag

SEQ ID NO: 3614 - RNA, 5055 nt, synthetic construct
  misc_feature 1..5055: note = derived and/or modified CDS sequence (wt) from CCHFV(SPU103/87)__DQ211634.1__GP
  source 1..5055: mol_type = other RNA
atgcatatatcattaatgtatgcagttctttgcctacagctgtgtggtctggggggagctcatggatcacataatggaactagatacaataatacaggcgctttgacaacgctcggtgatggccagagctctgaaccgccagtgagcacggccccatccaccacacacaacccctccactgtcacatccacaacaccagctagcgggtctgaaggctcaggggaagtttacacagcctctccagtcaccaccgagggcctgtctccaccggggaccactccagagctccccgccacaaccggtatagacacttcaggtgcaagtgatgccgaccccagcacacaggcagccggagacacctctgcactaacagtccgcacaagtttgcccagcagccctagcacactgcctacatcacaagacacacaccatcctgtgaggaacctactttcagttacgagccctaggccagaagagacaacagcaccttcaggttcaggcatagagagctcagcaaccagcagcccccatccagcttccgacagaccaccaacccctcccgcagcagcccagggacccactgaaagtaacagtcacaacgccaccgaacatcttgagtccctgacacagtcagcaaccccagatctagtaacctctccagcacagacagtccacccacagagcgccacctccatagccgctccagacacacaccccagcccaacaaacagatctaaaagaaaccttgaagtggaaataatcttgaccttgtctcagggtttaaaaaaatactacggcaaaatacttaggcttctgcatcttaccttggaggaggacactgaaggtctactggaatggtgtaagagaaatcttggccttgattgtgatgacactttctttcaaaaaagaattgaagaattcttcataactggggagggccattttaatgaagttttacaatttagaacgccaggcacagtaagcactacagagtcaacacatgctggaccgccaacagctgaaccctttaagtcctattttgctaaaggcttcctttcaatagattcaggttactattcagccaaatgttactcaggaacatctaattcagggcttcagttgatcaatattacccgacattcaactagaatagctgacacacctgggcctaagatcactaacttaaagaccatcaactgcataaacttaaaggcattgaccttcaaagaacacagagaggttgaaatcaatgtgcttctccctcaagttgcagttaatctctcaaattgtcatgttgtaatcaaatcacatgtctgtgactactctctagacatcgacgggacggtgaggctccctcacattcatcatgaaggaattttcatcccaggaacttataaaatagtgatagataaaaaaaacaagctgaatgacagatgtaccctattcaccgactgtgtgataaaaggaagggaggttcgtaaaggccagtcagttttgaagcagtacaagacagaaatcaggattggcaaggcatcaaccggctctagaagattgctctccgaggagtctagcgacgactgtatatcaagaactcaactattgaggacagagactgcagagatccacggcgataactatggtggcccaggtgacaagataaccatctgcaatggctcaactattgtagaccagagactgggtagtgagctggggtgttacactatcaatagagtaaagacattcaaactatgcgaaaacagtgctacagggaagagttgtgaaatagatagtgtcccagttaaatgcaggcagggttattgcctaaaaatcactcaggaaggaaggggtcatgtaaaattatctagaggctcagaggttgtcttagatgcatgtgacacaagctgtgaagtaatgatacccaaaggcactggtgacatcctagttgactgttcaggtgggcagcaacattttctgaaagacaatctgatagatctaggatgccccaaaattccattgctgggtaaaatggctatttatatttgcagaatgtcgaatcaccccaaaacaactatggctttcctcttctggttcagctttggctatgtgataacttgtgtactttgcaaggccattttttacttgttaataattgttggaacactaggaaaaaggctcaagcagtacagagagttaaaacctcagacctgcaccatatgtgagacaactcctgtgaatgcaatagatgctgagatgcatgacctcaattgcagttacaacatatgtccctattgtgcatctagactaacctcagacgggcttgctaggcatgtgacacagtgccctaagcggaaggaaaaagtggaggaaactgaattgtacttgaacttggaaagaattccttgggttgtgagaaggctgttgcaggtatcagagtccactggtgtggcattgaaaagaagcagctggctgattgtgctactggtgctgttcacggtttcattgtcaccggttcagtcagcgcccattagtcatgggaagacagttgaggcataccaggccagagaggggtacacaggcatgtgtctctttgtgctgggaagtatcctgtttttagtctcttgtctaatgaaaggactggttgacagtgtcggcaacaccttcttccctggactgtccatttgcaaaacgtgctctataagcagcattaatggctttgaaattgagtcgcataggtgctattgcagcttgttttgttgcccatactgtagacactgctctgctaataaagaaattcatcagctgcacttgagcatctgcaaaaaaaggaaaacaggaagcaatgtcatgctggctgtctgcaagcgcatgtgctttagggccaccatggaagtaagcaacagagccctgtttatccgtagcatcatcaacaccacttttgttttatgcatactgatactagcagtttgtgttgttagcacctcagcagtggagatggaaagcctaccagccggaacctgggagagagaagaagacctaacaaatttctgtcatcaggaatgccaagttacggatactgaatgcctctgcccttatgaggctctagtgctcagaagacccctattcttagataatatagttaaaggcatgaaaaatttgctaaactcaacaagtttggagacaagtttatcaattgaggcaccatggggagcaataaatgttcagtcaacctacaaaccaactgtatcaactgcaaacatagcgcttagttggagctcagtagaacacagaggcaataagatactggtttcgggcagatcagaatcaattatgaagctggaagaaaggacaggaataagctgggatctcggtgtagaagacgcctctgagtctaaactgcttacagtctctgtcatggacttgtcacagatgtactcacctgtcttcgagtacttatcaggagacagacaggtggaagagtggcccaaagcaacttgtacgggtgattgcccagaaagatgtggctgcacatcatcaacctgcttacataaagaatggccccattcaaggaattggagatgtaaccccacttggtgctggggtgtagggactggctgcacctgttgtggattagacgtgaaagacctctttacagattatatgtttgtcaagtggaaaattgaatacattaaaacagaagcaatagtgtgtgtagaacttactagtcaggaaagacagtgtagcttgattgaagcgggcacaaggttcaatttgggtcccgtgaccatcacattgtcagaaccaagaaacatccagcaaaagctcccttctgaaataatcacactgcatcccaggattgaggagggtttttttgacctgatgcatgtacaaaaagtgttgtcggcaagcacagtgtgtaagttgcagagttgcacacatggtgtgccaggagatctacaggtctaccacatcggaaatttattaaaaggggataaggtaaatggacacctagttcataaaattgagccacacttcaatacttcttggatgtcctgggatggttgtgatctagactattattgcaacatgggagattggccttcttgcacatacacaggagttacccagcacaatcatgcttcatttgtaaacctgctcaacattgaaactgattacacaaaaaacttccactttcactctaaaagggtcactgcacacggagacacaccacaactggatcttaaggcaagaccaacctatggtgcaggtgagatcactgtattggtggaagttgctgacatggagttacacacaaagaagattgaaatatcaggcttaaaatttacaagcctgacttgtacaggctgttatgcttgtagttctggcatctcatgcaaagttagaattcatgtggatgaaccagatgaacttacagtgcatgttaaaagtgatgatccagatgttgttgcagctagctcaagtctcatggcaagaaagcttgaatttggaacagacagtacatttaaggctttttcagccatgcctaaaacttctctatgtttctacattgtggaaagagaatactgtaagagctgcagtgaagaagacacacaaaaatgtgttaacacaaaacttgagcagccacagagcattttgatcgaacataagggtactataatcgggaagcaaaacaacacttgcaaggctagggcgggttgctggttagagtcagttaagagttttttttacggcctaaagaacatgctcagtggcatttttggcaatgtatttataggcattttcttatttcttgcccccttcatcctattaatactattctttatgtttgggtggaggatcttgttttgttttaagtgttgtagaagaactagaggcctgttcaagtatagacacctgaaagacgatgaagaaactggttatagaaagatcattgaaagactaaacaacaaaaaagggaaaaataaactgcttgatggtgaaagacttgctgatagaagaattgccgaactgttctctacaaaaacacacattggctag

SEQ ID NO: 3615 - RNA, 5055 nt, synthetic construct
  misc_feature 1..5055: note = derived and/or modified CDS sequence (wt) from CCHFV(Iran-53)__DQ446216.1__GP
  source 1..5055: mol_type = other RNA
atgcatatatcattgatgtatgcagttttctgcttgcaactgtgcggtctagggaagactaacggaccacacaatgggactgaacacaataatacacacgttatgacaacgcctgatgacagtcagagccctgaaccgccagtgagcacagccttacctgtcacaccggacccttcaactgtcacaccttcaacaccagccagcggattagaaggctcaggagaggtttacacatcctctccaatcaccaccaagggtttgtctctgccggaggccacatctgagccccctgcgactaccagcgtggtcacttcaagtgcaagtgacaccgattctagcacacaggcagccggaggcacccctacaccaacagtccgcacgagtctgcccagcagccctagcacaccatccacatcacaaggcacacactatcccgtgaggagtctgctttcagtcacgagccctaagccagaagaaacaccaacaccgtcaaaatcaggcaaagataacttagcaaccaacagcccccacccagccaccagcagaccaacagcccctcccacaacagcccagaaacccactgaaaacaacagccacaacaccaccgaacagcttgagtccttaacacacttagcaactttaggttcaatgatctctccaacacagacagtcctcccacagagtgttacctctatagccattcaagacattcataccagcccaacaaataggtctaaaagaaaccttgatgtggaaataatcttaacgttatctcagggcctgaaaaagtattatggcaaaatacttaagctcctgcatctcaccttagaggaagacactgaaggcttgttagagtggtgcaagagaaatctcggtcttgactgtgatgacaccttcttccaaaaaagaatcgaagaattcttcataactggtgagggtcatttcaatgaagttttacaatttagaacactaggcacattgagtaccacagagtcaacgcatgctggatcaccaacagttgaacccttcaaatcctactttgctaaaggtttcctttcaatagattcaggttatttctctgccaaatgttattcaagaacatccaattcagggctccaattgattaatgttacccgacattcaactaggatagctgacacgcctgggcctaagatcactaacctaaagaccatcaattgcataaacttaaaagcatccgtctttaaagaacatagggaggttgaaatcaatgtgcttctccctcaagttgcagtcaacctctcaaactgtcatgttgcaatcaaatcacatatctgtgactattctttagacaccgacggggcaattaggcttcctcaaattcatcatgaaggcacttttatcccaggtacttacaaaatagtgatagacaaaaaaagtaagctgaatgacaggtgtaccctattcaccaactgtgtgataaaaggaagagaagttcgtaaaggccagtcagtcctaaggcaatataagacagaaattagaattggcagggcatcaactggttctaggagattgctttccgaagaatctggtgatgactgcatatcaagaactcagctattgaggacagagactgcagaggtccatggcgataactatggtggtccaggtgataagataaccatctgtaatggttcaactgttgtagatcaaagactgggtagtgaactggggtgttacactatcaatagagtgaggtcattcaagctatgcgaaaacagtgccacagggaagagctgtgaaatagacagtatcccagtcaagtgtaagcagggttattgcctaaaaatcactcaggaaggaaggggccatgtgaagttatctagaggctcagaagttgtcttggatgtatgtgattcaagctgtgaagtgatgatacctaagggcactggtgacattctagtagattgttcaggtgggcagcaacattttttaaaagacaacctggttgacctagggtgtcccaaaattccgttactgggcaaaatggctatttatatctgcaggatgtcgaatcaccccaagacaaccatggccttcctcttttggttcagctttggctatgtgataacttgtatactttgcaaggccatttttttcttattaataatttttggaacactagggaaaaggttcaagcagtacagagagttaaaaccccagacctgcaccatatgtgagacaacacctgtaaatgcaatagatgctgaaatgcatgatctcaactgcagttacaatatatgtccctattgtgcgtctagactgacttcagatgggcttgctaggcatgtgacacaatgtcctagacggaaggagaaagtggaggaaaccgaattatacctgaatttagagagaattccctgggttgtaagaaagctattgcaggtgtcagagtccactggtacagtgttaaaaaggagcagctggctaattgtattacttgtgctgttcacagtttcattgtcaccagttcaatcagcacccattggtcacgggaaaacaattgaaacataccgggttagggaagaatacacaagtatttgcctctttgtactaggaagtatcctgtttatagtctcttttctaatgaaaggactggttgacggtgttggcaacatcttctttcctgggctgtccgtctgtaagacatgctctataggtagcattaatggctttgaaattgagtctcataagtgctactgtagcttgttttgttgcccttactgtaggcactgctctgctgatggagaaatccatcagctgcacttgagcatctgcaaaaaaaggaaaacaggaagtaatgttatgctggctgtttgcaaacgcatgtgtttcagggcaactatggaagtaagcaacaaggccctatttatccgtagcattatcaacaccacttttgttgtgtgcatactgatactagcggtttgtgttgttagcacctcagcagtagagatggaaagcctaccagctgggacctgggaaagagaagaagacctaacaaatttctgccatcaggaatgccaggtcacagagactgagtgcctctgcccttatgaagctttagtgctcagaaggcccctatttctagatagtatagtcaaaggtatgaaaaatctgctaaactcaacaagtctagaaacaagcttatcaattgaggcaccatggggagcaattaatgttcagtcaacctacaaaccaactgtatcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagtcatggacttgtctcagatgtactctcctgtcttcgagtacttatcaggtgacagacaagtggaagagtggcctaaagcaacctgcacaggtgactgcccagaaagatgtggctgcacatcatcaacctgcttacacaaagagtggccccactcaaggaattggagatgtaatcctacttggtgctggggtgtagggactggctgcacctgttgtggtttagatgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagaaccaaggaacattcaacaaaagctccctcctgaaataatcacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacctgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacagctagatctgaaggcaaggccaacctatggtgcaggtgaggtcaccgtgctggtggaagttgctgacatggagttacacacaaagaagattgaaatatcaggcttaaaatttgcaggcctaacttgcacaggttgttatgcttgtagttctggcatctcttgtaaagttagaattcatgtagatgaaccagatgaacttacagtacatgttaaaagtgatgacccagatgtagttgcagctagctcaagtctcatggcgaggaagcttgagtttggaacagacagtacatttaaagctttctcagccatgcctaaaacctccctatgtttctacattgtggaaagagaatactgtaagagctgcagtaaagaagatacacaaaaatgtgttaacacgaaactcgaacaaccacagagcattttgatcgaacataagggaactataattggaaagcaaaacaatacttgcacggctaaagcgagttgctggttagagtcagttaagagttttttttatggtctgaagaatatgctcggtggcatatttggcaatgtttttataggcattttcacatttcttaccccctttatcttgttaatactcttctttatgtttgggtggaggatcctgttttgcttcaagtgttgcagaagaaccagaggcctattcaagtacagacacctcaaagacgatgaagaaactggttacagaaagatcattgaaagactgaacaacaaaaagggaaaaaacaggctgcttgatggtgaaagacttgctgacagaaagattgctgaactgttctccacaaaaacacacattggctag

SEQ ID NO: 3616 - RNA, 5055 nt, synthetic construct
  misc_feature 1..5055: note = derived and/or modified CDS sequence (wt) from CCHFV(Iran-52)__DQ446215.1__GP
  source 1..5055: mol_type = other RNA
atgcatatatcattgatgtatgcagttttctgcttgcagctgtgcggtctagggaagactaacggaccacacaatgggactgaacacaataatacacacgttatgacaacgcctgatgacagtcagagccctgaaccgccagtgagcacagccttacctgtcacaccggacccttcaactgtcacaccttcaacaccagccagcggattagaaggctcaggagaggtttacacatcctctccaatcaccaccaagggtttgtctctgccggaggccacatctgagccccctgcgactaccagcgtggtcacttcaagtgcaagtgataccgattctagcacacaggcagccggagacacccccacaccaacagtccgcacgagtctgcccagcagccctagcacaccatccacatcacaaggcacacactatcccgtgaggagtctgctttcagtcacgagccctaagccagaagaaacaccaacaccgtcaaaatcaggcaaagatgacttagcaaccaacagcccccacccagccaccagcagaccaacaacccctcccacaacagcccagaaacccactgaaaacaacagccacaacaccaccgaacagcttgagtccttaacacacttagcaactttaggtttaatgatctctccaacacagacagtcctcccacagagtgttacctctatagccattcaagacattcataacagcccaacaaataggtctaaaagaaaccttgatatggaaataatcttaacgttatctcagggtctgaaaaagtattatggcaaaatacttaagctcctgcatctcaccttagaagaagacactgaaggcttgttagagtggtgcaagagaaatctcggtcttgactgtgatgacaccttcttccaaaaaagaatcgaagaattcttcataactggtgagggtcatttcaatgaagttttacaatttagaacactaggcacattgagtaccacagagtcaacgcatgctggatcaccgacagttgaacccttcaaatcctactttgctaaaggtttcctttcaatagattcaggttatttctctgccaaatgttattcaagaacatccaattcagggctccaattgattaatgttacccgacattcaactaggatagctgacacgcctgggcccaagatcactaacctgaagaccatcaattgcatgaacttaaaagcatccgtctttaaagaacatagagaggttgaaatcaatgtgcttctccctcaagtagcagtcaacctctcaaactgtcatgttgcaatcaaatcacatatctgtgactattctttagacaccgacggggcaattaggcttcctcaaattcatcatgaaggcacttttatcccaggtacttacaaaatagtgatagacaaaaaaagtaagctgaatgacaggtgtaccctattcaccaactgtgtgataaagggaagagaagttcgtaaaggccagtcagtcctaaggcaatataagacagaaattagaattggcagggcatcaactggttctaggagattgctttccgaagaatctggtgatgactgcatatcaagaactcagctattgaggacagagactgcagaggtccatggcgataactatggtggtccaggtgataagataaccatctgtaatggttcaactgttgtagatcaaagactgggtagtgaactggggtgttacactatcaatagagtgaggtcattcaagctatgcgaaaacagtgccacagggaagagctgtgaaatagacagtatcccagtcaagtgtaagcagggttattgcctaaaaatcactcaggaaggaaggggccatgtgaagttatctagaggctcagaagttgtcttggatgtatgtgattcaagctgtgaagtgatgatacctaagggcactggtgacattctagtagattgttcaggtgggcagcaacattttttaaaagacaacctggttgacctagggtgtcccaaaattccgttactgggcaaaatggctatttatatctgcaggatgtcgaatcaccccaagacaaccatggccttcctcttttggttcagctttggctatgtgataacttgtatactttgcaaggccatttttttcttattaataatttttggaacactagggaaaaggttcaagcagtacagagagttgaaaccccagacctgcaccatatgtgagacaacacctgtaaatgcaatagatgctgaaatgcatgatctcaactgcagttacaatatatgtccctattgtgcgtctagactgacttcagatgggcttgctaggcatgtgacacaatgtcctagacggaaggagaaagtggaggaaaccgaattatacctgaatttagagagaattccctgggttgtaagaaagctattgcaggtgtcagagtccactggtacagtattaaaaaggagcagctggctaattgtattacttgtgctgttcacagtttcattgtcaccagttcaatcagcacccattggtcacgggaaaacaattgaaacataccgggttagggaagaatacacaagtatttgcctctttgtactaggaagtatcctgtttatagtctcttttctaatgaaaggactggttgacggtgttggcaacatcttctttcctgggctgtccgtctgtaagacatgctctataggtagcattaatggctttgaaattgagtctcataagtgctactgtagcttgttttgttgcccttactgtaggcactgctctgctgatggagaaatccatcagctgcacttgagcatctgcaaaaaaaggaaaacaggaagtaatgttatgctggctgtttgcaaacgcatgtgtttcagggcaactatggaagtaagcaacaaggccctatttatccgtagcattatcaacaccacttttgttgtgtgcatactgatactagcggtttgtgttgttagcacctcagcagtagagatggaaagcctaccagctgggacctgggaaagagaagaagacctaacaaatttctgccatcaggaatgccaggtcacagagactgagtgcctctgcccttatgaagctctagtgctcagaaggcccctatttctagatagtatagtcaaaggtatgaaaaatctgctaaactcaacaagtctagaaacaagcttatcaattgaggcaccatggggagcaattaatgttcagtcaacctacaaaccaactgtatcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagtcatggacttgtctcagatgtactctcctgtcttcgagtacttatcaggtgacagacaagtggaagagtggcctaaagcaacctgcacaggtgactgcccagaaagatgtggctgcacatcatcaacctgcttacacaaagagtggccccactcaaggaattggagatgtaatcctacttggtgctggggtgtagggactggctgcacctgttgtggtttagatgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagaaccaaggaacattcaacaaaagctccctcctgaaataatcacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacctgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacagctagatctgaaggcaaggccaacctatggtgcaggtgagatcaccgtgctggtggaagttgctgacatggagttacacacaaagaagattgaaatatcaggcttaaaatttgcaggcctaacttgcacaggttgttatgcttgtagttctggcatctcttgtaaagttagaattcatgtagaggaaccagatgaacttacagtacatgttaaaagtgatgacccagatgtagttgcagctagctcaagtctcatggcgaggaagcttgagtttggaacagacagtacatttaaagctttctcagccatgcctaaaacctccctatgtttctacattgtggaaagagaatactgtaagagctgcagtaaagaagatacacaaaaatgtgttaacacgaaactcgaacaaccacagagcattttgatcgaacataagggaactataattggaaagcaaaacaatacttgcacggctaaagcgagttgctggttagagtcagttaagagttttttttatggtctgaagaatatgctcggtggcatatttggcaatgtttttataggcattttcacatttcttaccccctttatcttgttaatacttttctttatgtttgggtggaggatcctgttttgcttcaagtgttgcagaagaaccagaggcctattcaagtacagacacctcaaagacgatgaagaaactggttacagaaagatcattgaaagactgaacaacaaaaagggaaaaaacaggctgcttgatggtgaaagacttgctgacagaaagattgctgaactgttctccacaaaaacacacattggctag

SEQ ID NO: 3617 - RNA, 5055 nt, synthetic construct
  misc_feature 1..5055: note = derived and/or modified CDS sequence (wt) from CCHFV(75024)__AB069671.1__GP
  source 1..5055: mol_type = other RNA
atgcatatatcattgatgtgtgcagttctttgcttgcagctgtatggtctgggggaaactcatggatcaagcaatgaaactgaacacaacaaaacaaacgttgtgacaacgcccggtgacagccagagccctgaaccgctagtgagcacgaccctgcctgtcacgctggactcctccactgtcacacccacaacaccggctagtggaccagaaggctcgggggaagtttacacatcccccccaatcaccactgagggcctgtctccgtcagaagccacgtcagagctccccgcgacaactggcataggcatctcaagtgcaagtgatgtcgattccagcacacaggcagccggagacacctccacaccaacagtacgcacaagtccacctaacagctctagcacaccacccacatcacaagatacacaccatcctatgaggaatttactttcagtcacgagccttaagccagaagaaacatcagcaccgtcaaaatcaggcaaagagagtccagcagccagcagccctcacccagtcgccagcagaccaccaacccctcccacaacagctcagggacccattgaaaacaacagccataacaccactggacagcttgagtctgtgacacaatcggcaaccctaggcccaatggcctctccaacacagacagtcctctcacaaaatgtcacctccatagccattcaagacacacaccccagcccaacaaataggtctaaaagaaaccttgaaatggagataatcttaactttacctcaaggtttaaagaaatactatggcaaggtgctcaggcttttgcaactcaccttagaggaggacactgaaggcctactagaatggtgtaagagaaatcttggtcttgactgtgatgataccttctttcaaaagagaattgaagagttcttcataactggtgagggtcatttcaatgaagttttacaatttagaacaccaggcacattgagcaccacagagtcaacacatgctgagtcaccaacagctgaaccctttaagtcctatttcgctaaaggcttcctttcaatagattcaggttacttctcagccaaatgttactcaagaacatctaattcagggcttcagttgatcaatgtcactcgacattcaactagaatagctgatacacctgggcccaagattaccaacctaaagaccatcagctgcataaacttaaaggcatcagtcttcaaagaacatagagaggttgaaatcaatgtgcttctccctcaagttgcagttaacctctcaaactgtcacgttacaatcaaatcacatgtctgtgactattctttagacattgacgggacagtgaggcttcctcacattcatcatgaaggaacctttattccaggaacttacaagatagtgatagacaaaaaaaataagctgaatgacagatgcaccctattcactaactgtgtaataaaagggagggaagttcgtaaaggccaatctgttttgaggcaatataagacagagattaggattggcaaggcatcaactggttctagaagattgctttctgaagaatctggtgatgactgcatatcaagaactcagctattgaggacagagactgcagagatccatggtgataactatggcggtccgggtgacaagattactatttgcaatggttcgacaattgtagatcaaagactgggtagtgagatggggtgttacactatcaatagggtgaagtcattcaagctgtgcgaaaacagtgcaacagggaagagctgtgaaatagacagtatcccagttaagtgcaggcagggttattgcctaaaaatcactcaggaaggaaggggccatgtgaaattatccaggggctcagaggttgtcttggatgcatgcgactcaagctgtgaagtaatgatacctaagggcacaggtgacatcctggtagactgttcaggtgggcagcaacattttttgaaggacaacttaattgatctaggatgtcccagtattccattactgggtaaaatggctatttatatttgcagaatgtcgaatcaccctaagacaaccatggctttcctcttttggttcagttttggctatgtgataacttgtatactctgcaaggctattttctacttattaataattgttggaacgctagggaagaggtttaagcagtacagagagttaaaaccccagacctgtaccatatgtgagacaactcctgcaaatgcaatagatgctgaaatgcatgaccttaactgcagttacaacatatgtccctattgtgcatctagactaacctcagacgggcttgctaggcatgtgacacaatgccctaagcggaaggagaaagtagaagaaactgaattgtacttgaacttagagagaattccctgggttgtaagaaagctgttgcaggtatcggagtccaccggtgttgcattaaaaagaagcagctggctgattgtgctgcttgtgctgttcgcaatttcattatcaccagttcaatcagcacccatcggtcatgggaagacaattgaaacataccaggccagggaggaatacacaagcatctgcctctttgtactaggaagtatcctgtttatagtctcttgtctaatgaaagggctggttgacagtattggcaacatcttcttccctgggctgtccatttgcaaaacgtgctctataggtagtatcaatggctttgaaattgagtctcataagtgctattgtagcttgctttgttgcccctattgtaggcattgttctgctgatagagaaattcatcagctgcacttgagcatctgcaaaaaaagaaaaacaggaagtaatgttatgcttgcagtctgcaagcgcatgtgcttcagagcaactatggaagtgagcaataaggccctacttatccgtagtatcatcaacaccacttttgttgtgtgcatattaatactagcagtctgtgttgttagcacctcagcagttgagatggaaagcctaccagctgggacctgggaaagagaagaagacctaacaaatttctgtcatcaggaatgccaggttacggagactgagtgcctctgcccttatgaagccctagtactcagaaggcccttgttcctggacagtatagttagaggcatgaaaaatcagctaaactcaacaagtttagaaacaagcttatcgattgaggcaccatggggagcaataaatgttcagtcaacctacaaaccaactgtgtcaactgcaaacatagcacttagttggagctcagttgaacacagaggtaataagattttggtttcaggcagatcagaatcaattatgaagctggaagaaaggacaggaatcagctgggaccttggcgtagaagatgcctctgaatctaagctacttacagtctctgtcatggacttgtctcagatgtactctcctgtcttcgagtacttatcaggtgacagacaagtagaagagtggcccaaggcaacctgtacaggagactgcccagaaagatgtggctgcacaacatcaacctgcttgcataaagaatggccccattcaagaaactggagatgtaatcccacttggtgctggggggtggggactggctgcacttgttgtggattagatgtgaaagacctttttacagattatatgattgtcaagtggaaagttgaatacattaaaacagaggccatagtgtgtgtggaactcaccagtcaggaaaggcagtgtagcttgattgaggcaggcacaaggttcaatttaggttctgtgaccatcacattgtcagaaccgaggaacattcaacaaaagctccctcctgaaataatcacattgcatcctaggattgaagaaggtttttttgacctgatgcatgtacaaaaagtgttgtcagctagcacagtgtgtaagttgcagagttgcacacacggtgtgccaggtgatctacaggtctaccatgtcggaaatttattaaaaggagataaggtgaatggacacctaattcataaaattgagccacacttaaacacttcctggatgtcctgggatggctgtgatctagactactattgcaacatgggagactggccttcttgtacatataccggagttacccaacacaatcatgcttcatttgtaaacctgctcaacattgaaactgactatacaaaaagcttccactttcactctaaaagggttactgcacacggagacacaccacaattagatctgaaggcaagaccaacctacggcgcaggagaaatcactgtactggtagaagttgctgacatggagttcacaccgaagaagattgaaatatcaggcctaaaatttgcaagcctgacttgcacaggctgttatgcttgtagttctggcatttcctgcaaagttaggattcatgtggatgaaccagatgaacttacagtacatgttaagagtgatgatccagatgtagtagcagctagctcaagtctcatggcaaggaagcttgagtttggaacagacagtacatttaaagctttctcagctatgcccaaaacttccttatgtttctacattgtcgaaagggagtactgtaagagctgcagtaaagaagacacacaaaaatgtgttaacacaaaacttgagcaaccacagagcattttgatcgaacataagggaactataattggaaagcaaaacaatacctgcacagccaaagcaagttgctggttagagtcggttaaaagtttcttttatggtctaaagaacatgcttagtggcatttttggcaatctttttatgggcatcttcttatttcttgcccccttcatcttgttaatacttttctttatgtttggatggaggatcctgttttgctttaagtgttgcagaagaaccaggggcctgttcaagtatagacatctcaaagacgatgaagaaactggttacaggaggatcattgaaagactgaacaacaagaaggggaagaacaagctgcttgatggtgaaagacttgccgatagaagaattgccgaactattctccacaaaaacacacattggctag

SEQ ID NO: 3618 - RNA, 5055 nt, synthetic construct
  misc_feature 1..5055: note = derived and/or modified CDS sequence (wt) from CCHFV(7803)__AB069672.1__GP
  source 1..5055: mol_type = other RNA
atgcatatatcattgatgtgtgcagttctttgcttgcagctatatggtctgggggaaactcatggatcaagcaatgaaactgaacacaacaaaacaaacgttgtgacaacgcccggtgacagccagagccctgaaccgctagtgagcacgaccctgcctgtcacgctggactcctccactgtcacacccacaacaccggccagtgaaccagaaggctcgggggaagtttacacatcccccccaatcaccactgagggcctgtctccgtcagaagccacgtcagagctccccgtgacaactggcataggcatctcaagtgcaagtgatgtcgattccagcacacaggcagccggagacacctccacaccaacagtacgcacaagtccacctaacagccctagcacaccacccacatcacaagatacacaccatcctatgagaaatttactttcagtcacgagccttaagtcagaagaaacatcagcaccgtcaaaatcaggcaaagagagtccagcagccagcagccctcacccagtcgccagcagaccaccaacccatcccataacagctcagggacccactgaaaacaacagccataacaccactggacagcttgagtctgtgacacaatcggcaaccctaggcccaatggcctctccaacacagacagtcctctcacaaaatgtcacctccatagccattcaagacacacaccccagcccaacaaataggtctaaaagaaaccttgaaatggagataatcttaactttacctcaaggtttaaagaaatactatggcaaggtgctcaggcttttgcaactcaccttagaggaggacactgaaggcctactagaatggtgtaagagaaatcttggtcttgactgtgatgataccttctttcaaaagagaattgaagagttcttcataactggtgagggtcatttcaatgaagttttacaatttagaacgccaggcacattgagcaccacagagtcaacacatgctgagtcaccaacagctgaaccctttaagtcctatttcgctaaaggcttcctttcaatagattcaggttacttctcagccaaatgttactcaagaacatctgattcagggcttcagttgatcaatgtcactcgacattcaactagaatagctgatacacctgggcccaagattaccaacctaaagaccataagctgcataaacttaaaggcatcagtcttcaaagaacatagagaggttgaaatcaatgtgcttctccctcaagttgcagttaacctctcaaactgtcacgttacaatcaaatcacatgtctgtgactattctttagacattgacgggacagtgaggctacctcacattcatcatgaaggaacctttattccaggaacttacaagatagtgatagacaaaaaaaataagctgaatgacagatgcaccctattcactaactgtgtaataaaagggagggaagttcgtaaaggccaatctgttttgaggcaatataagacagagattaggattggcaaggcatcaactggttctagaagattgctttctgaagaatctggtgatgactgcatatcaagaactcagctattgaggacagagactgcagagatccatggtgataactatggtggtccgggtgacaagattactatttgcaatggttcgacaattgtagatcaaagactgggtagtgagatggggtgttacactatcaatagggtgaagtcattcaagctgtgcgaaaacagtgcaacagggaagagctgtgaaatagacagtatcccagttaagtgcaggcagggttattgcctaaaaatcactcaggaaggaaggggccatgtgaaattatccaggggctcagaggttatcttggatgcatgcgactcaagctgtgaagtaatgatacctaagggcacaggtgacatcctggtagactgttcaggtgggcagcaacattttttgaaggacaacttaattgatctaggatgtcccagtattccattattgggtaaaatggctatttatatttgcagaatgtcgaatcaccctaagacaaccatggctttcctcttttggttcagttttggctatgtgataacttgtatactctgcaaggctattttctacttattaataattgttggaacgctagggaagaggtttaagcagtacagagagttaaaaccccagacctgtaccatatgtgagacaactcctgcaaatgcaatagatgctgaaatgcatgaccttaactgcagttacaacatatgtccctattgtgcatctagactaacctcagacgggcttgctaggcatgtgacacaatgccctaagcggaaggagaaagtagaagaaactgaattgtacttgaacttagagagaattccctgggttgtaagaaagctgttgcaggtatcggagtccaccggtgttgcattaaaaagaagcagctggctgattgtgctgcttgtgctgttcgcaatttcattatcaccagttcaatcagcacccatcagtcatgggaagacaattgaaacataccaggccagggaggaatacacaagcatctgcctctttgtactaggaagtatcctgtttatagtctcttgtctaatgaaagggctggttgacagtattggcaacatcttcttccctgggctgtccatttgcaaaacgtgctctataggtagtatcaatggctttgaaattgagtctcataagtgctattgtagcttgctttgttgcccctattgtaggcattgttctgctgatagagaaattcatcagctgcacttgagcatctgcaaaaaaagaaaaacaggaagtaatgttatgcttgcagcctgcaagcgcatgtgcttcagagcaactatggaggtgagcaataaggccctacttatccgtagtatcatcaacaccacttttgttgtgtacatattgatactagcagtctgtgttgttagcacctcagcagttgagatggaaagcctaccagctgggacctgggaaagagaagaagacctaacaaatttctgtcatcaggaatgccaggttacggagactgagtgcctctgcccttatgaagccctagtactcagaaggcccttgttcctggacagtatagttagaggcatgaaaaatccgctaaactcaacaagtttagaaacaagcttatcgattgaggcaccatggggagcaataaatgttcagtcaacctacaaaccaactgtgtcaactgcaaacatagcacttagttggagctcagttgaacacagaggtaataagattttggtttcaggcagatcagaatcaattatgaagctggaagaaaggacaggaatcagctgggaccttggcgtagaagatgcctctgaatctaagctacttacagtctctgtcatggacttgtctcagatgtactctcctgtcttcgagtacttatcaggtgacagacaagtagaagagtggcccaaggcaacctgtacaggagactgcccagaaagatgtggctgcacaacatcaacctgcttgcataaagaatggccccattcaagaaactggagatgtaatcccacttggtgctggggggtggggactggctgcacttgttgtggattagatgtgaaagacctttttacagattatatgattgtcaagtggaaagttgaatacattaaaaccagaggcatagtgtgtgtggaactcaccagtcaggaaaggcagtgtagcttgattgaggcgggcacaaggttcaatttaggttctgtgaccatcacattgtcagaaccgaggaacattcaacaaaagctccctcctgaaataatcacattgcatcctaggattgaagaaggtttttttgacctgatgcatgtacaaaaagtgttgtcagctagcacagtgtgtaagttgcagagttgcacacacggtgtgccaggtgatctacaggtctaccatgtcggaaatttattaaaaggagataaggtgaatggacacctaattcataaaattgagccacacttaaacacttcctggatgtcctgggatggctgtgacctagactactactgcaacatgggagactggccttcttgtacatataccggagttacccaacacaatcatgcttcgtttgtaaacctgctcaacattgaaactgactatacaaaaagcttccactttcactctaaaagggttactgcacacggagacacaccacaattagatctgaaggcaagaccaacctacggcgcaggagaaatcactgtactggtagaagttgctgacatggagttcacaccgaagaagattgaaatatcgggcctaaaatttgcaagcctgacttgcacaggctgttatgcttgtagttctggcatttcctgcaaagttaggattcatgtggatgaaccagatgaacttacagtacatgttaagagtgatgatccagatgtagtagcagctagctcaagtctcatggcaaggaagcttgagtttggaacagacagtacatttaaagctttctcagctatgcccaaaacttccttatgtttctacattgtcgaaagggagtactgtaagagctgcagtaaagaagacacacaaaaatgtgttaacacaaaacttgagcaaccacagagcattttgatcgaacataagggaactataattggaaagcaaaacaatacctgcacagccaaagcaagttgctggttagagtcggttaaaagtttcttttatggtctaaagaacatgcttagtggcatttttggcaatttttttatgggcatcttcttatttcttgcccccttcatcttgttaatacttttctttatgtttggatggaggatcctgttttgctttaagtgttgcagaagaaccaggggcctgttcaagtatagacatctcaaagacgatgaagaaactggttacaggaggatcattgaaagactgaacaataagaaggggaagaacaagctgcttgatggtgaaagacttgccgatagaagaattgccgaactattctccacaaaaacacacattggctag

SEQ ID NO: 3619 - RNA, 5055 nt, synthetic construct
  misc_feature 1..5055: note = derived and/or modified CDS sequence (wt) from CCHFV(Hodzha)__AY223476.1__GP
  source 1..5055: mol_type = other RNA
atgcatatattattgatgtgtgcagtactttgcctgcagcagtatggtctgggggagactcatagaccaaacaacggaaccgaacacaacaaaacaaacgttttgacaacgcccggcgacaaactgagccctgaactgccagtaagcacagccttgtctgttacgccagactcctccactgtcacacccacaacaccagtcagtggactggaaggctcgggggacgtgtacacatcccccccagtcaccaccaagggcctgtctccgtcgaaggccacgtcagagctccccgcgtcttcaggcatagacacctcaagtgcaagtgatgtcgattccagcacacaggcagccagagacacctcaacactaacagtccgcacaagtccacctagcagccctagcacaccacctacatcacaagatacataccatcttgtgaggaatctactttcagtcacgagcccctggccagaagaaacaacagcaccgtcaaaatcaggcaaagagagtccagtagccaacagccctcacccagtcaccagcagaccatcatcccctcccataacagtccaaggacccactgaaaacagcagccacaacaccaccggacagcttgagtccatggcacaatcaacaaccctagtcccaatggcctctccaacacagacagtcctctcacagagtgtcacctccttagccgttcaagacgcacaccccagcccaacaaacaggtctaaaagaaaccttgaaatggtgataatcttaactttacctcagggtttaaaaaaatactatggtaaggtgctcaggcttttgcaactcaccttagaggaggacactgaaggcctgctagaatggtgtaagagaaatcttggtcttgattgtgatgatactttctttcaaaagagaattgaagaattcttcataacaggtgagggtcatttcaatgaagttttacaatttaaaacaccaagcacattgagcaccacagagtcaacacatgctgtgtcaccaacagctgaaccctttaaatcctatttcgccaaaggcttcctttcaatagattcaggttacttctcagccaaatgttattcaaaaacatctaattcagggcttcagttgatcaatgtcactcgacattcaactagaatagctgacacacctgggcccaagatcaccaacctaaaaaccatcagctgcataaatttgaaggcatcagtcttcaaagaacatagagaggttgaaatcaatgtgcttctccctcaagttgcagtcaacctctcaaactgtcacgttactatcaaatcacatgtctgtgactattctttagacgttgatgggacagtgaggcttcctcacatccatcatggaggaaccttcattccaggaacttacaagatagtgatagacaaaaaaaacaagctgaatgacagatgtaccctatacaccaactgtgtgataaaagggagagaagttcgtaaaggccaatcaattttgaggcagtataagacagagattaggattggcaaggcatcaactggttctagaagactgctttctgaagaatctggtgacgactgcatatcaagaactcagctactgaggacagagactgcagagatccatggtgatgattatggtggtccgggcgacaagattaccatttgcaatggttcaactattgtagatcaaagactaggtagtgaactggggtgttacactatcaatagagtgaagtcattcaagctgtgcaaaaacagtgcaacagggaagagctgtgaaatagacagcaccccagttaaatgcaggcagggttattgcctaaaaatcactcaggaaggaaggggccatgtgaaattatccaggggctcggaggttgtcttggatgcatgcgattcaagctgtgaagtaatgatacctaagggcacaggtgacatcctagtagactgttcaggtgggcagcaacattttttgaaagacaacttaattgatctaggatgtcccagaattccattattaggtaaaatggctatttatatttgcagaatgtcgaatcaccctaagacaaccatggctttcctcttttggttcagttttggctatgtgataacctgtatactctgcaaggccattttctacttattaataattgttggaacactagggaagaggttcaagcagtatagagagttaaaaccccagacctgtaccatatgtgagacaactcctgcaaatgcaatagatgctgaaatgcatgaccttaactgcagttacaacatatgtccctattgtgcatctagactaacctcagatgggcttgctaggcatgtgacacaatgccctaagcggaaggagaaggtagaagaaactgaattgtacttgaacttagagagaattccctggattgtaagaaagctgttgcaggtgtcggagtccactggtgttgcattaaaaagaagcagctggctgattgtgctgcttgtgctgttcgcagtttcattatcacctgttcaatcagcacccattggtcatgggaagacaattgaaacataccaggccagggaagattacacaagtatttgcctctttgtactgggaagcatcttgtttatagtctcttgtctgatgaaagggctggttgacagtattggcaacatcttcttccctgggctgaccatctgcaagacatgctctataggtagtatcaatggctttgaaattgagtctcacaagtgctattgtagcttactttgttgcccctactgtaggcactgctctgctgatagagaaattcatcagctgcacttgagcatctgcaaaaaaaggaaaacaggaagtaatgtcatgctcgcagtctgcaagcgcatgtgcttcagagcaactatggaagtgagcaataaggccctacttatccgtagcatcatcaacaccacttttgttgtgtgcatattgatattagcagtctgtgttgttagcacctcagcggtagagatggaaagcctaccagctgggacctgggaaagagaagaagacctaacaaatttctgtcatcaggaatgccaggttacagagactgagtgcctctgcccttatgaagcccttgtgctcagaaggcccctgttcctggatagtatagttaaaggcacgaaaaatctgttaaactccacaagtttagaaacaagcttgtcgattgaggcaccatggggggcaataaatgttcagtcaacctacaaaccaactgtatcaactgcaaacatagcacttagttggagttcagttgaacacagaggtaataagattttggtttcaggcagatcagaatcaattatgaagctggaagaaagaacaggaatcagctgggatcttggcgttgaagatgcctctgaatctaagctacttactgtctctgtcatggacttgtctcagatgtactcccctgtcttcgagtacttatcgggtgacagacaagtagaagagtggcccaaagcaacctgcacaggtgactgcccagaaagatgtggctgcacatcatcaacctgcttacataaagaatggccccattcacgaaactggagatgcaatcccacttggtgctggggggtggggactggctgcacctgttgtggattagatgtgaaagacctatttacagattatatgttcgtcaagtggaaagttgattacattaaaacagaggccatagtgtgtgtagaactcaccagtcaggaaaggcagtgtagcttggttgaggcgggcacaaggttcaatttaggtcctgtaaccatcacattgtcagaaccgaggaacatacaacaaaagctccctcctgaaataatcacattgcatcctaggattgaagaaggtttttttgacctgatgcatgtacaaaaagtgctgtcagcaagcacagtgtgtaaattgcagagttgcacacatggtgtgccaggagatctacaggtctaccacatcggaaatttattaaaaggggataaagtgaacggacacctaattcataaaattgagccgcacttcaatacttcctggatgtcctgggatggctgtgacctagactactactgcaacatgggagactggccttcttgcacatataccggagttacccaacacaatcatgcttcatttgtaaacctgctcaacattgaaactgactatacaaaaagcttccactttcactctaaaagggttactgcacatggagacacaccacaattggatctgaaggcaagaccaacctacggcgcaggagaaatcactgtactggtagaagttgctgatatggagttacacacaaagaagatcgaaataacaggccttaaatttgcaagcctgacttgcacaggttgttatgcttgtagttcaggcatctcctgcaaagttaggattcacgtggatgaaccagatgagctaacagtacatgttaaaagtgatgacccagatgtagttgcagccagctcaagtctcatggcaaggaaacttgagtttggaacagacagtacattcaaagctttctcagccatgcctaaaacttccttatgcttctacattgtcgaaagggagtactgtaagagctgcagtaaagaagacacacagaaatgtgttaacacaaaacttgagcaaccacagagcattttgatcgaacgcaagggaactataatcggaaagcaaaacaatacttgcacagccaaggcaagttgctggttagagtcagttaaaagtttcttttatggtctaaagaacatgcttagtggcatttttggcaatgtttttgtaggcattttcttatttcttgccccctttatcttgttaatacttttcttcatgtttggatggaggatcctgttttgcttcaagtgttgcagaagaaccaggggcctgtttaagtataaacatctcaaagacgatgaagaaactggttacagaaggatcattgaaagactgaacaacaagaaggggaaaaacaagctgcttgacggtgaaagacttgccgatagaaggattgccgaactattctccacaaaaacacacattggctag

SEQ ID NO: 3620 - RNA, 5055 nt, synthetic construct
  misc_feature 1..5055: note = derived and/or modified CDS sequence (wt) from CCHFV(Hodzha)__KX013448.1__GP
  source 1..5055: mol_type = other RNA
atgcatatattattgatgtgtgcagtactttgcctgcagcagtatggtctgggggagactcatagaccaaacaacggaaccgaacacaacaaaacaaacgttttgacaacgcccagcgacaaactgagccctgaaccgccagtaagcacagccttgtctgttacgccagactcctccactgtcacacccacaacaccagtcagtggactggaaggctcgggggaagtgtacacatcccccccagtcaccaccaagggcctgtctccgtcgaaggccacgtcagagctccccgcgacaactggcatagacacctcaagtgcaagtgatgtcgattccagcacacaggcagccagagacacctcaacactaacagtccgcacaagtccacctagcagccctagcacaccacctacatcacaagatacataccatcttgtgaggaatctactttcagtcacgagccccaggccagaagaaacaacagcaccgtcaaaatcaggcaaagagagtccagtagccaacagccctcacccagtcaccagcagaccatcatcccctcccataacagtccaaggacccactgaaaacagcagccacaacaccaccggacagcttgagtccatggcacaatcaacaaccctagtcccaatggcctctccaacacagacagtcctctcacagagtgtcacctccttagccgttcaagatgcacaccccagcccaacaaacaggtctaaaagaaaccttgaaatggagataatcttaactttacctcagggtttaaaaaaatactatggtaaggtgctcaggcttttgcaactcaccttagaggaggacactgaaggcctgctagaatggtgtaagagaaatcttggtcttgattgtgatgatactttctttcaaaagagaattgaagaattcttcataactggtgagggtcatttcaatgaagttttacaatttaaaacaccaagcacattgagcaccacagagtcaacacatgctgtgtcaccaacagctgaaccctttaaatcctatttcgccaaaggcttcctttcaatagattcaggttacttctcagccaaatgttattcaaaaacatctaattcagggcttcagttgatcaatgtcactcgacattcaactagaatagctgacacacctgggcccaagattaccaacctaaaaaccatcagctgcataaatttgaaggcatcagtcttcaaagaacatagagaggttgaaatcaatgtgcttctccctcaagttgcagtcaacctctcaaactgtcacgttactatcaaatcacatgtctgtgactattctttagacgttgatgggacagtgaggcttcctcacatccatcatggaggaaccttcattccaggaacttacaagatagtgatagacaaaaaaaacaagctgaatgacagatgtaccctatacaccaactgtgtgataaaagggagagaagttcgtaaaggccaatcaattttgaggcagtataagacagagattaggattggcaaggcatcaactggttctagaagactgctttctgaagaatctggtgacgactgcatatcaagaactcagctactgaggacagagactgcagagatccatggtgatgattatggtggtccgggcgacaagattaccatttgcaatggttcaactattgtagatcaaagactaggtagtgaactggggtgttacactatcaatagagtgaagtcattcaagctgtgcgaaaacagtgcaacagggaagagctgtgaaatagacagcaccccagttaaatgcaggcagggttattgcctaaaaatcactcaggaaggaaggggccatgtgaaattatccaggggctcggaggttgtcttggatgcatgcgattcaagctgtgaagtaatgatacctaagggcacaggtgacatcctagtagactgttcaggtgggcagcaacattttttgaaagacaacttaattgatctaggatgtcccagaattccattattaggtaaaatggctatttatatttgcagaatgtcgaatcaccctgagacaaccatggctttcctcttttggttcagtttcggctatgtgataacctgtatactctgcaaggccattttctacttattaataattgttggaacactagggaagaggttcaagcagtatagagagttaaaaccccagacctgtaccatatgtgagacaactcctgcaaatgcaatagatgctgaaatgcatgaccttaactgcagttacaacatatgtccctattgtgcatctagactaacctcagatgggcttgctaggcatgtgacacaatgccctaagcggaaggagaaggtagaagaaactgaattgtacttgaacttagagagaattccctggattgtaagaaagctgttgcaggtgtcggagtccactggtgttgcattaaaaagaagcagctggctgattgtgctgcttgtgctgttcgcagtttcattatcacctgttcaatcagcacccattggtcatgggaagacaattgaaacataccaggccagggaagaatacacaagtatttgcctctttgtactgggaagcatcttgtttatagtctcttgtctgatgaaagggctggttgacagtattggcaacatcttcttccctgggctgaccatctgcaagacatgctctataggtagtatcaatggctttgaaattgagtctcacaagtgctattgtagcttactttgttgcccctactgtaggcactgccctgctgatagagaaattcatcagctgcacttgagcatctgcaaaaaaaggaaaacaggaagtaatgtcatgctcgcagtctgcaagcgcatgtgcttcagagcaactatggaagtgagcaataaggccctacttatccgtagcatcatcaacaccacttttgttgtgtgcatattgatattagcagtctgtgttgttagcacctcagcggtagagatggaaagcctaccagctgggacctgggaaagagaagaagacctaacaaatttctgtcatcaggaatgccaggttacagagactgagtgcctctgcccttatgaagcccttgtgctcagaaggcccctgttcctggatagtatagttaaaggcaagaaaaatctgttaaactccacaagtttagaaacaagcttgtcgattgaggcaccatggggggcaataaatgttcagtcaacctacaaaccaactgtatcaactgcaaacatagcacttagttggagttcagttgaacacagaggtaataagattttggtttcaggcagatcagaatcaattatgaagctggaagaaagaacaggaatcagctgggatcttggcgttgaagatgcctctgaatctaagctacttactgtctctgtcatggacttgtctcagatgtactcccctgtcttcgagtacttatcgggtgacagacaagtagaagagtggcccaaggcaacctgcacaggtgactgctcagaaagatgtggctgcacatcatcaacctgcttacataaagaatggccccattcacgaaactggagatgcaatcccacttggtgctggggggtggggactggctgcacctgttgtggattagatgtgaaagacctatttacagattatatgttcgtcaagtggaaagttgattacattaaaacagaggccatagtgtgtgtagaactcaccagtcaggaaaggcagtgtagcttggttgaggcgggcacaaggttcaatttaggtcctgtaaccatcacattgtcagaaccgaggaacatacaacaaaagctccctcctgaaataatcacattgcatcctaggattgaagaaggtttttttgacctgatgcatgtacaaaaagtgctgtcagcaagcacagtgtgtaaattgcagagttgcacacatggtgtgccaggagatctacaggtctaccacatcggaaatttattaaaaggagataaagtgaacggacacctaattcataaaattgagccgcacttcaatacttcctggatgtcctgggatggctgtgacctagactactactgcaacatgggagactggccttcttgcacatataccggagttactcaacacaatcatgcttcatttgtaaacctgctcaacattgaaactgactatacaaaaagcttccactttcactctaaaagggttactgcacatggagacacaccacaattggatctgaaggcaagaccaacctacggcgcaggagaaatcactgtactggtagaagttgctgatatggagttacacacaaagaagatcgaaataacaggcctcaaatttgcaagcctgacttgcacaggttgttatgcttgtagttcaggcatctcctgcaaagttaggattcacgtggatgaaccagatgagctaacagtacatgttaaaagtgatgatccagatgtagttgcagccagctcaagtctcatggcaaggaaacttgagtttggaacagacagtacattcaaagctttctcagccatgcctaaaacttccttatgcttctacattgtcgaaagggagtactgtaagagctgcagtaaagaagacacacagaaatgtgttaacacaaaacttgagcaaccacagagcattttgatcgaacaaaagggaactataatcggaaagcaaaacaatacttgcacagccaaggcaagttgctggttagagtcagttaaaagtttcttttatggtctaaagaacatgcttagtggcatttttggcaatgtttttgtaggcattttcttatttcttgccccctttatcttgttaatacttttcttcatgtttggatggaggatcctgttttgcttcaagtgttgcagaagaaccaggggcctgtttaagtataaacatctcaaagacgatgaagaaactggttacagaaggatcattgaaagactgaacaacaagaaggggaaaaacaagctgcttgacggtgaaagacttgccgatagaaggattgccgaactattctccacaaaaacacacattggctag

SEQ ID NO: 3621 - RNA, 5055 nt, synthetic construct
  misc_feature 1..5055: note = derived and/or modified CDS sequence (wt) from CCHFV(Baghdad 12)__AJ538197.2__GP
  source 1..5055: mol_type = other RNA
atgcatatatcattgatatatgcagttctttgcttacagctgtatggtctgggggaaactcatggatcaagcagtggaactgaacacaacaggacaaacgttgtggcaacgcccggaggtagccagagccctgaaccgctagtgagcacgaccttgcccgtcacgctagactcctccactgtcacacccgcaacgcaagctagcggaccagaaggctcgggggaagtttacacatcccccccaaccaccactgaaggcctgtctccgtcagatgccacgtcagagctccccacaacaactggcataggcatctcaagttcaagtgatgtcaattccagcacacaggcagccggggacacctccacaccaacagcacgcacaagtctacctgacagccctagcacaccacccacatcacaagatacacaccatcccatgagaaatttactttcagtcacgagccttaagccagaagaaacaccagcaccgtcaaaatcaggcaaagagagtccagcagccagcagccctcacccagtcgccagcagaccaccaaccccttctacaacagctcagggacccaccgaaaacaacagccgcaacaccactgtacagcttaaatccgtgacacaatcggcaaccctaggcccaatggcctctccaacacagacagtccttctacagagtgtcacctccatagccattcaagacacacaccccagcccaacgaataggtctagaagaaaccttgaaatggagataatcttaactttacctcagggtttaaagaaatactatggcaaggtgctcaggcttttgcaactcaccctagaggaggacactgaaggcctgctagaatggtgcaagaggaatcttggtcttgattgtgatgatactttctttcaaaagagaattgaagagttcttcataactggtgagggtcatttcaatgaagttttacaattcagaacaccaggcacattgagcaccacagagtcaacacatgctgggtcaccaacagttgaaccctttaaatcctattttgctaaaggcttccttttaatagactcaggttacttctcagccaaatgttactcaagaacatctaattcagggcttcagttgatcaatgtcactcggcattcaactaaaatagctgatacacctgggcccaagattaccaacctaaagaccatcagctgcataaacttaaaggcatcaatcttcaaagaacatagagagattgaaatcaatgtgcttcttccccaagttgcagtcaacctctcaaactgtcacgttacaatcaaatcacatgtctgtgactattctttaaacattgatggaacagtgaagcttcctcacattcatcatgaaggaatctttattccaggaacttacaagatagtgatagacaaaaaaaataagctgaatgacagatgcaccctgttcaccaactgtgtgataaaagggagagaagttcgtaaaggccaatctgttttgaggcagtataagacagagattaggattggtaaggcatcaactggctctagaagattgctttctgaagaatctggtgatgactgcatatcaagaactcggctattgagaacagagactgcagagatccatggtgacagctatggtggtccgggtgacaaaattactatttgcaacggttcaactattgtagatcaaagactgggaagtgagatggggtgttacactatcaatagagtgaagtcattcaagctgtgcgaaaacagtgcaacaggaaagagctgtaaaatagacagtatcccagttaagtgcagacagggttattgcctaaaaatcactcaggaaggaaggggccatgtgaaattatccaggggctcagaggttgtcttggatgcatgcgactcaagctgtgaagtaatgatacctaaaggcacaggtgacatcttagtagactgttcaggtgggcagcaacattttttgaaggataacttgattgatctaggatgccccaacattccattattaggtaaaatggctatttatatttgcagaatgtcaaatcaccctaagacaaccatggctttcctcttttggttcagttttggttatgtgataacctgtatactctgcaaggccatcttctacttattaataattgttgggacactagggaaaaggtttaagcagtacagagagttaaaaccccagacctgtactatatgtgagacaactcctgtaaatgcaatagatgctgaaatgcatgaccttaactgcagttacaatatatgtccctattgtgcatctagattaacctcagatgggcttgctaggcatgtgacacaatgccctaagcggaaggagaaagtggaagaaactgaattgtacttgaacttagagaggattccctgggttgtaagaaagctgttgcaggtatcagagtccacaggtgttgcattaaagagaagcagctggctgattgtgctgcttgtgctacttgcagtttcatcatcaccagttcaatcagcacccatcggttatgggaagacaattgagacataccaggccagggagggatacacaagtatttgcctctttgtactaggaagtatcctgtttatagtctcttgtctaacaaaagggctggttgacagtattggcaacatcttcttccctgggctgtccatttgcaaaacgtgctctataggtagtatcaatggctttgaagttgagtctcataagtgctattgtagcttgctttgttgtccctactgtaggcattgctctgctgatagagaaatccatcagctgcacttgagcatctgcaaaaaaagaaaaacaggaagtagtgtcatgcttgcagtctgcaagcgcatgtgcttcagagcaactatggaagtgagcaataaggccctacttatccgtagcattatcaacaccacttttgttgtctgcatattgacactagcagtctgtgttgttagcacctcagcagtagagatggaaagcctaccagctgggacctgggaaagagaagaagacctaacaaatttctgtcatcaagaatgccaggtcacggagactgagtgcctctgcccttatgaagccctagtactcagaaagcccttgttcctggatagtatagtcaaaggcacgaaaaatctgctaaactcaacaagtttagaaacaagcttatcgattgaggcaccatggggagcaataaatgttcagtcaacctataaaccaactgtgtcaactgcaaacatagcacttagttggagttcagttgaacacagaggtaacaagattttggtttcaggcagatcagaatcaattatgaagctagaagagagaacaggaatcagttgggatcttggcgtagaagatgcctctgaatctaagctacttacagtctctgtcatggacttgtctcagatgtactctcctgtctttgagtacttatcaggtgacagacaagtagaagaatggcccaaggcaacctgtacaggtgactgcccagaaagatgtggctgcacaacatcaacctgcttgcataaagaatggccccattcaagaaactggagatgtaatcccacttggtgctggggagtgggaactggctgcacttgttgcggattagatgtgaaggacctttttacagattatatgttcgtcaaatggaaagttgaatacattaaaacagatgccatagtgtgtgtggaactcactagtcaagaaaggcaatgcagcttgattgaggcaggtacaaggtttaacttaggttctgtgaccatcacattgtcagaaccgaggaacattcagcaaaagctccctcctgaaataatcacattacatcctaggattgaagaaggtttttttgacctgatgcatgtacaaaaagtgttgtcagctagcacagtgtgtaagttgcagagttgcacacacggtgtgccaggtgatctacaggtctaccacatcggaaatttattaaaaggggataaagtgaatggacacctaattcataaaattgagccacattttaacacttcttggatgtcctgggatggctgtgacttagactactattgcaatatgggagactggccttcttgcacatataccggagttacccaacacaatcatgcttcatttgtaaacctgctcaacattgaaactgattacacaaaaagcttccactttcactctaaaagggttactgcacatggagatacaccacagttagatctgaaggtaagaccaacctacggcgcaggagaaatcactgtactggtagaagttgctgacatggagttgcacacgaagaagattgaaatatcaggcctaaaatttgcaagcctgacttgcacaggctgttatgcttgtagctctggcatttcctgcaaagttaggatacatgtggatgaaccggatgaactcacagtacacgtcaaaagtgatgatccagatgtagtagcagctagctcaagtctcatggcaaggaagcttgagtttggaacagacagcacatttaaagctttctccgccatgccaaaaacttccttatgtttctacattgtcgaaagggagtactgtaaaagctgcagtaaagaagatacacaaaaatgtgttaacacaaaacttgagcaaccacagagcattttgattgaacataagggaactataatcggaaagcaaaacaatacctgcacagccaaaacaagttgctggttagagtcagttaaaagtttcttttatggtctaaagaatatgcttagtggcatttttggcaattttttcatgggcatcttcttatttcttgccccctttatcttgttaatacttttctttatgtttggatggaggatcctgttttgctttaagtgttgcagaagaaccaggggcctgtttaagtacagacatctcaaagatgatgaagaaactggttatagaaggatcattgaaagactgaacaacaagaaagggaagaacaagctgcttgatggtgaaagacttgccgatagaaggattgccgaactattctccacaaaaacacatattggctag

SEQ ID NO: 3622 - RNA, 5055 nt, synthetic construct
  misc_feature 1..5055: note = derived and/or modified CDS sequence (wt) from CCHFV(TADJ/HU8966 )__AY179962.1__GP
  source 1..5055: mol_type = other RNA
atgcatatgttattgatgtgtgcagtactttgcttgcagctatatggtctggggggaactcttagatcaaacaacggaaccgaacacaacaaaacaaatgttttgacaacgcccggcgacaaactgagccctgagccgccagtaagcacagccttgcctgttacgccagactcctccactgtcacacccacaacaccagccagtggactggaaggctcgggggaagtgtacacatcccccccaatcaccaccaagggcctgtctccgtcggaggctacgtcagagccccccgcgacaactggtatgggcatctcaagtgcaagtggtgtcgatttcagcacacaggcagccagagacacctcaacactaacagttctcacaagtccacctaacagccctaacacaccacctacatcacaagacacgcaccatcctgtgaggagtctactttcagtcacgagccccaggccagaagagacaacagcaccgtcaaaatcaggcaaagagagtccagcagccaacagctctcacccggtcactagcagaccatcatcccctctcataacagtccgggggcccactgaaaacagcagccacaacaccaccggtcagcttgagtccatgacacaatcaacaaccctagtcccaatggcctctccaacacagacagtcctttcacaaagcgtcacctccatagccgttcaagacgcacaccccagctcaacaaacaggtctaaaagaaaccttgaaatggagataatcttaactttacctcagggtttaaaaaagtactatggtaaggtgctcaggcttttgcaactcaccttagaggaggacactgagggcttgctagaatggtgtaagagaaatcttggtcttgattgtgatgatactttctttcaaaagagaattgaagaattcttcataactggtgagggtcatttcaatgaagttctacaatttagaacaccaggcacattgagcaccacagagtctacacatgctgggtcaccaacagctgaaccctttaaatcttatttcgctaaaggcttcctttcaatagattcaggttacttctcagccaaatgttattcaagaacatctaattcagggcttcggctgatcaatgtcactcgacattcaactagaatagctgacacacctgggcccaagatcaccaacctaaaaaccatcagctgcataaatttaagggcatcaatcttcaaagaacatagagaggttgaaatcaatgtgcttctccctcaagttgcagtcaacctctcaaactgtcacgttgctatcaagtcacatgtctgtgactattctttagacgttgatgggacagtgaggcttcctcatatccatcatgggggaaccttcattccaggaacttacaagatagtgatagacaaaaaaaataagctgaatgacagatgtaccctatttaccaactgtgtaataaaagggagagaagttcgtaaaggccaatcaattttgaggcagtataagacagagattaggattggcaaggcatcaactggttctagaagactgctttctgaagaatctggtgacgactgcatatcaagaactcagctactgaggacagagactgcagagatccatggtgatgattatggtggtccgggtgacaagattaccatttgcaatggttcgactattgtagatcaaagactgggtagtgaactggggtgttacactatcaatagagtgaagtcattcaagctgtgcgaaaacagtgcaacagggaagaactgcgaaatagacagcgtcccagttaaatgcaggcagggttattgcctaaaaattactcaggaaggaaggggccatgtgaaattatccaggggctcagaggttgttttggatgcatgcgattcaagctgtgaagtaatgatacctaagggcacaggtgacatctcagtagactgttcaggagggcagcaacattttttgaaagacaacttaattgatctgggatgtcccaagattccattattgggtaaaatggccatttatatttgcagaatgtcgaatcaccctaaaacaaccatggctttcctcttttggttcagttttggctatgtgataacccgtatactctgcaaggccattttctacttattaataattgttggaacactagggaagaggtttaagcaatatagagagttaaaaccccagacctgtaccatatgtgagacaactcctgcaaatgcaatagatgctgaaatgcatgaccttaactgcagttacaacatatgtccctattgtgcatctagactgacctcagatggactcgctaggcatgtgacacaatgccctaagcggaaggagagagtagaagaaactgaattgtacttgaacttagaaagaattccctggattgtaagaaagctgttgcaggtatcggagtccactggtgttgcattaaaaagaagcagctggctgattgtgctacttgtgctgttcacagtttcattatcaccagttcaatcagcacccattggttatgggaatacaattgaaacataccaggccagggaagaatacacaagcatttgcctctttgtactgggaagtatcttgtttatagtctcttgtctgatgaaagggctggttgacagtattggcaacatcttcttccctgggctgaccatctgcaagacatgctctataggtagtatcaatggctttgaaattgagtctcacaagtgctattgtagcttactttgttgcccctactgtaggcactgctctgctgatagagaaattcatcagctgcacttgagcatctgcaaaaaaagaaaaacaggaagtaatgtcatgcttgcagtctgcaagcgcatgtgcttcagagcaactatggaagtgagcaataaggccctacttatccgtagcatcatcaataccacttttgttgtgtgcatattaatattagcagtctgtattgttagcacctcagcagtagagatggaaagcctaccagctgggacctgggaaagagaagaagacctaacaaatttctgtcatcaggaatgccaggttacagagactgagtgcctctgcccttatgaagcccttgtgctcagaaggcccctgttcctggatagtatagtcaaaggcatgaaaaatccgctaaactccacaagtttagaaacaagcttgtcgattgaggcaccatggggggcaataaatgttcagtcaacttacaagccaactgtttcaactgcaaacatagcacttagttggagttcaattgaacacagaggtaataatattttggtttcaggcagatcagaatcaattatgaagctggaagaaagaacaggaattagtggggatcttggcgttgaagatgcctctgaatccaagctacttacagtctctgttatggacttgtctcagatgtactcccctgtcttcgagtacttatcaggtgacagacaagtagaagagtggcccaaggcaacctgtacaggtgactgcccagaaagatgtggctgcacatcatcaacctgcttacataaagaatggccccattcacgaaactggagatgcaatcccacttggtgctggggggtggggactggctgcacctgttgtggattagatgtgaaagacctatttatagattatatgttcgtcaagtggaaagttgattacattaaaacagaagccatagtgtgtgtagaactcaccagtcaggaaaggcagtgtagcttggttgaggcgggcacaaggttcaatttaggtcctgtgaccatcacattgtcagaaccgaggaacatacaacaaaagctccctcctgaaataatcacattgcatcctaggattgaagaaggtttttttgatctaatgcatgtgcaaaaagtgctgtcagcaagcacagtgtgtaaattgcagagttgcacacatggtgtgccaggagatctacaggtctaccacatcggaaacttattaaaaggagataaagagaacggacacctaattcataaaattgagccgcacttcaatacttcctggatgtcctgggatggctgtgacctagactactactgcaacatgggagactggccttcttgcacatataccggagttacccagcacaatcatgcttcatttgtaaacctgctcaacattgaaactgactatacaaaaagcttccactttcactctaaaagggttactgcacacggagacacaccacaattggatctgaaggcaagaccaacttacggcgcaggagaaatcactgtactggtagaagttgctgatatggagttacacacgaagaagattgaaataacaggcctcaaatttgcaagcctgacttgcacaggttgttatgcttgtagttcaggcatttcctgcaaagttaggattcatgtggacgagccagatgaacttacagtacatgttaaaagtgatgatccagatgtagttgcagctagctcaagtctcatggcaaggaagcttgagttcgggacagacagtacattcaaagctttctcagccatgcctaaaacttccttatgcttctacattgtcgaaagggagtaccgtaagagctgtagtaaagaggacacacagaaatgtgttaacacaaaacttgagcaaccacagagcattttgatcgaacacaagggaactataatcggaaagcaaaataatacttgcacagccaaagcaagttgctggttagagtcagtcaaaagtttcttttatggtctaaagaacatgcttagtggcatttttggcaatgtttttgtgggcattttcttgtttcttgccccttttatcttgttaatacttttctttatgtttggatggaggatcctgtcttgctttaagtgttgcagaagaaccaggggcctgcttaagcatagacatctcaaagacgatgaagaaactggttacagaaggatcattgaaagactgaacaacaagaaggggaaaaacaagctgcttgatggtgaaagacttgccgatagacggattgccgaactattctccacaaaaacacacattggctag

SEQ ID NO: 3623 - RNA, 5055 nt, synthetic construct
  misc_feature 1..5055: note = derived and/or modified CDS sequence (wt) from CCHFV(K168_40)__KX013457.1__GP
  source 1..5055: mol_type = other RNA
atgcacatatcactgatgtgtgcagttctttgcctgcagctgtatggtctggggggaacccatgggttacacaatggaactgaacacaataagacaaacgctgtgacaacgtccagtaacagccagagctcagaatcaccagcaagaacggccccacctgtcacgccggactcccccaccgtcacacccacaactccagccagcgcaccagaaggctcaggggaggcccactcatcccccccaaacaacacagagggcccgtctctgccggagtccacgtcagagccccccgcggcaaccagcacaggcatcccaagtgcaagtgatgtcaactccagcacacaggcagccagagacacctccacaccaacagtccgcaccagtccccccaacagccccagcacaccacccacaccacaagaaacacaccatcctgtgaggaatctactttcagtcacgagccataagcccgaagaaacatcagcaccgtcagaatctggcaaagagagtccagcagccaacagcccccacccagtcgccagcagaccaccaaccccctccacaacagcccaaggacctactgaaaacaacaactacaacaccaccggacagcttgagtccttgacacagtcgacaaccttaggcccaatgacctctctaacacagacagacctcccacagagtgtcacctccatagctgttcaagacacgcaccctagcccaacgaacaggtccaaaagaaaccttgaaatggaaataatcttaactttacctcagggtttaaaaaaatactatggcaaggtgctcaggcttctgcaactcaccttagaggaggacactgaaggcctgctagaatggtgtaagagaaaccttggtctcgattgtgatgacactttctttcaaaagagaattgaagaattcttcataactggtgagggtcatttcaatgaagttttacaatttagaacaccaggcacattgagcaccacagagtcaacacatgctgggttaccaacagctgaaccctttaaatcttatttcgctaaaggcttcctttcaatagactcaggttacttctcagccaaatgttactcaagaacatctaattcagggcttcagctgattaatgtcactcgacattcaactagaatagccgacacacccgggcccaagattaccaacctgaagactatcagctgcataaacttaaaggcatcagtctttaaagaacatagagaggttgaaattaatgtgcttctccctcaagttgcagttaacctctcaaactgtcacgttacaatcaaatcacatgtctgtgactattctttagacattgacggaacagtgaggcttcctcacattcatcatgacggaacctttatcccaggaacttacaagatagtgatagacagaaaaaacaagctgaatgacagatgtaccttattcaccaactgtgtgataaaaggaagagaggttcgtaaaggccaatcagttttgaggcagtataagacagagattaggattggcaaggcatcaactggttctagaagattgctttctgatgagtctggtgatgactgcatatcaaggactcagctactgagaacagagactgcagagatccatggtgacaattatggtggtccgggtgacaagattaccatttgcaatggttcaactattgtagaccaaagactgggcagtgaactggggtgttacactatcaatagagtgaagtcattcaagctgtgcgaaaacagtgccacagggaagagctgtgaagtagacagtatcccagtaaaatgcaggcagggttattgcctaaaaatcactcaggaaggaaggggccacgtgaaattatccagaggttcagaggttgtcttggatgcatgcgattcaagctgtgaagtaatgatacctaagggcacaggtgacatcctagtggactgttcaggtgggcagcaacatttcttgaaggacaacttaattgacctaggatgtcccaaaattccattgttgggcaaaatggctatttatatttgcagaatgtcgaatcaccccaagacaaccatggctttcctcttttggttcagttttggctatgtgataacttgtatagtctgcaaggccattttttacttattaataattgttggaacactagggaagaggtttaagcagtatagagagttaaaaccccagacctgcaccatctgtgagacaactcctacaaatgcaatagatgctgaaatgcatgaccttaactgcagttacaacatatgtccctattgtgcatctagactaacctcagatgggcttgctaggcatgtaactcattgccctaagcggaaagagaaagtagaagaaactgaattgtacttgaacttagagagaattccctgggttgtaagaaagctgttgcaggtatcagagtccaccggtgtagcattaaaaagaagcagctggctgattgtgctgcttgtgctgtttgcagtttcattatcaccagttcaatcagcacctattggtcatgggaagacaattgaaacataccaggtcagggaggaatacacaagtatttgcctctttgtactgggaagtatcttgttcatagtctcttgtctaatgaaagggctggttaacagtgttggcaacatcttcttccctgggctgtccatttgcaagacgtgctctataggtagtattaatggctttgaaattgagtctcataagtgctattgtagcttactttgttgcccttactgtaggcactgctctgctgacagggaaattcatcaattgcacttgagcatctgcaagaaaagaaaaacaggaagtaatgtcatgcttgctgtttgcaagcgcatgtgtttcagagcaactgtggaagtgagcaacaaggccctatctatccgtagcatcatcaacaccacttttgttgtgtgcattttaatactagcagtctgtgttgttagcacttcagcagtagagatggaaagcctaccagctgggacctgggaaagagaagaagatctaacaaatttctgtcatcaggaatgccaggtcacggagactgagtgcctctgcccttatgaggctctagtactcagaaggcccctgtttctggacggtatagtcaaaggcatgaaaaacctgctaaactcaacaagtttggaaacaagcttgtcgattgaggcaccatggggggcaataaatgttcagtcaacctacaaaccaactgtatcagctgcaaacatagcacttagttggagttcagttgaacacagaggtaataagattttggtttcaggcagatcagaatcaattatgaagctggaagaaaggacaggaatcagctgggatcttggcgtagaagatgcctctgaatctaagctactcacagtctctgtcatggacttgtctcagatgtactctcctgtcttcgagtacttgtcaggtgacagacaagtagaagagtggcccaaggcaacctgtacaggtgactgcccagagagatgtggctgtacatcatcaacctgtttgcataaagaatggccccattcaagaaactggaggtgtaatcccacttggtgctggggggtagggactggctgcacctgttgtggtttagatgtgaaagacctttttacagactatatgtttgtcaagtggaaagtcgaatacattaagacagaggccatagtgtgtgtagaacttaccagtcaggaaaggcagtgtagcttaattgaggcgggtacaaggttcaatttaggtcccgtgaccatcacattgtcagaaccgaggaacatccaacaaaaactccctcctgaaataatcacactgcatcctaggattgaagaaggtttttttgacctgatgcatgtacaaaaggtgctgtcagcaagcacagtgtgtaagttgcagagttgcacacatggtgtgccaggagatctacaggtctaccacatcggaaatttactaaaaggagataaagttaacggacacctaattcataaaattgaaccacacttcaacacttcttggatgtcttgggatggctgtgacctagactactactgcaacatgggagattggccttcttgcacatataccggggttacccagcacaatcatgcttcatttataaacctgctcaacattgaaactgactatacaaaaagcttccattttcactctaaaagggttactgcacatggagacacaccacaattagatctgaaggcaaggccaaactatggcgcaggagagatcaccgtactggtagaggttgccgatatggagttacacacaaagaagattgaaatatcaggactaaagtttgcaagcttgacttgtacaggttgttatgcttgtagttccggtatctcctgtaaagttaggattcatgtggatgaaccagatgaacttacagtacatgttaaaagtgatgatccagatgtagttgctgctagctcaagtctcatggcaaggaagcttgaatttggaacagacagtacatttaaggctttctcagccatgccaaaaacctccttatgtttctatattgtcgaaagggaatactgcaagagctgcagtaaagaagacacacaaaaatgtgttaacacgaagcttgagcatccacagagcattttgatcgaacataagggaactataatcggaaagcagaacaatacctgcacagcaaagacaagttgctggttagagtcagttaagagtttcttttatggtttaaagaacatgcttagtggcattttcggcaacgtttttgtaggcattttcttatttcttgcccccttcatcttgctaatacttttctttatgtttgggtggaggatcctattttgcttcaagtgctgtagaagaaccagaggcctgtttagatataaacatctcgaagacgatgaagaaactggttacagaagaatcattgaaagactgaacaacaaaaaaggaaaaaacaagctgcttgatggtgaaagacttgctgatagaagaattgccgaactattctccacaaaaacacacattggctag

SEQ ID NO: 3624 - RNA, 5055 nt, synthetic construct
  misc_feature 1..5055: note = derived and/or modified CDS sequence (wt) from CCHFV(K128_76)__KX013454.1__GP
  source 1..5055: mol_type = other RNA
atgcacatatcgttgatgtgtgcagttctttgcctgcagctgtatggtctggggggaactcatgggtcacacaatgaaaccgaacacaacaaaacaaacgccgtgacaacgtccagtgacagccagagcccagaaccaccaacaagaacgaccctgcccgtcacgccagactcccccaccgtcacacccacaactccagccagcgcaccagaaggctcaggggaagtccacacatcccccccaaacaccactgagggcccgtctctgccggagtccacgccagagccccccacggcaaccagcacaggcatcccaagtgcaagtgatgtcaactccagcacacaggcagccagagacacctccacaccaacagtccacaccagtccacccaacagccccagcacaccacccacactacaagaaacacaccatcctatgaggaacttactttcagtcacgagccataagcctgaagaaacatcagcaccgtcagaatctggcaaagagagtccagcagccaacagccctcacccagtcgccgacagaccatcaacctcctccacaacagcccaaggacctactgaaaacaacagctacaacaccaccgaacagcttgagtccttgacacagtcgacaactctaggcccaatgacctctctaacacagacagtcctctcacagagtgtcacctccatagccgttcaagacacacacctcagcccaacgaacagatccaaaagaaaccttgaaatggaaataatcttaactttacctcagggtttaaaaaaatactatggcaaggtgctcaggcttctgcaactcaccttagaagaagacactgagggcctgttagaatggtgtaagagaaatcttgatcttgactgtgatgacactttctttcaaaagaggattgaagaattcttcataactggtgagggttatttcaatgaagttttacaatttagaacaccaggcacattgagcaccacagagtcaacacatgctgggttaccaacggctgaaccctttaaatcctatttcgctaaaggcttcctttcaatagactcaggttacttctcagccaaatgttactcaagaacatctaattcagggcttcagctgatcaatgtcactcgacattcaactagaatagctgacacacctgggcccaagatcaccaacctaaagaccatcagctgcataaacttaaaggcatcagtctttaaagaacatagagaggttgaaattaatgtgcttctccctcaagttgcagtcaacctctcaaactgtcacgttacaatcaaatcacatgtctgtgactattctttagacattgacggaacagtgaagcttcctcacattcaccatgacggaacctttatcccaggaacttacaagatagtgatagacaggaaaaacaagctgaatgacagatgtaccttgttcaccaactgtgtgataaaaggaagagaagttcgtaaaggccaatcagttttgaggcagtataagacagagattaggattggcaaggcatcaactggttctaggagattgctttctgatgaatctggtgatgactgcatatcaaggactcagctgttgagaacagagactgcagagatccatggtgacaattatggtggtccgggtgacaagattaccatttgcaatggttcaactattgtagaccaaagactgggtagtgaactggggtgttacactatcaatagagtgaagtcattcaagctgtgcgaaaacagtgccacagggaagagctgtgaaatagacagtatcccagttaagtgcaggcagggttattgcctaaaaatcactcaagaaggaaggggccatgtgaaattatccaggggctcagaggttgtcttggatgcatgcgactcaagctgtgaagtaatgatacctaagggcacaggtgacattctagtagactgttcaggtgggcagcaacattttttgaaggacaacttgattgacctaggatgtcccaaaattccattgttgggcaaaatggctatttatatttgtagaatgtcgaatcaccccaaaacgaccatggctttcctcttttggttcagttttggctatgtgataacttgtatagtctgcaaagccattttttacttattaataattgttggaacactagggaagaggtttaagcagtatagagagttaaaaccccagacctgtaccatctgtgagacaactcctacaaatgcaatagatgctgaaatgcatgaccttaactgcagttacaacatatgtccctattgtgcatctagactaacctcagatgggcttgctaggcatgtaactcattgccctaagcggaaggagaaagtagaagaaactgaattgtacttgaacttagaaagaattccatgggttgtaagaaagctattgcaggtatcagagtccaccggtgtagcattaaaaagaagcagctggctgattgtgctgcttgtgctgtttgcagtttcattatcaccagttcaatcagcacccattagtcatgggaagacaattgaaacataccaggtcagggaggaatacacaagtatttgcctctttgtactgggaagcattttgtttattgtctcttgtctaatgaaagggctggttaacagtgttggcaacatcttcttccctgggctgtccatttgcaagacgtgctctataggtagtattaatggctttgaaattgagtctcataagtgctattgtagcttactttgttgcccttactgtaggcactgctctgctgatagagaaattcatcaactgcacttgagcatctgcaaaaaaagaaaaacaggaagtaatgtcatgcttgctgtttgcaagcgcatgtgtttcagagcaacaatggaagtgagcaacaaggccctatttatccgtagcatcatcaacaccacttttgttgtgtgcattttgatactagcagtctgtgttgttagcacttcagcagtagagatggaaagcctgccagctgggacctgggaaagagaagaagacctaacaaatttctgtcatcaggaatgccaggttactgagactgagtgcctctgcccttatgaagctctagtactcagaaggcccctgtttcaggacagtatagtcaaaggcatgaaaaacctgctaaactcaacaagtttagaaacaagcttgtcgattgaggcaccatggggggcaataaatgttcagtcaacctacaaaccagctgtgtcagctgcaaacatagcacttagttggagttcagttgaacacagaggtagtaagattttggtttcaggcagatcagaatcaattatgaagctggaagaaaggacaggaatcagctgggatcttggcgtagaagatgcctctgaatctaagctacttacagtctctgtcatggacttgtctcagatgtactcccctgtcttcgagtacttgtcaggtgacagacaagtagaagagtggcccaaggcaacctgtacaggtgactgcccagagagatgtggttgtacatcatcaacctgtttgcataaagaatggccccattcaagaaactggaggtgtaatcccacttggtgctggggggtagggactggctgcacctgttgtggtttagatgtgaaagacctttttacagactatatgttcgtcaagtggaaagttgaatatattaagacagaggccatagtgtgtgtagaacttaccagtcaggaaaggcagtgtagtttaattgaggcaggtacaaggttcaatttaggtcctgtgaccatcacattgtcagaaccgaggaacatccaacaaaagctccctcctgaaataatcacactgcatcctaggattgaagaaggtttttttgacctgatgcatgtgcaaaaggtgctgtcagcaagcacagtgtgtaagttgcagagttgcacacatggtgtgccaggagatctacaagtctaccacatcgggaatttactaaaaggagatagagttaacggacacctaattcataaaattgagccacactttaacacttcttggatgtcctgggatggctgtgacctagactattactgcaacatgggagactggccttcttgcacatataccggagttacccagcacaatcatgcttcatttgtgaacctgctcaacattgaaactgactatacaaaaagcttccattttcactctaaaagggttactgcacatggagacacaccacaattagatctgaaggcaaggccaaactatggcgcaggagagatcaccgtactggtagaggttgccgatatggagttacacacaaagaagattgaaatatcaggcctaaagtttgcaagcttgacttgtacaggttgttatgcttgtagttccggtatctcctgtaaagttaggattcatgtggatgaaccagatgaacttacagtacatgttaaaagtgatgatccagatgtagttgcagctagctcaagtctcatggcaaggaagcttgaatttggaacagacagtacatttaaggctttctcagccatgcccaaaacctccttatgtttctacattgtcgaaagggagtactgcaagagctgcagtaaagaagacacacaaaaatgtgttaacacaaaacttgagcagccacagagcattttaatcgaacataagggaactataatcggaaagcaaaacaatacctgcacagcaaagacaagttgctggttagagtcagttaaaagtttcttttatggtttaaagaacatgcttagtggcatttttggcaatgtttttgtgggtattttcttatttcttgcccccttcatcttgctaatacttttctttatgtttgggtggaggatcctgttttgcttcaagtgctgtagaagaaccagaggcctgttcagatataagcatctcgaaaacgatgaagaaactggttacagaagaatcattgaaagactgaacaacaaaaaaggaaaaaacaagctgcttgatggtgaaagacttgctgatagaagaatcgccgaactattctccacaaaaacacacattggctag

SEQ ID NO: 3625 - RNA, 5055 nt, synthetic construct
  misc_feature 1..5055: note = derived and/or modified CDS sequence (wt) from CCHFV(K168_125)__KX013460.1__GP
  source 1..5055: mol_type = other RNA
atgcacatatcactgatgtgtgcagttctttgcctgcagctgtatggtctggggggaacccatgggttacacaatggaactgaacacaataagacaaacgctgtgacaacgtccagtaacagccagagctcagaatcaccagcaagaacggccccacctgtcacgccggactcccccaccgtcacacccacaactccagccagcgcaccagaaggctcaggggaggcccactcatcccccccaaacaacacagagggcccgtctctgccggagtccacgtcagagccccccgcggcaaccagcacaggcatcccaagtgcaagtgatgtcaactccagcacacaggcagccagagacacctccacaccaacagtccgcaccagtccccccaacagccccagcacaccacccacaccacaagaaacacaccatcctgtgaggaatctactttcagtcacgagccataagcccgaagaaacatcagcaccgtcagaatctggcaaagagagtccagcagccaacagcccccacccagtcgccagcagaccaccaaccccctccacaacagcccaaggacctactgaaaacaacaactacaacaccaccggacagcttgagtccttgacacagtcgacaaccttaggcccaatgacctctctaacacagacagacctcccacagagtgtcacctccatagctgttcaagacacgcaccctagcccaacgaacaggtccaaaagaaaccttgaaatggaaataatcttaactttacctcagggtttaaaaaaatactatggcaaggtgctcaggcttctgcaactcaccttagaggaggacactgaaggcctgctagaatggtgtaagagaaaccttggtctcgattgtgatgacactttctttcaaaagagaattgaagaattcttcataactggtgagggtcatttcaatgaagttttacaatttagaacaccaggcacattgagcaccacagagtcaacacatgctgggttaccaacagctgaaccctttaaatcttatttcgctaaaggcttcctttcaatagactcaggttacttctcagccaaatgttactcaagaacatctaattcagggcttcagctgattaatgtcactcgacattcaactagaatagccgacacacccgggctcaagattaccaacctgaagactatcagctgcataaacttaaaggcatcagtctttaaagaacatagagaggttgaaattaatgtgcttctccctcaagttgcagttaacctctcaaactgtcacgttacaatcaaatcacatgtctgtgactattctttagacattgacggaacagtgaggcttcctcacattcatcatgacggaacctttatcccaggaacttacaagatagtgatagacagaaaaaacaagctgaatgacagatgtaccttattcaccaactgtgtgataaaagggagagaggttcgtaaaggccaatcagttttgaggcagtataagacagagattaggattggcaaggcatcaactggttctagaagattgctttctgatgagtctggtgatgactgcatatcaaggactcagctactgagaacagagactgcagagatccatggtgacaattatggtggtccgggtgacaagattaccatttgcaatggttcaactattgtagaccaaagactgggcagtgaactggggtgttacactatcaatagagtgaagtcattcaagctgtgcgaaaacagtgccacagggaagagctgtgaagtagacagtatcccagtaaaatgcaggcagggttattgcctaaaaatcactcaggaaggaaggggccacgtgaaattatccagaggttcagaggttgtcttggatgcatgcgattcaagctgtgaagtaatgatacctaagggcacaggtgacatcctagtggactgttcaggtgggcagcaacatttcttgaaggacaacttaattgacctaggatgtcccaaagttccattgttgggcaaaatggctatttatatttgcagaatgtcgaatcaccccaagacaaccatggctttcctcttttggttcagttttggctatgtgataacttgtatagtctgcaaggccattttttacttattaataattgttggaacactagggaagaggtttaagcagtatagagagttaaaaccccagacctgcaccatctgtgagacaactcctacaaatgcaatagatgctgaaatgcatgaccttaactgcagttacaacatatgtccctattgtgcatctagactaacctcagatgggcttgctaggcatgtaactcattgccctaagcggaaagagaaagtagaagaaactgaattgtacttgaacttagagagaattccctgggttgtaagaaagctgttgcaggtatcagagtccaccggtgtagcattaaaaagaagcagctggctgattgtgctgcttgtgctgtttgcagtttcattatcaccagttcaatcagcacctattggtcatgggaagacaattgaaacataccaggtcagggaggaatacacaagtatttgcctctttgtactgggaagtatcttgttcatagtctcttgtctaatgaaagggctggttaacagtgttggcaacatcttcttccctgggctgtccatttgcaagacgtgctctataggtagtattaatggctttgaaattgagtctcataagtgctattgtagcttactttgttgcccttactgtaggcactgctctgctgacagggaaattcatcaattgcacttgagcatctgcaagaaaagaaaaacaggaagtaatgtcatgcttgctgtttgcaagcgcatgtgtttcagagcaactgtggaagtgagcaacaaggccctatctatccgtagcatcatcaacaccacttttgttgtgtgcattttaatactagcagtctgtgttgttagcacttcagcagtagagatggaaagcctaccagctgggacctgggaaagagaagaagatctaacaaatttctgtcatcaggaatgccaggtcacggagactgagtgcctctgcccttatgaggctctagtactcagaaggcccctgtttctggacagtatagtcaaaggcaagaaaaacctgctaaactcaacaagtttggaaacaagcttgtcgattgaggcaccatggggggcaataaatgttcagtcaacctacaaaccaactgtatcagctgcaaacatagcacttagttggagttcagttgaacacagaggtaataagattttggtttcaggcagatcagaatcaattatgaagctggaagaaaggacaggaatcagctgggatcttggcgtagaagatgcctctgaatctaagctactcacagtctctgtcatggacttgtctcagatgtactctcctgtcttcgagtacttgtcaggtgacagacaagtagaagagtggcccaaggcaacctgtacaggtgactgcccagagagatgtggctgtacatcatcaacctgtttgcataaagaatggccccattcaagaaactggaggtgtaatcccacttggtgctggggggtagggactggctgcacctgttgtggtttagatgtgaaagacctttttacagactatatgtttgtcaagtggaaagtcgaatacattaagacagaggccatagtgtgtgtagaacttaccagtcaggaaaggcagtgtagcttaattgaggcgggtacaaggttcaatttaggtcccgtgaccatcacattgtcagaaccgaggaacatccaacaaaaactccctcctgaaataatcacactgcatcctaggattgaagaaggtttttttgacctgatgcatgtacaaaaggtgctgtcagcaagcacagtgtgtaagttgcagagttgcacacatggtgtgccaggagatctacaggtctaccacatcggaaatttactaaaaggagataaagttaacggacacctaattcataaaattgaaccacacttcaacacttcttggatgtcttgggatggctgtgacctagactactactgcaacatgggagattggccttcttgcacatataccggggttacccagcacaatcatgcttcatttataaacctgctcaacattgaaactgactatacaaaaagcttccattttcactctaaaagggttactgcacatggagacacaccacaattagatctgaaggcaaggccaaactatggcgcaggagagatcaccgtactggtagaggttgccgatatggagttacacacaaagaagattgaaatatcaggcctaaagtttgcaagcttgacttgtacaggttgttatgcttgtagttccggtatctcctgtaaagttaggattcatgtggatgaaccagatgaacttacagtacatgttaaaagtgatgatccagatgtagttgctgctagctcaagtctcatggcaaggaagcttgaatttggaacagacagtacatttaaggctttctcagccatgccaaaaacctccttatgtttctatattgtcgaaagggaatactgcaagagctgcagtaaagaagacacacaaaaatgtgttaacacgaagcttgagcatccacagagcattttgatcgaacataagggaactataatcggaaagcagaacaatacctgcacagcaaagacaagttgctggttagagtcagttaagagtttcttttatggtttaaagaacatgcttagtggcattttcggcaacgtttttgtaggcattttcttatttcttgcccccttcatcttgctaatacttttctttatgtttgggtggaggatcctattttgcttcaagtgctgtagaagaaccagaggcctgtttagatataaacatctcgaagacgatgaagaaactggttacagaagaatcattgaaagactgaacaacaaaaaaggaaaaaacaagctgcttgatggtgaaagacttgctgatagaagaattgccgaactattctccacaaaaacacacattggctag

SEQ ID NO: 3626 - RNA, 5052 nt, synthetic construct
  misc_feature 1..5052: note = derived and/or modified CDS sequence (wt) from CCHFV(Kosova Hoti)__EU037902.1__GP
  source 1..5052: mol_type = other RNA
atgcatacactattagtgtgcttcattctttacctacagctgttgggtctaggaggagctcatggacagtcaaacgcaactgaacacaatggaacaaacaccaccacagcacccggcacaagtcaaagccccaagccacccgcgagcacaaccccatcacacgcaccggaaccatccaccatcaaactcaccacaccaacaagcgaaacagaaggctcaggggaaacgaccccacccacaaacaccacccaggactcgcccccgctagagaccacaccagaacgctctgcaacaaccgccacaagcacgtcaggcacagacaacatgaattccaccacacagatgaccgataacacccccacatcaacagtcagcacaagtctatccagtagccccagcacgccatccacatcacaaggcatgcaccatcccgtaaggagtctattgtcagtctcgagccccaagacagcaacaacaccaacaccaatgagccctggagagatgagctcggaaaccagcagtcagcactcagccatgagcagaacaccaaccccccacacagcaacccaggtctccactgagaacgccaaccgcagcacatccagacagtctgagtcctcagcacagccggcaacccaaagcccagtgacttccccagcgcaatcaatccttctgatgagtgctactcccacaaccattcagaacatacatcccagcccaacaaacaggtctaagaggaaccttgagatggaaataattttaactctgtctcaaggtctgaagaaatactatggtaaaatactgaagcttctgcaccttaccttggaagaggacactgaaggcttgttggaatggtgtaagagaaaccttgggtcgaactgtgatgatgacttctttcaaaagaggatagaagaattcttcataactggtgagggctacttcaacgaagttctacagtttaaaacactaagcacaccaagctccacggagccgtctcatgccaggctaccaacagcggaacccttcaaatcttacttcgctaagggcttcctttcaatagattcgggttacttctctgccaaatgttatccaagatcatccacttcagggcttcagctgatcaatgtcacccaacacccagctaggatagcagagacacctggacccaaaacaacgagtctgaaaaccatcaactgcatcaatctaagagcatctgtcttcaaagaacacagggaagttgagatcaatgtgcttcttcctcaaattgcagtcaacctctcaaactgccatgttgtgatcaattcacatgtctgtgattactctttagacactgatgggccagtgaggcttcctcgcatttaccatgaagggactttcatgccaggaacttataaaatagtgatagacagaaaaaataagctaaatgaccgatgtacgctagtcaccaactgtgtgataaaaggaagagaagttcgtaagggccaatcagtgctgaggcagtacaaaacagaaattaagataggcaaggcaccaacaggctctaggaaactactgtccgaagagccaggtgatgattgcatatcaaggactcagctattgaggacagaaacagcagagatccatgacgataactatggtggtccaggtgacaaaataactatctgcaatggttcaaccattgtagatcagagactgggcagtgaactagggtgttacaccatcaacagggtgaagtcattcaagctatgcgaaaacagcgccacagggaaaacctgtgagatagacagcactccagttaagtgcaggcaaggtttttgtttaaaaatcacccaaaagggaaggggccacgtaaaattatctagaggctcagaggttgtcttggacgcttgcgactcaaactgtgaagtaatgatacctaaaggcactggagatatcctagtggactgttcaggtggacagcagcatttcttaaaagacaacttgattgacctggggtgccctcatatcccactattgggtaagatggccatttacatttgcagaatgtcaaatcatcctaaaacaaccatggcttttctcttctggttcagctttggttatgtgatcacctgtatattttgcaaggctcttttttattcattgataattattgggacactaggaaaaaagatcaagcaatatagggaactgaaacctcaaacttgcaccatatgtgaaacagctcctgtcaatgcaatagatgctgaaatgcatgacctcaactgtagttacaatatatgcccttattgtgcatcaagattgacctccgatgggctagctaggcatgtaaagcaatgccctaagcgaaaggagaaagtcgaggagactgagctgtacctgaacctggaaagaattccttgggtcgtcagaaagctattgcaagtgtcagagtccactggtgtggcattgaaacgaagcagttggctgattgtgctgcttgtgttactcacagtttcattgtcaccggttcaatcagcacctgttggtcatggtaagacgatcgaaacatatcagaccagagaaggattcacaagtatttgtctctttatgttaggaagcatcctattcatagtctcttgcttggtgaaagggctggttgacagtgtcagtgacagcttcttccccggcctgtctgtctgcaagacatgctccattggcagtataaatggctttgaaattgaatcgcataaatgctactgtagcttattttgctgcccctattgtagacactgctctgctgacagagaaattcaccaattgcacttgaatatctgcaaaaaaagaaaaacggggagcaatgtcatgctagctgtctgcaagcgcatgtgctttagggcaaccatagaagcaagcagaagagccctgctcatccgaagtattatcaataccacttttgtaatatgcattctaacattaacaatctgtgttgttagtacctctgcagtagagatggaaaaccttccagcaggcacctgggagagagaggaagacctgacaaatttttgtcatcaggaatgccaggtaaccgagacggaatgcctttgtccatacgaagctcttgtgctcaggaaacctcttttcttagacagtatagtcaaaggtatgaaaaatttgctaaactcaacaagcttagaaacaagcttatcaattgaggcaccatggggagcaataaatgtccagtcaaccttcaaaccaacagtgtcgactgcgaacatagcactcagttggagctcagtggaacacagaggcaacaagatcttagtcacaggcaggtctgagtcaattatgaaactagaggaaaggacaggaatcagctgggatctaggcgtagaagatgcctctgaatccaaattacttaccgtctctatcatggatttgtcacagatgtattccccagtttttgagtacttgtcaggggacagacaggttgaagaatggcccaaagcaacttgcacaggtgactgcccacaaaggtgtggctgcacatcatcaacctgcttgcataaagaatggcctcattcaagaaactggagatgtaatcccacttggtgctggggagtgggaactggctgcacctgctgcggggtggatgtaaaagacctttttacagatcacatgtttgtcaaatggaaggttgaatatataaaaactgaagccatagtgtgtgttgagctcaccagccaagaaagacagtgcagtctgattgaggcaggtactagattcaacttgggccctgtgactattaccctgtctgagccaagaaacattcagcagaagctcccccctgagatcattacgttgcatcccaaaattgaggaaggcttctttgacttgatgcatgtacaaaaagtgttgtccgcaagtacagtgtgtaaactgcagagttgcacacatggtataccaggagatctacaagtttaccacattggcaatttgttgaaaggggatagagtgaacgggcatctaattcacaaaattgaaccacatttcaacacctcttggatgtcctgggatggttgtgacttagactactactgcaacatgggggactggccttcttgtacatacacaggagtgacccagcataatcatgctgcatttgtaaacttgctcaacattgaaactgattacacaaaaaccttccacttccactctaaaagagtcacagcacatggtgacacaccacaattggacttaaaagcaaggccgacctacggtgcaggagagatcactgtgctggttgaggttgctgacatggagttgcataccaagaaagttgagatatcgggcttgaaatttgcaagtctggcttgcacaggttgctatgcctgtagctctggtatctcctgtaaagtcaggattcatgtagatgaaccagatgagctcacagtgcatgtaaagagcagtgatccagatgtggttgcagctggcacaagcctcatggcaaggaagcttgaatttgggacagacagcacattcaaggccttttcagctatgcccaaaacctctttatgtttttacattgtggagaaagaatactgcaagagctgcagtgaagatgatacaaaaaaatgtgttgacacaaaacttgagcagccacagagcatactaattgagcacagagggacgataattggaaagcagaatgatacttgcacagccaaggcaagctgttggctagagtcagtcaagagttttttttatggattgaagaatatgcttggcagtgtttttggtaattttttcataggtattttgttattccttgccccttttgtcctgttggtgcttttctttatgtttggatggaaaatcttgttttgctttaaatgttgcaggaggaccagaggcttgtttaagtatagacacctcaaagacgatgaggaaacaggctacagaaggattattgaaaggctgaacaacaaaaaagggaaaaatagactgcttgatggtgaaaggttggctgataggaaaattgccgagctgttttccacaaaaacacacattggctag

SEQ ID NO: 3627 - RNA, 5049 nt, synthetic construct
  misc_feature 1..5049: note = derived and/or modified CDS sequence (wt) from CCHFV(Oman)__DQ211632.1__GP
  source 1..5049: mol_type = other RNA
atgcacacactgctagtgtatgctgtcttttgcttgcagctatggagtccaggaggaactcgtggactgtcaaatgaaactcaacacaatgaaacaggtatcacaagagcacctgaagggagccaaggacccagtttgcctgtaagcacagcatcacccatcatgtcagacccctccatcaccacaccctcagcgtcgaccagtggactagaaggctcaggggacacgactcccccagccatcacacaaggcccgaccccaccagagaccacgccggaaccctccacaacaaccggcacaaacgcattcagcacagccattgccaatgtcagtacacagacagtcaaggacacccccacaccgacagtccaaacaagtccacctagcactcccgacgcatctaccataccacagggcacacatcacaccgcaaggggtctgctgtcagtcaccgtcacaaagccagaagaagtaccaacaccaacaggcccagaacaagcaagcatagagaccaatagcccacgcctagcaactagcaagacaccgtccccctctccaacagctcaggttaccactgaaaacagcaaccctaatacctccagacagctcgtgctctcaacacaaccagcaacctcaagcccagtgacctctccagcacagctgatcttcgtgcagagtgctactaccgtagccgttcaagatgcacacccaagcccaacaaacaggtccaaaagaaaccttgagatggaagtaattttgactttatctcaaggtttaagaaagtactacggcagaatactgaaacttctggaccttaccttagaagaagacaccgaaggactgctggagtggtgtaagagaaatcttggtctaacctgtgacgataacttctttcagaagaggatagaagagttcttcttgactggtgagggtcacttcaatgaagttttacagttcaaaaccccaagcacactgagctctacagaatctgctagtgtagggttaccaacagttgagcccttcaaatcttactttgctaaaggctttctttcaatagactcaggttacttctctgccaagtgttatccaagggcgtctaactcagggcttcagttaatcaatgtcactcaacattcagctagaatagcagacacacctggacctaagatcacaaatctgaaaaccatcaattgcataaacctaaaggcattggtctttaaagagcatagagagattgaaatcaatgttcttctccctcaagtcgcagtcaatctctcaaactgccatgtccacatcaaatcgcatgtctgtgattattctttagacatcgacggaacagttaggctaccccgtatccaccatgaaggaactttcataccaggaacttacaaaatagtgatagacaaaaaaaacaaacaaaacgatagatgcaacttggttaccaattgtgtaataaaaggaagggaagtgcgtaaaggccagtcagtgttaagacagtacagaacagaaatcaggatcggcaaggcatcttctggctccagaagactgctgtccgaagagtctggtgaagactgtatatcaaggactcagctattgaggacagaaactgcagaaatccatggtgataactatggtggtccaggtgacaaaataaccatctgcaatggttcaaccattgtagatcaaaggctgggtagtgaactggggtgttacactatcaatagggtgaagtcatttaagctatgcgaaaacagtgccacaggtaagtcctgtgaaatagataacactccagtaaaatgcaagcaaggtttttgcttgaaaataacccaagaaggaaggggccacgtgaagctttcaagagactcagaagttgtcctggacgcctgcgattcaagctgtgaaataatgataccaaagggcactggagacatcctggttgactgctcaggtgggcagcagcacttcttaaaagacaacctgattgatctgggatgccccaacatcccattattaggcaaaatggcaatctacatttgtagaatgtcaaatcatcctaaaacaactatggcttttcttttttggtttagctttggttatgtgataacctgcatactttgtaaagtcattttttatctattgatagttgttggaactttagggaaaaagtttaaacagtatagagagttaaaacctcagacctgcacaatatgtgaaacaactcctgtcaatgcaatagatgctgagatgcacgatctcaattgtagttacaatatatgtccttattgtgcatctaggttaacttcagatggtcttgccagacatgtaatgcagtgtcctaagcggaaggaaaaaatagaagaaaccgaattatacctgaacttagaaagaatcccttgggttgtcagaaaactactgcaggtgtcagaatccactggtgtagcactaaagaggagcagttggctgattgtgctacttgtgcttctcacagtttcattgtcaccagtacaatcagcacctatcggtcatgggaagaccatagaaacgtatcaaactagagaagggtacacaagtatttgtctttttgtgctaggaagcattttgtttatagtttctcacctaatgaaggggctggttgacagtgttggtaacagtttttttcctgggttatctatctgcaagacatgctctattggcagtataaatggctttgaaattgaatctcacaaatgtttctgtagcctattttgttgcccctactgtagacactgctctgccgataaagaaatccataagttgcatttgagcatctgcaaaaaaagaaaagctgggagtaatgtcatgttggccgtctgtaagcgcatgtgttttagggcaactatggaagtgagcaacaaggctctactcatccgaagtgtcatcaacactacttttgttgtatgcatactaatattagcagtttgtgttgttagcacctctgcagtagagatggaaagcctgccagctggcacttgggagagagaggaagacctaacaaacttctgccatcaagaatgccaggtcactgaaactgaatgtctctgtccctatgaagctcttgtactcagaaagcccttatttttagacagtattgctaagggcatgaagaacctgctgaattcaacaagcttagaaacaagcttatcaattgaggcaccatggggagcaataaacgttcaatctactttcaaacctactgtgtcaactgcaaacatagcacttagttggagctcagtggaacacagaggtaataagatcttggtttcaggcagatcagagtcaatcatgaagctagaagaaagaacaggaatcagctgggatttgggagtagaagatgcctctgagtccaaattacttactgtttccgtcatggacttatcacagatgtactctcctgtctttgagtacctatcaggtgacagacaagtagaggaatggccaaaggcaacctgtacaggcgattgcccggaaagatgtggctgcacatcatcaacctgcctacacaaggaatggcctcactcaagaaactggagatgcaaccccacttggtgttggggagtcggcaccggatgcacctgttgtggactagatgtaaaggacctttttacagattacatgtttgttaaatggaaggtcgaatatataaaaacagaggctatagtgtgtgttgagcttactagccaagaaagacaatgtagcttgattgaggcaggcacaagattcaacttaggtcctgtgactatcacattatcagagccaagaaacattcagcaaaagctccctccagaaattgtcacattacatcctagaattgaagaaggtttttttgacttaatgcatgtacagaaggtactatcagcaagcacagtgtgcaagctacagagttgcacacatggcgtaccaggagacttacaggtctaccacatcggaaacttactaaaaggagacaaagtgaacgggcatctgatacataaagttgaaccacatttcaacacctcctggatgtcttgggacggctgtgacctagattactactgcaatatgggggattggccctcttgcacgtatactggagttacccaacataatcatgctgcatttgtaaacctacttaacattgaaactgattacacaaagaacttccactttcactctaagagagtcactgcacatggggacactccacaattagatttaaaagccagaccaaattatggtgcaggtgaggtcactgtgctggtggaagttgctgacatggagttacacacaaagaaaattgagatatcaggtttgaagtttgcaagcctaacttgcacaggttgttatgcttgtagctctggcatctcatgtaaggttaggatccatgtagatgaaccagatgagcttacagtacatgtgaagagtgaagacccagacatagttgctgctagctcaagtctcatggcaagaaagcttgaattcgggacggatagtacattcaaagccttctcagccatgcctaaaacctccttgtgcttttacattgttgagagagaatactgtaaaagctgcagtaaagaagacacacaaaagtgtgttaacgcaaagcttgagcgaccacagagcattttaattgagcacaaaggaacgataattggaaagcagaacgacacttgcacagctaaagcaagctgctggctagagtcagtcaagagtttcttttatggactaaagaacatgcttagtggcatttttggcaatgttttcatagggattttcttattccttgctccttttatcctgttaatacttttctttatgtttgggtggagaatcctattctgctttaagtgctgcaggagaactagaggcctatttaagtacagacacctcaaagatgatgaagaaaccggttataggaaaatcattgagagactaaacaacaaaaaaggtaaaaacaagctgcttgacggtgaaagattagctgatagaaagatcgctgagctgttctctacaaaaacacacattggctga

SEQ ID NO: 3628 - RNA, 5049 nt, synthetic construct
  misc_feature 1..5049: note = derived and/or modified CDS sequence (wt) from CCHFV(Oman_812956)__KY362518.1__GP
  source 1..5049: mol_type = other RNA
atgcacacactgctagtgtatgctgtcttttgcttgcagctatggagtccaggaggaactcgtggactgtcaaatgaaactcaacacaatgaaacaggtatcacaagagcacctgaagggagccaaggacccagtttgcctgtaagcacagcatcacccatcatgtcagacccctccatcaccacactctcagcgtcgaccagtggactagaaggctcaggggacacgactcccccagccatcacacaaggcccgaccctaccagagaccacgccggaaccctccacaacaaccggcacaaacgcattcagcacagccattgccaatgtcagtacacagacagtcaaggacacccccacaccgacagtacaaacaagtccacctagcactcccgacgcatctaccataccacagggcacacatcacaccgcaaggggtctgctgtcagtcaccgtcacaaagccagaagaagtaccaacaccaacaggcccagaacaagcaagcatagagaccaatagcccacgcctagcaactagcaagacaccgtccccctctccaacagctcaggttaccactgaaaacagcaaccctaatacctccagacagctcgtgctctcaacacaaccagcaacctcaagcccagtgacctctccagcacagctgaacttcgtgcagagtgctactaccatagccgttcaagatgcacacccaagcccaacaaacaggtccaagagaaaccttgagatggaagtaattttgactttatctcaaggtttaagaaagtactacggcagaatactgaaacttctggaccttaccttagaagaagacaccgaaggactgctggagtggtgtaagagaaatcttggtctaacctgtgacgataacttctttcagaagaggatagaagagttcttcttgactggtgagggtcacttcaatgaagttttacagttcaaaaccccaagcacactgagccctacagaatctgctagtgtagggttaccaacagttgagcccttcaaatcttactttgctaaaggctttctttcaatagactcaggttacttctctgccaagtgttatccaagggcgtctaactcagggcttcagttaatcaatgtcactcaacattcagctagaatagcagacacacctggacctaagatcacaaatctgaaaaccatcaattgcataaacctaaaggcattggtctttaaagagcatagagagattgaaatcaatgttcttctccctcaagtcgcagtcaatctctcaaactgccatgtccacatcaaatcgcatgtctgtgattattctttagacatcgacggaacagtcaggctaccccgtatccaccatgaaggaactttcataccaggaacttacaaaatagtgatagacaaaaaaaacaaacaaaacgatagatgcaacttggttaccaattgtgtaataaaaggaagggaagtgcgtaaaggccagtcagtgttaagacagtacagaacagaaatcaggatcggcaaggcatcttctggctccagaagactgctgtccgaagagtctggtgaagactgtatatcaaggactcagctgttgaggacagaaactgcagaaatccatggtgataactatggtggtccaggtgacaaaataaccatctgcaatggttcaaccattgtagatcaaaggctgggtagtgaactggggtgttacactatcaatagggtgaagtcatttaagctatgcgaaaacagtgccacaggtaagtcctgtgaaatagataacactccagtaaaatgcaagcaaggtttttgcttgaaaataacccaagaaggaaggggccacgtgaagctttcaagagactcagaagttgtcctggacgcctgcgattcaagctgtgaaataatgataccaaagggcactggagacatcctggttgactgctcaggtgggcagcagcacttcttaaaagacaacctgattgatctgggatgccccaacatcccattattaggcaaaatggcaatctacatttgtagaatgtcaaatcatcctaaaacaactatggcttttcttttttggtttagctttggttatgtgataacctgcatactttgtaaagtcattttttatctattgatagttgttggaactttagggaaaaagtttaaacagtatagagagttaaaacctcagacctgcacaatatgtgaaacaactcctgtcaatgcaatagatgctgagatgcacgatctcaattgtagttacaatatatgtccttattgtgcatctaggttaacttcagatggtcttgccagacatgtaatgcagtgtcctaagcggaaggaaaaaatagaagaaaccgaattatacctgaacttagaaagaatcccttgggttgtcagaaaactactgcaggtatcagaatccactggtgtagcactaaagaggagcagttggctgattgtgctacttgtgcttctcacagtttcattgtcaccagtacaatcagcacctatcggtcatgggaagaccatagaaacgtatcaaactagagaagggtacacaagtatttgtctttttgtgctaggaagcattttgtttatagtttctcacctaatgaaggggctggttgacagtgttggtaacagttttttccctgggttatctatctgcaagacatgctctattggcagtataaatggctttgaaattgaatctcacaaatgttactgtagcctattttgttgcccctactgtagacactgctctgccgataaagaaatccataagttgcatttgagcatctgcaaaaaaagaaaagctgggagtaatgtcatgttggccgtctgtaagcgcatgtgttttagggcaactatggaagtgagcaacaaggctctactcatccgaagtgtcatcaacactacttttgttgtatgcatactaatattagcagtttgtgttgttagcacctccgcagtagagatggaaagcctgccagctggcacttgggagagagaggaagacctaacaaacttctgccatcaagaatgccaggtcactgaaactgaatgtctctgtccctatgaagctcttgtactcagaaagcccttattttttgacagtattgctaagggtatgaagaacctgctgaattcaacaagcttagaaacaagcttatcaattgaggcaccatggggagcaataaacgtccaatctactttcaaacctactgtgtcaactgcaaacatagcacttagttggagctcagtggaacacagaggtaataagatcttggtttcaggcagatcagagtcaatcatgaagctagaagaaagaacaggaatcagctgggatttgggagtagaagatgcctctgagtccaaattacttactgtttccgtcatggacttatcacagatgtactctcctgtctttgagtacctatcaggtgacagacaagtagaggaatggccaaaggcaacctgtacaggcgattgcccggaaagatgtggctgcacatcatcaacctgcctacacaaggaatggcctcactcaagaaactggagatgcaaccccacttggtgttggggagtcggcaccggatgcacctgttgtggactagatgtaaaggacctttttacagattacatgtttgttaaatggaaggtcgaatatataaaaacagaggctatagtgtgtgttgagcttactagccaagaaagacaatgtagcttgattgaggcaggcacaagattcaacttaggtcctgtgactatcacattatcagagccaagaaacattcagcaaaagctccctccagaaattgtcacattacatcctagaattgaagaaggtttttttgacttaatgcatgtacagaaggtactatcagcaagcacagtgtgcaagctacagagttgcacacatggcgtaccaggagacttacaggtctaccacatcggaaacttactaaaaggagacaaagtgaatgggcatctgatacataaagttgaaccacatttcaacacctcctggatgtcttgggacggctgtgacctagattactactgcaatatgggggattggccctcttgcacgtatactggagttacccaacataatcatgctgcatttgtaaacctacttaacattgaaactgattacacaaagaacttccactttcactctaagagagtcactgcacatggggacactccacaattagatttaaaagccagaccaaattatggtgcaggtgaaatcactgtgctggtggaagttgctgacatggagttacacacaaagaaaattgagatatcaggtttgaagtttgcaagcctaacctgcacaggttgttatgcttgtagctctggcatctcatgtaaggttaggatccatgtagatgaaccagatgagcttacagtacatgtgaagagtgaagacccagacatagttgctgctagctcaagtctcatggcaagaaagcttgaattcgggacggatagtacattcaaagccttctcagccatgcctaaaacctccttgtgcttttacattgttgagagagaatactgtaaaagctgcagtaaagaagacacacaaaagtgtgttaacgcaaagcttgagcgaccacagagcattttaattgagcacaaaggaacgataattggaaagcagaacgacacttgcacagctaaagcaagctgctggctagagtcagtcaagagtttcttttatggactaaagaacatgcttagtggcatttttggcaatgttttcatagggattttcttattccttgctccttttatcctgttaatacttttctttatgtttgggtggagaatcctattctgctttaagtgctgcaggagaactagaggcctatttaagtacagacacctcaaagatgatgaagaaaccggttataggaaaatcattgagagactaaacaacaaaaaaggtaaaaacaagctgcttgacggtgaaagattagctgatagaaagatcgctgagctgttctctacaaaaacacacattggctga

SEQ ID NO: 3629 - RNA, 5049 nt, synthetic construct
  misc_feature 1..5049: note = derived and/or modified CDS sequence (wt) from CCHFV(Oman-199809166)__KR864901.1__GP
  source 1..5049: mol_type = other RNA
atgcacacactgctagtgtatgctgtcttttgcttgcagctatggagtccaggaggaactcgtggactgtcaaatgaaactcaacacaatgaaacaggtatcacaagagcacctgaagggagccaaggacccagtttgcctgtaagcacagcatcacccatcatgtcagacccctccatcaccacactctcagcgtcgaccagtggactagaaggctcaggggacacgactcccccagccatcacacaaggcccgaccctaccagagaccacgccggaaccctccacaacaaccggcacaaacgcattcagcacagccattgccaatgtcagtacacagacagtcaaggacacccccacaccgacagtacaaacaagtccacctagcactcccgacgcatctaccataccacagggcacacatcacaccgcaaggggtctgctgtcagtcaccgtcacaaagccagaagaagtaccaacaccaacaggcccagaacaagcaagcatagagaccaatagctcacgcctagcaactagcaagacaccgtccccctctccaacagctcaggttaccactgaaaacagcaaccctaatacctccagacagctcgtgctctcaacacaaccagcaacctcaagcccagtgacctctccagcacagctgaacttcgtgcagagtgctactaccatagccgttcaagatgcacacccaagcccaacaaacaggtccaagagaaaccttgagatggaagtaattttgactttatctcaaggtttaagaaagtactacggcagaatactgaaacttctggaccttaccttagaagaagacaccgaaggactgctggagtggtgtaagagaaatcttggtctaacctgtgacgataacttctttcagaagaggatagaagagttcttcttgactggtgagggtcacttcaatgaagttttacagttcaaaaccccaagcacactgagccctacagaatctgctagtgtagggttaccaacagttgagcccttcaaatcttactttgctaaaggctttctttcaatagactcaggttacttctctgccaagtgttatccaagggcgtctaactcagggcttcagttaatcaatgtcactcaacattcagctagaatagcagacacacctggacctaagatcacaaatctgaaaaccatcaattgcataaacctaaaggcattggtctttaaagagcatagagagattgaaatcaatgttcttctccctcaagtcgcagtcaatctctcaaactgccatgtccacatcaaatcgcatgtctgtgattattctttagacatcgacggaacagtcaggctaccccgtatccaccatgaaggaactttcataccaggaacttacaaaatagtgatagacaaaaaaaacaaacaaaacgatagatgcaacttggttaccaattgtgtaataaaaggaagggaagtgcgtaaaggccagtcagtgttaagacagtacagaacagaaatcaggatcggcaaggcatcttctggctccagaagactgctgtccgaagagtctggtgaagactgtatatcaaggactcagctgttgaggacagaaactgcagaaatccatggtgataactatggtggtccaggtgacaaaataaccatctgcaatggttcaaccattgtagatcaaaggctgggtagtgaactggggtgttacactatcaatagggtgaagtcatttaagctatgcgaaaacagtgccacaggtaagtcctgtgaaatagataacactccagtaaaatgcaagcaaggtttttgcttgaaaataacccaagaaggaaggggccacgtgaagctttcaagagactcagaagttgtcctggacgcctgcgattcaagctgtgaaataatgataccaaagggcactggagacatcctggttgactgctcaggtgggcagcagcacttcttaaaagacaacctgattgatctgggatgccccaacatcccattattaggcaaaatggcaatctacatttgtagaatgtcaaatcatcctaaaacaactatggcttttcttttttggtttagctttggttatgtgataacctgcatactttgtaaagtcattttttatctattgatagttgttggaactttagggaaaaagtttaaacagtatagagagttaaaacctcagacctgcacaatatgtgaaacaactcctgtcaatgcaatagatgctgagatgcacgatctcaattgtagttacaatatatgtccttattgtgcatctaggttaacttcagatggtcttgccagacatgtaatgcagtgtcctaagcggaaggaaaaaatagaagaaaccgaattatacctgaacttagaaagaatcccttgggttgtcagaaaactactgcaggtatcagaatccactggtgtagcactaaagaggagcagttggctgattgtgctacttgtgcttctcacagtttcattgtcaccagtacaatcagcacctatcggtcatgggaagaccatagaaacgtatcaaactagagaagggtacacaagtatttgtctttttgtgctaggaagcattttgtttatagtttctcacctaatgaaggggctggttgacagtgttggtaacagttttttccctgggttatctatctgcaagacatgctctattggcagtataaatggctttgaaattgaatctcacaaatgttactgtagcctattttgttgcccctactgtagacactgctctgccgataaagaaatccataagttgcatttgagcatctgcaaaaaaagaaaagctgggagtaatgtcatgttggccgtctgtaagcgcatgtgttttagggcaactatggaagtgagcaacaaggctctactcatccgaagtgtcatcaacactacttttgttgtatgcatactaatattagcagtttgtgttgttagcacctccgcagtagagatggaaagcctgccagctggcacttgggagagagaggaagacctaacaaacttctgccatcaagaatgccaggtcactgaaactgaatgtctctgtccctatgaagctcttgtactcagaaagcccttatttttagacagtattgctaagggtatgaagaacctgctgaattcaacaagcttagaaacaagcttatcaattgaggcaccatggggagcaataaacgtccaatctactttcaaacctactgtgtcaactgcaaacatagcacttagttggagctcagtggaacacagaggtaataagatcttggtttcaggcagatcagagtcaatcatgaagctagaagaaagaacaggaatcagctgggatttgggagtagaagatgcctctgagtccaaattacttactgtttccgtcatggacttatcacagatgtactctcctgtctttgagtacctatcaggtgacagacaagtagaggaatggccaaaggcaacctgtacaggcgattgcccggaaagatgtggctgcacatcatcaacctgcctacacaaggaatggcctcactcaagaaactggagatgcaaccccacttggtgttggggagtcggcaccggatgcacctgttgtggactagatgtaaaggacctttttacagattacatgtttgttaaatggaaggtcgaatatataaaaacagaggctatagtgtgtgttgagcttactagccaagaaagacaatgtagcttgattgaggcaggcacaagattcaacttaggtcctgtgactatcacattatcagagccaagaaacattcagcaaaagctccctccagaaattgtcacattacatcctagaattgaagaaggtttttttgacttaatgcatgtacagaaggtactatcagcaagcacagtgtgcaagctacagagttgcacacatggcgtaccaggagacttacaggtctaccacatcggaaacttactaaaaggagacaaagtgaatgggcatctgatacataaagttgaaccacatttcaacacctcctggatgtcttgggacggctgtgacctagattactactgcaatatgggggattggccctcttgcacgtatactggagttacccaacataatcatgctgcatttgtaaacctacttaacattgaaactgattacacaaagaacttccactttcactctaagagagtcactgcacatggggacactccacaattagatttaaaagccagaccaaattatggtgcaggtgaaatcactgtgctggtggaagttgctgacatggagttacacacaaagaaaattgagatatcaggtttgaagtttgcaagcctaacctgcacaggttgttatgcttgtagctctggcatctcatgtaaggttaggatccatgtagatgaaccagatgagcttacagtacatgtgaagagtgaagacccagacatagttgctgctagctcaagtctcatggcaagaaagcttgaattcgggacggatagtacattcaaagccttctcagccatgcctaaaacctccttgtgcttttacattgttgagagagaatactgtaaaagctgcagtaaagaagacacacaaaagtgtgttaacgcaaagcttgagcgaccacagagcattttaattgagcacaaaggaacgataattggaaagcagaacgacacttgcacagctaaagcaagctgctggctagagtcagtcaagagtttcttttatggactaaagaacatgcttagtggcatttttggcaatgttttcatagggattttcttattccttgctccttttatcctgttaatacttttctttatgtttgggtggagaatcctattctgctttaagtgctgcaggagaactagaggcctatttaagtacagacacctcaaagatgatgaagaaaccggttataggaaaatcattgagagactaaacaacaaaaaaggtaaaaacaagctgcttgacggtgaaagattagctgatagaaagatcgctgagctgttctctacaaaaacacacattggctga

SEQ ID NO: 3630 - RNA, 5055 nt, synthetic construct
  misc_feature 1..5055: note = derived and/or modified CDS sequence (wt) from CCHFV(BA66019)__AF350448.1__GP
  source 1..5055: mol_type = other RNA
atgtatacactgttagtgtgtgctgttctctgtccacagctgtggagtctggaagggacccatgttccacacaacgagactaaacacaatggaaccggcatcacagcagcacctggagagagtcaaggccccatgtcgcctgcgagcacagcagtgcccctcacaccggaacccccaaacaccaaacctgcagcatcagccagcgaactggaaagctcgggggaagggcacacctcccttttagccaccacacaaggtctgacttcgccggaggccacgccggagctcccaacaacaaccgacacaggcgtatcaagcacaagcgtcgtcgacattggcacacagatggccaaagacactcccacatcgacagcccacacaagcctgcccagcaatcccagtgcaccatccacagcacaaggcacacatcacactataagaggtctgctgtcagttaccagcaccaagccagaagaagcatcaacaccaacagacccaggaaaggcgggtgcagagaccggcagcccaagaccagccatcagcagaaaaccaaccctctcaccaacagctgaagctcccactgaaatcaacaactctagcacccccaaacaacccgagccctcaatacaaccagcaaccccaagcctagtgatctctccagcacagccagccttcccacagagtgctacttccacagctgctcaagatatatactctagcccaacaaacagatctaaaagaaaccttaagatggaaataattttgactttgtctcaaggtctaaagaagtactacggtaagatacaaaaaactctgggtctcaccttagaagaagacactgaaggtctgctggagtggtgtaagagaaatcttggtctgacctgtgatgataatttcttccaaaagagaatagaagagttttttttgaccggtgaaggctacttcaatgaagttttacagtttaaaacaccaagcacaccaggctccacagaaccgactcatgccgaggcaccaacagttaaaccctttaaatcttactttgctagaggcttccttacaataaactcaggttacttctctgccaagtgctattcatggacttctaactcaggacttcagttgatcaacgtcacccagcatccagccagaatagcagacacacctggacccaagatcactaatctgaagaccatcaattgtataaacttaaaagcatcagtctttaaagagcatagagagatcgaaatcaatgtgcttctcccacaagtcgcggtcaacctctcaaactgccacgttctgatcaaatcacatgtctgtgactactctttagacatcgatgggacaataagactacctcgtatctaccatgaaggaacatttataccaggaacctataaaatagtaatagacaaaagagataagcaaaacgacagatgcaccttggtcaccaattgtgtaataaaaggaagggaggttcgtaaaggccagtcagcattaaggcaatacaggacagaaatcagaataggcaaggcatctgctggctctagaagattgctgtccgaagagtctggtgacgactgcatatctagaactcagctattgaggacagagactgcagaggtccatggtgacaactatggtggtccaggtgacaaaataactatctgtaatggttcaaccattgtggatcaaagacttggcagtgaactggggtgttatactatcaatagagtgaagtcattcaagctatgcgaaaatagtggcacgggaaaatcctgtaagatagataaacacccagttaagtgcaggcagggtttttgcttaaaaattactcaggaaggaaggggccatgtgaagctatcgagaggctcagaagttgtcttagatgcctgcgactcaagctgtgaaataatgataccgaagggcacaggagacatcctagtagactgttcaggtgggcaacaacatttcttaaaagataacttggttgatctaggatgccctaacattccactattaggtaaaatggctatctacatttgcaggatgtcaaatcaccctaaaacaactatggcttttctcttttggtttagtttcggctatgtaataacatgtatattttgtaaaatcattttttacttgttgatagtcgtggggacattggggaaaaagttcaaacagtaccgggagctgaaacctcagacttgtactatatgtgaaacaactcctaccaatgcaatagatgctgaaatgcacgatcttaaatgcagttacaatatatgcccttattgtgcatctagattaacctcggacgggcttgccaggcatgtgacacaatgccctaagcgaaaagagaaagtagaagagactgaactgtacttgaacttggaaagaattccttggattgtcagaaaactactgcaagtgtcagagtctaccggtgtggcactgaaaaggagcagttggctgattgtgttacttgtgctacttacagtttcattgtcaccggttcaatcagcacccattggacatggaaagacaattgaggcatatcagaccagagaggggtacacaagtgtttgcctgtttatgctgggaggcatcttgtttgtggtctcctgcctgatgaaagggctagttgacagtgtcagcaacagctttttccctgggttatctatttgcaaaacctgttctatcggcagtgtaaatggctttgaaattgaatcccataaatgttactgtagcttactttgttgcctttattgtagacattgctctgctgatagggaaatccaccaattgcacttgagcatctgcaaaaaaagaagggcaggaggcaatgtcatgctggctgtctgcaagcgcatgtgcctcagagccactatggaggtaagcaataaggtcctattcatccgaagtattatcaacaccacttttgttatatgcatactggtattggcagtctgtatcgttagcacctccgcagtagagatggaaagcctaccagccggcacttgggaaagggaggaagacctgactaacttctgccaccaggaatgccaagtcacagagactgaatgtctctgtccttacgaggctcttgtactcaggaaacccctattctcagacagtatagtcaagggcatgaaaaacctgctaaattcaactagcttggaaacaagcttatcaattgaagcaccatggggagcaataaacgtccagtcaacctttaaacccaccgtttcaactgcaaacatagcacttagctggagttcagtagaacacagaggtaacaaaattttggtctcaggcagatcagaatcaattatgaagctagaagaaaggacaggaatcagctgggatctgggcgtagaagatgcctctgaatctaagttgcttactgtttctgtcatggatttgtcacagatgtattctcctgtctttgagtacttatcaggtgacagacaggtagaggagtggcccaaagcaacctgcacaggtgattgcccagataggtgtggctgcacatcatcaacctgtttacacaaagaatggccccattcaagaaattggagatgcaaccccacttggtgttggggagtcggcactggatgcacctgctgtggactagatgtgaaagatctttttacagattatatgtttgtcaagtggaaagttgaatacataaagaccgaggccatagtgtgcgttgagctcaatagccaagaaaggcagtgcagcttgattgaggcaggcacaagattcaacttgggtcctgtgaccatcacgttgtcagaaccaagaaacattcagcagaagcttcctcctgaaataatcacattgcatcctagaattgaggaaggtttcttcgatctgatgcatgttcaaaaggtgctgtctgcaagtacagtatgcaagctacaaagctgcacacatggtgtgccaggagacttacagatctaccacattggcaacttgttaaaaggggatagggtaaatgggcatctgattcacaaaattgagccacacttcaacacttcttggatgtcctgggatggctgtgacctagattactactgtaacatgggggattggccctcttgcacatatactggagtgacccaacataaccatgctgcttttgtaaacttacttaacatcgaaactgattacacaaagaacttccattttcattctaaaagggttactgcccatggagacaccccacaactggatcttaaagctagaccaacttacggtgcgggtgaaatcactgttctggtggaggttgctgacatggagttacacacaaaaaagattgcgatatcaggtctgaaatttgcaagtttgacttgcacaggttgctatgcttgtagctctggcatctcctgtaaagtcaggattcatgtggatgaaccagatgagcttacagtacatgtgaaaagtgaagatccggacattgttgcagccagctcaagcctcatggcaaggaagcttgaatttgggacagacagcacattcaaggccttctcagccatgcccaaaacctccttgtgcttctacattgtagagagagaatactgtgagagctgcagcaaagaagacacacagaaatgtgttaacacaaagcttgagcaaccacaaagcattttaattgagcacaaaggaacgataatcggaaagcaaaatgacacttgcacagccaaagcaagctgctggttagagtcagtaaagagttttttttatggattgaagaacatgcttagcggcatcttcggcaacgtttttataggcattttcttattccttgctccttttattctgttaatactcttctttatgtttgggtggagaatcctgttttgctttaagtgttgcagaaggaccagaggcttattcaagtacagatatctcaaggacgacgaagagtctggttacagaagaatcattgaaagattaaacaacaaaaaaggaaaaaacaagttacttgacggtgaaagactagctgacaggaggatcgctgagttgttctctaccaaaacacacattggttaa

SEQ ID NO: 3631 - RNA, 5055 nt, synthetic construct
  misc_feature 1..5055: note = derived and/or modified CDS sequence (wt) from CCHFV(SPU 18/88)__KJ682810.1__GP
  source 1..5055: mol_type = other RNA
atgtacacaccactattgtgtgctattctttgtttgcagctgtggagcttagaaggaatttatggattgtccaacaaaacccaacacaatgacactagtaccataaaggtgcccgaagagagtcaaaaaaccagtctacccgcgaacacagcatcgcccatcacgtcagacccctcctccgccacatccacagcattagccagtggaccagaaggctcaggggacacgagcacctctccatcagtcaccacacaaggcccgaccctactagaaaccacgccagagccccacacaacaattgacatcgatgaatcaagcacagccatcgctgacatcagcacacagacagtcaaggacatccccacaccaacaacccacaccagtttgcccagcactcccagcgcgccaactataccgcaagaagcacatcacactgcaagaggcctactgtcagtcaccagcacaaaaccaggagaaacatcaacaccaacaagcccaggggaagcaagcacagaggccagcagcccacagccaactatcagcgaaacaccatccccccccccaacaacccaagcacccaccgaaatcaacaaccccaacacatccagacagcccatgccctcaacacaaccagcagctcccaactcagtgacccctccagtacagccaaccttctctcagagtgacgtttccacggttgctcaagatatacaccccagcccaacaaacagatctaaaagaaatcttgaaatggaaataattttgactttatctcaaggtttgaagaagtactacggcaaggtactaaaacttctggatcttactttagaagaagacactgaaggcctgttagagtggtgtaagagaaaccttggtctgacctgcgatgacaacttctttcagaagagaatagaagagttttttttaactggtgaaggtcacttcaatgaagtgttgcagttcaaaacaccaagcacactgagccctacggaaccagctcgtgttgagtcaccgacagtagaaccctttaaatcttactttgctaaaggcttcctctcaatggactcaggttacttctccgccaagtgttacccaaagtcatccaattcaggacttcagctgatcaacgtcacccaacattcaattagaataacagacacacctgggcctaagatcactagtctgaaaaccatcaattgcataaacttgaaggcattagtcttcaaagagcatagggagattgaaatcaatgttctcctccctcaagtcgcggtcaatctctcaaactgccatgtgctgatcaaatctcatgcttgtgattactctttagacatcgacgggccggtaagactgccccgtatccaccatgaaggaacttttataccaggaacttacaaaatagttatagacaaaaaaaacaagcagaacgacagatgcactttggtcactaactgtgtgataaaaggaagggaaattcgcaaaggccagtcagtgttaaggcaatacagaacagaaattaagattggcaaagcatcttctggttctagaagactattgtctgaagagtctaatgatgactgtttatcaaggactcagctattgaggacagaaaatgcggaaattcacagtgacaactatggtggtccaggtgacaagataactatctgcaacggttcaactattgtagatcagagactgggcagtgaactaggatgttacactatcaatagagtgaaatcatttaagctctgtgaaaacagtgctacaggtaaatcttgtgaaatagatagcaccccagtcagatgtaggcagggtttttgcttgaaaattactcaggagggaaggggccacgtgaagctatcaagaggctcagaagttgtcttggacgcctgtgattcaagctgtgaaataatgataccaaagggcactggggacatcctagttgactgttcaggtgggcagcaacatttcctaaaagataacctggttgatctaggatgccccaacatcccactgttaggcaaaatggccatctacatttgtagaatgtcaaatcatcccaagacaactatgggtttccttttttggtttagctttggttatgtgataacctgtatactttgtaaagtaatcttctatctattaatagttgtagggacattagggaaaaagttcaaacagtacagagagttaaaacctcagacctgtaccatatgtgaaacgaatcctgttaatgcaatagatgctgagatgcacgacctcaactgtagttacaatatatgtccttattgtgcatctaggctgacctcagatggtcttgccagacatgtaatgcaatgccccaaacggaaggaaaaaatagaagaaaccgaattatatttaaacttagaaagaatcccctgggttgttaggaaattactgcaggtgtcagaatccaccggtgtagcactaaagaggagtagttggctggttatactacttgtgctactcacagtttcattgtcaccagtacaatcagcacctatcagccatggagagacagtcgaagtatatcaaaccagagaagggtacacaagtatttgcctttttgtactagggagcatcctgtttttggtatcctgcctgatgaaggggttggttgacagtgtcggcaatagtttttcccctggcttgtccatttgtaagacatgttctattggcagtataaacggctttgaaattgaatctcacaaatgttactgtagtctgttttgctgcccctactgtaggcactgctctgccgatatagaaatacataagttgcacttaagcatctgcaagaaaagaaaaactgggagtaatgtcatgttagccgtctgtaagcgcatgtgctttagggcaactgtggaagtaagcaataaagctttacttatccgaaacatcatcaacaccacttttgttgtgtgcatactgatattagcagtttgtgttgtcagcacctctgcagtggagatggaaaacctgccagcaggcacttgggaaaaagaggaagacctgacaaatttctgtcatcaggaatgccaggtaactgagactgaatgcctctgtccttatgaagctcttgtgctaaggaaacccttgtttttggacagtattgttaaaggcaagaagaacttgctaaattcaacaagcctagaaacaagcttatcaattgaggcaccatggggggcaataaatgtccagtcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaattgctcactgtctctgttatggacttgtcacaaatgtattctcctgtctttgagtacctatcaggtgatagacaagtggaggaatggcccaaggcaacctgcacaggagattgcccagagagatgcggctgcacgtcatcaacctgcctacacaaggaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgaccatcacattgtcagagccaagaaacattcagcaaaagctccctccagaaatagtcacattgcatcctaggattgaagaaggcttctttgacttaatgcatatacaaaaagtgctatcagcaagtacagtatgcaagctacagagttgcacacatggcgtgccaggagacctacagatctaccacattggaaacttgttaaaaggagacaaggtgaacgggcacctgattcacaaaattgaaccacacttcaacacttcctggatgtcttgggacggctgtgacctagactactactgtaatatgggggattggccatcttgctcatatactggcgtaacccaacacaatcatgctgcatttgtaaacatgctcaacatcgaaactgattatacaaaaaacttccactttcactctaagagagttacagcacatggagacacaccacaattagatttaaaagctagaccaacttatggtgcaggtgaaatcactgtgctggtagaggttgcagacatggagttgcatacaaagaaaattgagatatcaggtttgaagtttgcaagcttaacttgcacaggctgttatgcttgtagttctggtatctcctgtaaggttaggatccatgtagatgaaccagatgagcttacagtacatgtgaagagcgaggacccagacatagttgctgctagttcaagtctcatggctaggaagcttgaatttgggacagatagcacatttaaagccttttcagccatgcccaaaacctccttgtgcttttacattgtggagagggaatactgcaaaagctgtagtaaagaagacacacaaaaatgtgtcaacacaaagcttgaacaaccacaaagcattttaatcgagcacaaagggacgataattgggaagcagaacgacacttgtacaggcaaagcaggttgctggttagagtcaatcaagagttttttttatggactaaagaatatgcttagtggcatttttggcaatgttttcatagggattttcttattcctagctccttttatcatgctaatacttttcttcatgtttggatggaggatcctgttctgctttaagtgttgcagaagaactagaggcctatttaagtatagacacctcaaagacgatgaagaaatcggttacaggaaaatcattgagaggctaaaaaacaaaaaagggaaaaacaaactgcttgatggtgaaagactagctgataggaagatcgctgagctgttctctacaaaaacacacattggctaa

SEQ ID NO: 3632 - RNA, 5055 nt, synthetic construct
  misc_feature 1..5055: note = derived and/or modified CDS sequence (wt) from CCHFV(66019)__AB069669.1__GP
  source 1..5055: mol_type = other RNA
atgtatacactgttagtgtgtgctgttctctgtccacagctgtggagtctggaagggacccatgttccacacaacgagactaaacacaatggaactggcatcacagcagcacctggagagagtcaaggccccatgtcgcctgcgagcacagcagtgcccctcacaccggaacccccaaacaccaaacctgcagcatcagccagcgaactggaaagctcgggggaagggcacacctcccttttagccaccacacaaggtctgacttcgccggaggccacgccggagctcccaacaacaaccgacacaggcgtatcaagcacaagcgtcgtcgacattggcacacagatggccaaagacactcccacatcgacagcccacacaagcctgcccagcaatcccagtgcaccatccacagcacaaggcacacatcacactataagaggtctgctgtcagttaccagcaccaagccagaagaagcatcaacaccaacagacccaggaaaggcgggtgcagagaccggcagcccaagaccagccatcagcagaaaaccaaccctctcaccaacagctgaagctcccactgaaatcaacaactctagcacccccaaacaacccgagccctcaatacaaccagcaaccccaagcctagtgatctctccagcacagccagccttcccacagagtgctacttccacagctgctcaagatatatactctagcccaacaaacagatctaaaagaaaccttaagatggaaataattttgactttgtctcaaggtctaaagaagtactacggtaagatacaaaaaactctgggtctcaccttagaagaagacactgaaggtctgctggagtggtgtaagagaaatcttggtctgacctgtgatgataatttcttccaaaagagaatagaagagttttttttgaccggtgaaggctacttcaatgaagttttacagtttaaaacaccaagcacaccaggctccacagaaccgactcataccgaggcaccaacagttaaaccctttaaatcttactttgctagaggcttccttacaatagactcaggttacttctctgccaagtgctattcaaggacttctaactcaggacttcagttgatcaacgtcacccagcatccagccagaatagcagacacacctggacccaagatcactaatctgaagaccatcaattgtataaacttaaaagcatcagtctttaaagagcatagagagatcgaaatcaatgtgcttctcccacaagtcgcggtcaacctctcaaactgccacgttctgatcaaatcacatgtctgtgactactctttagacatcgatgggacaataagactacctcgtatctaccatgaaggaacatttataccaggaacctataaaatagtaatagacaaaagagataagcaaaacgacagatgcaccttggtcaccaattgtgtaataaaaggaagggaggttcgtagaggccagtcagcattaaggcaatacaggacagaaatcagaataggcaaggcatctgctggctctagaagattgctgtccgaagagtctggtgacgactgcatatctagaactcagctattgaggacagagactgcagaggtccatggtgacaactatggtggtccaggtgacaaaataactatctgtaatggttcaaccattgtggatcaaagacttggcagtgaactggggtgttatactatcaatagagtgaagtcattcaagctatgcgaaaatagtggcacgggaaaatcctgtaagatagataacaccccagttaagtgcaggcagggtttttgcttaaaaattactcaggaaggaaggggccatgtgaagctatcgagaggctcagaagttgtcttagatgcctgcgactcaagctgtgaaataatgataccgaagggcacaggagacatcctagtagactgttcaggtgggcaacaacatttcttaaaagataacttggttgatctaggatgccctaacattccactattaggtaaaatggctatctacatttgcaggatgtcaaatcaccctaaaacaactatggcttttctcttttggtttagtttcggctatgtaataacatgtatattttgtaaaatcattttttacttgttgatagtcgtggggacattggggaaaaagttcaaacagtaccgggagctgaaacctcagacttgtactatatgtgaaacaactcctaccaatgcaatagatgctgaaatgcacgatcttaaatgcagttacaatatatgcccttattgtgcatctagattaacctcggacgggcttgccaggcatgtgacacaatgccctaagcgaaaagagaaagtagaagagactgaactgtacttgaacttggaaagaattccttggattgtcagaaaactactgcaagtgtcagagtctaccggtgtggcactgaaaaggagcagttggctaattgtgttacttgtgctacttacagtttcattgtcaccggttcaatcagcacccattggacatggaaagacaattgaggcatatcagaccagagaggggtacacaagtgtttgcctgtttatgctgggaggcatcttgtttgtggtctcctgcctgatgaaagggctagttgacagtgtcagcaacagctttttccctgggttatctatttgcaaaacctgttctatcggcagtgtaaatggctttgaaattgaatcccataaatgttactgtagcttactttgttgcctttattgtagacattgctctgctgatagggaaatccaccaattgcacttgagcatctgcaaaaaaagaagggcaggaggcaatgtcatgctggctgtctgcaagcgcatgtgcctcagagcaactatggaggtaagcaataaggtcctattcatccgaagtattatcaacaccacttttgttatatgcatactggtattggcagtctgtatcgttagcacctccgcagtagagatggaaagcctaccagccggcacttgggaaagggaggaagacctgacaaacttctgccaccaggaatgccaagtcacagagactgaatgtctctgtccttacgaggctcttgtactcaggaaacccctattctcagacagtatagtcaagggcatgaaaaacctgctaaattcaactagcttggaaacaagcttatcaattgaagcaccatggggagcaataaacgtccagtcaacctttaaacccaccgtttcaactgcaaacatagcacttagctggagttcagtagaacacagaggtaacaaaattttggtctcaggcagatcagaatcaattatgaagctagaagaaaggacaggaatcagctgggatctgggcgtagaagatgcctctgagtctaagttgcttactgtttctgtcatggatttgtcacagatgtattctcctgtctttgagtacttatcaggtgacagacaggtagaggagtggcccaaagcaacctgcacaggtaattgcccagataggtgtggctgcacatcatcaacctgcttacacaaggaatggccccattcaaggaattggagatgcaaccccacttggtgttggggagtcggcactggatgcacctgctgtggactagatgtgaaagatctttttacagattatatgtttgtcaagtggaaagttgaatacataaagaccgaggccatagtgtgcgttgagctcaatagccaagaaaggcagtgcagcttgattgaggcaggcacaagattcaacttgggtcctgtgaccatcacgttgtcagaaccaagaaacattcagcagaagcttccttctgaaataatcacattgcatcctagaattgaggaaggcttcttcgatctgatgcatgttcaaaaggtgctgtctgcaagtacagtatgcaagctacaaagctgcacacatggtgtgccaggagacttacagatctaccacattggcaacttgttaaaaggggatagggtaaatgggcatctgattcacaaaattgagccacacttcaacacttcttggatgtcctgggatggctgtgacctagattactactgtaacatgggggattggccctcttgcacatatactggagtgacccaacataaccatgctgcttttgtaaacttacttaacatcgaaactgattacacaaagaacttccattttcattctaagagagttactgcacatggagacacaccacagctggatttgaaagctagaccaacttacggtgcgggtgaaatcactgtactagtggaggttgctgacatggagttacacacaaaaaagattgcgatatcaggtctgaaatttgcaagtttgacttgcacaggttgctatgcttgtagctctggcatctcctgtaaagtcaggattcatgtggatgaaccagatgagcttacagtacatgtgaaaagtgaagatccggacattgttgcagccagctcaagcctcatggcaaggaagcttgaatttgggacagacagcacattcaaggccttctcagccatgcccaaaacctccttgtgcttctacattgtagagagagaatactgtgagagctgcagcaaagaagacacacagaaatgtgttaacacaaagcttgagcaaccacaaagcattttaattgagcacaaaggaacaataatcggaaagcaaaatgacacttgcacagccaaagcaagctgctggttagagtcagtaaagagttttttttatggattgaagaacatgcttagcggcatcttcggcaacgtttttataggcattttcttattccttgctccttttattctgttaatactcttctttatgtttgggtggagaatcctgttttgctttaagtgttgcagaaggaccagaggcttattcaagtacagatatctcaaggacgacgaagagtctggttacagaagaatcattgaaagattaaacaacaaaaaaggaaaaaacaagttacttgacggtgaaagactagctgacaggaggatcgctgagttgttctctaccaaaacacacattggttaa

SEQ ID NO: 3633 - RNA, 5052 nt, synthetic construct
  misc_feature 1..5052: note = derived and/or modified CDS sequence (wt) from CCHFV(Gaib)__KX013445.1__GP
  source 1..5052: mol_type = other RNA
atgtatataccattagtgtatgctgttatctacctacagctgtatggtttgggaggagcacatgggctgctcaacaagactgaacaaaatgaaacaggcattacagcgacgcacggaagggttcagggccctccatctgcaagcataacattgcctgtcacaccggatcctctttccgccacatcagcagcatcaaccagcggaccagagggttcaggggaggtgcctacatcaccttcaactatcacacaaggcctgacctcatctgaaaacacgccgcagctccccacagcaaccgacacaggtatatcaagcacaagcatcattgatgtcagtacacagacagctggagacacctccacaccaacagcccacacgagtttgcctaacagccctagtgcgccgttcacatcacaagacacacgtcatactgtaaggggtctactgacagtgaccagcaccaagtcggatgaagcatcaacactaacagacccaaaagaagcaagcacagaggccagaagccccagtccatccatcagcagaacaccaaccccatccccaacagtccaagcctccactgaaaacaatacccccagtacccccagacaacccgagcccaccacacggccagctctcccaagtccaacgacctcaccaacacagccaagcctctcacagagcgccacctccgcagccattcaggacatgcatcccagcccaacaaacaggtccagaaggaatcttgagatggaaataattttgactttatctcaaggcctgaagaagtattacggtaagatactaaaacttctggatctcaccctagaagaagatactgagggcctgctagagtggtgcaagagaaatcttgatctgacctgtgatgaaaatttctttctaaagagaatagaagagttttttttgtccggtgagggtcactttaatgaagttttgcagtttaaagcaccaagcacaatgagctccacagaaccgactcatgcagggccaccgacagttgaacctttcaaatcttactttgctaagggcttcctttcaatagattcaggttatttttctgccaaatgttatccaaggacttctaattcaggtcttcagttgatcaatgtcacccagcacacagctagaatagcagacacacctggacccaagatcaccaatgtaaagaccatcaattgtataaacttgaaggcatcagtctttaagaagcatagggaggttgaaatcaatgtgcttctccctcagattgcggtcaacctctcaaactgccacgtcctgatcaaatcacatgtctgtgactattctttaaacttcgatgggatggtgagactaccccgcatccaccatgaaggaacttttatacctggaacttacaaaatagtgatagataggaaaaacaagcaaaatgacagatgcaccttggtcaccaactgtgtaataaaaggaagggaagtccgtaagggccagtcagcactgaggcaatacaggacagagatcaaaattggcgaggcatctattggatctagaagactgctgtccgaagaatccagtgatgactgcatatcaagaactcagctattaaggacagagactgcagaaatccataatgataattatggagggccaggtgacaaaataactatttgtaatggttcaactattgtagatcaaaggctaggcagtgaactgggatgttacactatcaatagagtaaagtcatttaagctatgcgaaaacagtgctacagggaaatcctgtgaaatagatagcatccctgtaaagtgcaggcaagggttttgtttaaaaattactcaggagggaagaggccatgtgaagttgtcaagaggttcagaagttgtcttagatgcctgtgattcaagctgtgaaataatgataccaaaaggcaccggagacatcctagtggactgttcaggtgggcaacaacattttttaaaggataacttgattgacttagggtgtcccaatatcccactgttaggcaaaatggctatctacatttgtagaatgtctaatcatcccaaaacaaccatggcctttctcttttggtttagttttggttatgtgataacctgtatattttgcaaagccatcttttatttgttgataatcgtggggacacttggaaaaaagttcaaacagtatagagagttaaaacctcagacctgtaccatatgtgaaacaactcctgtcaacgcaatagacgctgaaatgcatgatcttaactgcagttacaatatatgcccttattgtgcatctagattaacctcagatggacttgccagacacgttgtgcactgccctaagcggaaggagaaaatagaagagactgaactgtacttaaacttagaaagagttccttgggttgttagaaaactacttcaggtgtctgaatcaactggtgtggcactgaagaggagcagttggctaattgtgctacttgtgctacttacagtctcattgtcaccagttcaatcagcacccatcggtcatggaaagacgattgagacttatcaaactagagaagggtacacaagcatttgtctatttgtactaggtggcatcttgtttatcgtctcttgcctaatgaaggggctggttgacagtgtcggcaataattttttccctgggttaactatctgcaaaacatgttccatcagcagtataaacggctttgaaattgaatcccacaaatgctactgtagtttactttgctgcccttattgtagacactgctctgctgacagagagatacatcagttgcacctaagtatctgcaaaaaaagaaaaacagggagtaatgtcatgttagccgtctgcaagcgcatgtgcttaagggtaactacagaagtaagcaacagggctctattcatccgaagcatcatcaacaccacatttgttatatgcatacttatactagcagtctgcgttatcagcacctccgcagtagagatggaaaacctgccagcaggcacctgggagagagaagaagacctaacaaacttctgtcaccaagaatgtcaagtaacggagactgaatgtctatgtccttacgaagctcttgtgctcaggaaacccctgttctcagacagcatagttaagggcatgaaaaacctgctgaactcaacaagtttagagacaagtttatcaattgaggcaccatggggagcgataaatgtccaatcaacctttaaacctactgtatcaactgcaaatatagcactcagttggagctcaatagagcacagaggcaacaagattctggtctcaggcagatcagagtcaatcatgaagctagaagagaggacaggaatcagctgggacctaggcgtggaagatgcttccgagtctaggttacttactgtttctgttatggatttgtcacaaatgtactctcccgtttttgaatacctgtcaggtgacagacaggtggaggaatggcctaaagcaacctgcacaggcgactgtcctgaaagatgtggatgcacatcgtcaacctgcttacacaaagaatggcctcattcaagaaattggagatgcaatcccacttggtgctggggagttggtaccgggtgcacctgctgtggactagatgtaaaagacctttttacagactatatgtttgtcaaatggaaagtcgagtacataaagacagaggctatagtgtgtgttgaacttacaagccaagaaaggcaatgcagtttgattgaggcaggcacaagattcaacttaggtccagtgaccatcacattgtcagaaccgagaaacattcagcaaaagcttcctcctgaaataatcacattgcaccctagaattgaagaaggcttctttgacctaatgcacgtgcagaaagtgctgtctgctagtacggtgtgtaaactacagagttgcacacacggtgtgccgggggatctacaggtctaccacattggcaatttgttaaaaggggataaggtgaacggacatctgattcacaagattgaaccacacttcaacacttcttggatgtcctgggatggttgtgacctggactactactgcaatatgggggattggccttcctgcacgtatactggagtaacccaacataaccacgccgcatttgtgaacctgctcaacattgaaactgattataccaaaaacttccacttccactctaagagagttactgcacatggagacacaccgcaattggatttgaaggctagaccaacctatggtgcaggcgagatcactgtgctggtagaagttgctgacatggagctacacacaaaaaagattgagatatcaggcctgaaatttgcgagtctaacttgcacaggttgctatgcttgcagctctggcatctcctgtaaagttaggatccatgtagatgaaccagatgagcttacagtgcatgtgaaaagtgaagatccagacatagttgcagctagctcaagtctcatggcaaggaagcttgaatttggtacagacagtacctttaaagccttttcagctatgcccaaaacctctttatgcttttacattgtagagagagaatattgcaagagctgcagtagagaagacacacaaaaatgtgtcagcacaaaacttgagcaaccacagagcattttaattgaacacaaaggaacgataatcggaaaacagaataacacctgcacaactaaaacaacctgttggttggaatcagtaaagagtttcttttatggactaaagaacatgcttagcagtatttttggcaatgttttcgtgggcattttctcattccttgcccctttcatcttactgatacttttcttcatgtttgggtggagaatcctattttgctttaagtgttgcagaaggactagaggcttatttaagtacagacatctcaaagacgatgaagagaccggttataggaggatcattgaaagattaaacaacaaaaaaggaaagagcaagttgcttgatggtgaaaggttggctgataggaagattgctgagctgttctccacaaaaacacacattggatga

SEQ ID NO: 3634 - RNA, 5055 nt, synthetic construct
  misc_feature 1..5055: note = derived and/or modified CDS sequence (wt) from CCHFV(SPU415/85)__DQ211635.1__GP
  source 1..5055: mol_type = other RNA
atgtacacaccactagtgtgtgctgttatctgcctacagctgtggaatctaggaggtactcttgtgttcatcaacaggacccaacacaatgaaacaggcaccgtggcaacacccgaaggaaccctgagacctaggctgcctgtgagcacagcactgcccaccaagtcggaccgcccttctgtcggacccgcagcatcgtccagtggactagagggctcaggggaaccgaatacctccccctcaatcaccacaaaaggcctgaccccgccagagaccacgccagcactccccacagcaaccgacacagatgcatcaagcacaggggtcgtcgatgtcagcacgcagatgaccaaggacatccctatgtcgacggcctacacgaatccacccagcacccctagcgcaccatctacaccacaaggcacacatcacactgcaaggggcctactgtcagtcgctagtacgaagtcagaagaagtatcaatgtcaacaagcccagcaaaaacaagcacagagaccagcagcccacccccagccaccagcgagacaccaaccccctctccaacaactcaggtccccaccggaaacaataaccctaacacctccagacaacctacgccctcagcacagccagcaatgtcaaacccagcaacttctccagcacagccaaacctttcacagagtgccccccccactgctgatcaaggcgtacaccccagcccaacaaacagatccaagaggaaccttgaaatagaaataattttaactttatctcaaggtctgagaaagtactatggcaagatactgaagcttctggaccttaccttagaagaggacactgaaggcctgctagaatggtgtaaaagaaatcttggtctaacctgtgatgataacttctttcagaagagaatagaagagttttttttgactggtgagggttacttcaatgaagtcttacagttcaaggtaccaagcacactgagctccacagagccgactcataccaggccaccaacagttgaacccttcaaatcctacttcgctaaaggcttcctttcaatgaactcaggctacttctctgccaaatgttatccaaggacatctaactcgggacttcagttgatcaatgtcaccaaacattcagctaaaatagcagacacacctggacccaagattactaatttgaagaccatcaattgcataaacttaagggcatcagtcttcaaagaacatagagaggttgagatcaatgtacttctccctcaagttgcagtcaacctctcaaactgccacgcacaaattaaatcgcatgtctgtgactactctttagccactgatgggatggtgagattacctcatatccaccatgaagggactttcataccaggaacttacaaaatagtgatagacaaaaaaaacaagcaaaacgataggtgtaccttggtcacaaattgtgttataaagggaagggaagttcgtaagggccagtctgcattaagacaatacaagacagaaattaggattggcaaggcatcttctggttccagaagactgctgtccgaggagtctgatggtgactgtatatcaagaactcaactattgaggacagagactacagaaatccacagtgacaactatggtggcccaggtgacaaaataactatctgcaatggttcaactattgtagatcaaagactaggcagtgaactggggtgttatactatcaatagggtgaagtcatttaagctttgcgaaaacagtgccacaggaaaatcttgtgaaatagatagcaccccagttaagtgcagacaaggtttttgcttgaaaatcactcaagaagggaggggccacgtgaagctgtcgagaggctcggaaattgtcttggacgcttgcgattcaaactgtgaaataatgataccaaagggcaccggagacatcttagttgactgttcaggtggacaacaacatttcttaaaagataatttgattgatcttggatgtcccaatatcccattattaggcaaaatggccatctacatttgcagaatgtccaatcatcctaaaacaaccatggcctttctcttttggtttagctttggttatgtgataacctgtatactttgtaaggtgatcttttacctattgatagttgcagggacagtaggaaaaaagttcaaacagtatagagagttgagacctcagacctgcaccatatgtgaaacaattcctgtcaatgcaatagatgctgaaatgcatgacctcaactgcagttacaatatatgtccgtattgcgcatctagattaacctcagatggtcttgccagacatgtaatgcaatgccctaagcggaaggaaaaagtagaggaaactgaattatacttaaacctagaaaggattccctgggttgttaggaaattattgcaagtttcagagtctaccggtgtggcattgaagaggagcagttggctgacagtgctgcttgtgttgcttatagtctcattgtcaccggtgcagtcagcacctattggtcatggaaagacaattgaaacatatcaggccagagaagggtacacaagcttctgcctttttatactaggaagcatcttgtttgtagtctcttgcctagtaaagggtctaattgacagtgtcggtaacagctttttccctggattgtccatttgcaagacatgctcgattggcagtataaatggttttgagattgaatcccacaaatgttactgtagtctattttgttgcccttattgtagacactgctctgccgatagagaaatccataagttgcacttgagcatctgcaaaaaaagaaaaactgggagcaatgtcatgttggccgtctgcaagcgcatgtgctttagagcaaccatagaagttagcaatagggctctacttatccggaatatcatcaatactacttttgttgtgtgtatactgacactagcagtttgtgttgtcagcacctctgcagtggagatggaaagtctaccagccggcacttgggagaaagaggaagacctaacaaacttctgtcatcaggaatgccaagtcactgagactgaatgcctctgtccttacgaagcccttgtactcagaaaacccttatttttagacagtattgttaaaggcatgaagaacttgctaaactcaacaagcttggaaacaagcttatcaattgaggcaccatggggtgcaataaatgtccaatcaaccttcaaacccactgtgtcagctgcaaacatagcacttagctggagctcagtggaacacagaggcaacaagattttggtttcaggcaggtcagaatcaatcatgaagctggaggaaaggacaggaatcagctgggatctgggagtagaagacgcctctgagtccaaattgctcaccgtctctgtcatggacttgtcacaaatgtattcccccgtctttgagtacctgtcaggtgatagacaggtagaagagtggcccaaggcgacctgtacaggcgattgcccagaaagatgtggctgcacatcatcaacctgtttgcacaaggaatggccccattcaaggaactggagatgcaaccccacttggtgttggggggtcggcactggatgcacctgttgtgggctagatgtaaaagacctctttacagattacatgtttgtcaagtggaaagttgaatacataaaaacagaggccatagtgtgtgtcgaacttactagccaagaaaggcaatgtagcttgattgaagcaggcacaagattcaatttaggtcctgtgactatcacattatcggagccaagaaacattcagcaaaagctccctccagaaataattacattgcatcctagaattgaagaaggcttttttgacttaatgcatgtgcaaagagtgctgtcagcaagcacagtgtgcaagctacagagttgcacacatggtgtgccaggagacctacaggtctaccacatcggaaacttgttaaaaggagacaaggtaaacgggcatctgattcacaagattgaaccacatttcaacacttcctggatgtcttgggatggctgtgacctagattactactgcaatatgggggattggccttcttgcacatacactggagtaacccaacataaccatgctgcatttgtaaatttgctcaatatcgaaaccgattatacaaaaaactttcattttcactccaagagagttactgcacatggagacacaccacaattagacttgaaggccagaccaacttatggtgcaggggaggttactgtactagtggaggttgctgacatggagctgcacacaaagaaaattgagatatcaggcttgaagtttgcaagtctaacttgcacaggctgctatgcttgtagctctggtatctcctgtaaggtcaagatccatgtagatgaaccagatgagcttacagtacatgtgaagagtgaagacccagacatagttgctgcaggctcaagtctcatggcaaggaagcttgaatttggggcagatagtacattcaaagccttttcagccatgcccaaaacctccttgtgcttttatattgtggagagagaatactgtaagagctgcagtagagaggacacacgaaaatgtgttaacactaagcttgatcgaccacagagcattttgatcgaacataaaggaacgattattggaaagcaaaacaacacatgcacagctaaagcaagctgctggctagagtcagtcaaaagttttttctacggattgaagaatatgcttagtggcattttcggtaatgttttcatagggattttcttattcattgctccttttgtcctgttaatacttttctttatgtttgggtggaggatcctgttctgctttaagtgctgcagaagaaccagaggcctatttaagtacagacacctcaaggacgatgaagaaaccggttacaggaaaatcattgagaggctaaataacaaaaagggaaaaaacaaactacttgatggggaaaggctagctgataggaaaatcgccgagttattctccacaaaatcacatatcggctaa

SEQ ID NO: 3635 - RNA, 5055 nt, synthetic construct
  misc_feature 1..5055: note = derived and/or modified CDS sequence (wt) from CCHFV(SPU 431/85)__KJ682812.1__GP
  source 1..5055: mol_type = other RNA
atgtacacaccactagtgtgtgctgttatctgcctacagctgtggaatctaggaggtactcttgtgtccaccaacaggacccaacacaatgaaacaggcaccgtggcaacacccgaaggaaccctgagacctaggctgcctgtgagcacagcactgcccaccaagtcggaccgcccttctgtcggacccgcagcatcgtccagtggactagagggctcaggggaaccgaatacctccccctcaatcaccacaaaaggcctgaccccgccagagaccacgccagcactccccacagcaaccgacacagatgcatcaagcacaggggtcgtcgatgtcagcacgcagatgaccaaggacatccctatgtcgacggcctacacgaatccacccagcacccctagcgcaccatctacaccacaaggcacacatcacactgcaaggggcctactgtcagtcgctagtacgaagtcagaagaagtatcaatgtcaacaagcccagcaaaaacaagcacagagaccagcagcccacccccagccaccagcgagacaccaaccccctctccaacaactcaggtccccaccggaaacaataaccctaacacctccagacaacctacgccctcagcacagccagcaatgtcaaacccagcaacttctccagcacagccaaacctttcacagagtgccccccccactgctgatcaaggcgtacaccccagcccaacaaacagatccaagaggaaccttgaaatagaaataattttaactttatctcaaggtctgagaaagtactatggcaagatactgaagcttctggaccttaccttagaagaggacactgaaggcctgctagaatggtgtaaaagaaatcttggtctaacctgtgatgataacttctttcagaagagaatagaagagttttttttgactggtgagggttacttcaatgaagtcttacagttcaaggtaccaagcacactgagctccacagagccgactcataccaggccaccaacagttgaacccttcaaatcctacttcgctaaaggcttcctttcaatgaactcaggctacttctctgccaaatgttatccaaggacatctaactcgggacttcagttgatcaatgtcaccaaacattcagctaaaatagcagacacacctggacccaagattactaatttgaagaccatcaattgcataaacttaagggcatcagtcttcaaagaacatagagaggttgagatcaatgtacttctccctcaagttgcagtcaacctctcaaactgccacgcacaaattaaatcgcatgtctgtgactactctttagccactgatgggatggtgagattacctcatatccaccatgaagggactttcataccaggaacttacaaaatagtgatagacaaaaaaaacaagcaaaacgataggtgtaccttggtcacaaattgtgttataaagggaagggaagttcgtaagggccagtctgcattaagacaatacaagacagaaattaggattggcaaggcatcttctggttccagaagactgctgtccgaggagtctgatggtgactgtatatcaagaactcaactattgaggacagagactacagaaatccacagtgacaactatggtggcccaggtgacaaaataactatctgcaatggttcaactattgtagatcaaagactaggcagtgaactggggtgttatactatcaatagggtgaagtcatttaagctttgcgaaaacagtgccacaggaaaatcttgtgaaatagatagcaccccagttaagtgcagacaaggtttttgcttgaaaatcactcaagaagggaggggccacgtgaagctgtcgagaggctcggaaattgtcttggacgcttgcgattcaaactgtgaaataatgataccaaagggcaccggagacatcttagttgactgttcaggtggacaacaacatttcttaaaagataatttgattgatcttggatgtcccaatatcccattattaggcaaaatggccatctacatttgcagaatgtccaatcatcctaaaacaaccatggcctttctcttttggtttagctttggttatgtgataacctgtatactttgtaaggtgatcttttacctattgatagttgcagggacagtaggaaaaaagttcaaacagtatagagagttgagacctcagacctgcaccatatgtgaaacaattcctgtcaatgcaatagatgctgaaatgcatgacctcaactgcagttacaatatatgtccgtattgcgcatctagattaacctcagatggtcttgccagacatgtaatgcaatgccctaagcggaaggaaaaagtagaggaaactgaattatacttaaacctagaaaggattccctgggttgttaggaaattattgcaagtttcagagtctaccggtgtggcattgaagaggagcagttggctgacagtgctgcttgtgttgcttatagtctcattgtcaccggtgcagtcagcacctattggtcatggaaagacaattgaaacatatcaggccagagaagggtacacaagcttctgcctttttatactaggaagcatcttgtttgtagtctcttgcctagtaaagggtctaattgacagtgtcggtaacagctttttccctggattgtccatttgcaagacatgctcgattggcagtataaatggttttgagattgaatcccacaaatgttactgtagtctattttgttgcccttattgtagacactgccctgccgatagagaaatccataagttgcacttgagcatctgcaaaaaaagaaaaactgggagcaatgtcatgttggccgtctgcaagcgcatgtgctttagagcaaccatagaagttagcaatagggctctacttatccggaatatcatcaatactacttttgttgtgtgtatactgacactagcagtttgtgttgtcagcacctctgcagtggagatggaaagtctaccagccggcacttgggagaaagaggaagacctaacaaacttctgtcatcaggaatgccaagtcactgagactgaatgcctctgtccttacgaagcccttgtactcagaaaacccttatttttagacagtattgttaaaggcaggaagaacttgctaaactcaacaagcttggaaacaagcttatcaattgaggcaccatggggtgcaataaatgtccaatcaaccttcaaacccactgtgtcagctgcaaacatagcacttagctggagctcagtggaacacagaggcaacaagattttggtttcaggcaggtcagaatcaatcatgaagctggaggaaaggacaggaatcagctgggatctgggagtagaagacgcctctgagtccaaattgctcaccgtctctgtcatggacttgtcacaaatgtattcccccgtctttgagtacctgtcaggtgatagacaggtagaagagtggcccaaggcgacctgtacaggcgattgcccagaaagatgtggctgcacatcatcaacctgtttgcacaaggaatggccccattcaaggaactggagatgcaaccccacttggtgttggggggtcggcactggatgcacctgttgtgggctagatgtaaaagacctctttacagattacatgtttgtcaagtggaaagttgaatacataaaaacagaggccatagtgtgtgtcgaacttactagccaagaaaggcaatgtagcttgattgaagcaggcacaagattcaatttaggtcctgtgactatcacattatcggagccaagaaacattcagcaaaagctccctccagaaataattacattgcatcctagaattgaagaaggcttttttgacttaatgcatgtgcaaagagtgctgtcagcaagcacagtgtgcaagctacagagttgcacacatggtgtgccaggagacctacaggtctaccacatcggaaacttgttaaaaggagacaaggtaaacgggcatctgattcacaagattgaaccacatttcaacacttcctggatgtcttgggatggctgtgacctagattactactgcaatatgggggattggccttcttgcacatacactggagtaacccaacataaccatgctgcatttgtaaatttgctcaatatcgaaaccgattatacaaaaaactttcattttcactccaagagagttactgcacatggagacacaccacaattagacttgaaggccagaccaacttatggtgcaggggaggttactgtactagtggaggttgctgacatggagctgcacacaaagaaaattgagatatcaggcttgaagtttgcaagtctaacttgcacaggctgctatgcttgtagctctggtatctcctgtaaggtcaagatccatgtagatgaaccagatgagcttacagtacatgtgaagagtgaagacccagacatagttgctgcaggctcaagtctcatggcaaggaagcttgaatttggggcagatagtacattcaaagccttttcagccatgcccaaaacctccttgtgcttttatattgtggagagagaatactgtaagagctgcagtagagaggacacacgaaaatgtgttaacactaagcttgatcgaccacagagcattttgatcgaacataaaggaacgattattggaaagcaaaacaacacatgcacagctaaagcaagctgctggctagagtcagtcaaaagttttttctacggattgaagaatatgcttagtggcattttcggtaatgttttcatagggattttcttattcattgctccttttgtcctgttaatacttttctttatgtttgggtggaggatcctgttctgctttaagtgctgcagaagaaccagaggcctatttaagtacagacacctcaaggacgatgaagaaaccggttacaggaaaatcattgagaggctaaataacaaaaagggaaaaaacaaactacttgatggggaaaggctagctgataggaaaatcgccgagttattctccacaaaatcacatatcggctaa

SEQ ID NO: 3636 - RNA, 5055 nt, synthetic construct
  misc_feature 1..5055: note = derived and/or modified CDS sequence (wt) from CCHFV(8402)__AB069674.1__GP
  source 1..5055: mol_type = other RNA
atgtacacaccacttttgtgtgctgttctttgcttacagctgtggagtttagaagggtctcatggactgtccaacaaaacccaacacagtaatacaagcaccacaaaggcgcctgaagtaagccaggaacttggattgcctgtgagcacagtatcgactatcacgtcagaccctccttccatcacatccgcagtatcagtcagtggatcagaaggctcaggagacacgaacacctctccctcggtcaccacacaaggcccgactttgccagaaaccacgctggaacccctaacaacaaccgacacagatgcatcaagcactgtcgtcgtcgatgtcagcacacagacggtcaaggacacccctatatcaacaacctacacaagtttgcccagtactcccagcgagccaactacaccacagggtacacatcatactgcaaggggtctactgtcagtcaccagcacaaagccagaagaagcatcaacacaagcaaatccaggaaaaataagcatggagaccaatggcccgcgcctagccatcagcgagacaccatccttctctccaacaactcaggctcctaccgaaaacagcaaccccatcacatccaaacagcttatgctctcagcacaaccagtaaccccaaacccaatgacctctccagtacagccagccctctctcagagtgacacgtccacggccatccaagatgtacacccaagcccaacaggcagatctaaaagaaaccttgagatggaaataattttgactttatctcaaggtttgaagaagtactacggcaagatactaaaacttctggaccttactttggaagaagacactgaaggcctgctagagtggtgtaagagaaatcttggtttggtctgtgatgacaacttctttcagaagaggatagaagagttttttttgactgggaagggtcacttcaatgaagtcttacagttcaaaacaccaagcacactaagccccacgggaccagcccgaactgggtcaccaacagtggaaccttttaaatcttacttcgctaaagggttcctttcaatggactcaggctacttctctgccaagtgttatccaagagcatccaattcaggacttcagctgatcaatgtcacccaacattcaactagaataacagacacacctggacccaagatcactaatctgaagaccatcaattgcataaacttaaaggcatcagtctttaaagagcatagagagattgaaatcaatgttcttctccctcaagtcgcagttaacctctcaagctgccacgtgttgatcaaatcgcatgtctgtgactactctttggacattgacgggccagtaagactaccccgcatccaccatgaaggaactttcataccaggaacttacaaaatagttatagacaaaaaaaacaaacaaaatgatagatgcactttggtcaccaactgtgtaataaaaggaagggaaattcgtaagggccagtcagtgttaagacaatacaggacagaaatcaagattggcaaggcatcttctggttccagaagactattgtccgaagagtctggtgatgactgcatatcaagaactcagctattgaggacagagactgcggaaattcacaatgataactatggtggtccaggtgacaagataaccatctgcaatggttcaactgttgtggatcagagattgggcagtgaactggggtgttacactatcaatagagtaaagtcatttaagctttgcgagaacagtgccacaggcaaatcctgtgaaatagatagcaccccagtcaaatgcaggcagggtttctgtttgaaaattactcaggagggaaggggccacgtgaagctatcgagaggttcagaagttgtcctggacgcctgcgattcaagctgtgaaataatgataccaaagggcaccggagacatcctagttgactgttcaggtggacagcaacatttcttaaaagataacttgattgatctaggatgcccaaacatcccactattaggcaagatggctatctacatttgtagaatgtcaaatcatcctaaaacgactatggcttttcttttttggtttagctttggttatgtggtgacctgtatactctgtaaggtcatcttctatctattaatagttgtggggacgttggggaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagatggtcttgccagacatgtaatgcagtgccctaagcggaaggaaaaaatagaagaaaccgaattatacttaaacttggaaagaatcccctgggttgttaggaaattactgcaggtgtcagaatccaccggtgtggcactaaagaggagtagttggctggttgtgctacttgtgttacttacagtttcattgtcaccagtacaatcagcacctatcggccatggaaagacagttgaaacatatcaaaccagagaaggatacacaagtatttgcctctttgtactaggaagcatcttatttatagtctcttgcctaatgaaggggttggttgacagtgttggtaacagttttttccctggtttgtccatttgtaagacatgttctattggcagtgtaaatggctttgagattgaatctcacaaatgttactgtagcctattttgttgtccctactgtagacactgctctgccgatagagaaatacataggttgcacttgagcatctgcaagaaaaggaagactgggagtaatgtcatgctggccgtctgtaagcgcatgtgctttagggcaactgtggaagtaagcaacaaggctctactcatccgaaacatcatcaacaccacttttgttctgtgcatactgatattagcagtttgtgttgtcagcacctccgcagtggagatggaaagcctgccagctggcacttgggagagagaggaagatctgacaaatttctgtcatcaagaatgccaagtcactgagactgaatgcctctgtccctacgaagctcttgtgctcaggaaacccttgttttcagacagcattgtcaaaggcatgaagaacttgctaaattcaacaagcttagaaacaagcttatcaattgaggcaccatggggagcaataaatgtccaatcaaccttcaaacctactgtgtcagctgcgaatatagctcttagttggagctcagtggaacacaggggtaataagattttggtttcaggtagatcagagtcaatcatgaagctagaggaaaggacaggaatcagctgggatctaggggtagaagatgcttctgagtctaaattgcttactgtctctgttatggacttgtcacagatgtactctcctgtctttgagtacctatcaggtgacagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttatcaagtggaaagttgagtacattaaaacagaagctatagtgtgtgttgagcttactagccaagagagacaatgtaccttgattgaggcaggcacaagattcaacttaggtcctgtgaccatcacattgtcagagccaagaaacattcagcaaaagctccctccagagatagttacattgcaccccagaattgaagaaggtttctttgatttaatgcatgtacaaaaggtgctatcagcaagtacagtgtgtaagctacagagttgcacacatggtgtgccaggggacctacaggtctatcacataggaaacttgttaaaaggagacaaggtgaatgggcacctgattcacaaaattgaaccacacttcaacacttcctggatgtcttgggacggctgtgacctagactactactgtaatatgggggattggccatcttgcacatatactggagtaacccagcacaatcatgctgcatttgtaaacatgctcaacatcgaaactgattatacaaaaaacttccactttcactctaagagagttactgcacatggagacacaccacaattagatttgaaagctagaccaacttatggtgcaggtgaaatcactgtgctggtggaagttgctgacatggagttacacacaaagaaaattgagatatcaggtttgaagtttgcaagcttaacttgcacaggctgttatgcttgtagctctggtatctcctgtaaggttagaatccatgtagatgagccagatgagcttacagtacatgtgaagagtgaagacccagacatagttgctgctagctcaagtctcatggctagaaaacttgaatttgggacagatagtacattcaaagccttttcagccatgcccaaaacctccttatgcttttacattgtggagagagaatattgtaaaagctgcagcaaagaagatacacaaaaatgtgtcaacacaaagcttgagcaaccacagagcattttaatcgagcacaaaggaacgataattggtaagcagagcaacacctgcacagctaaagcaagctgttggctagagtcagtcaagagcttcttttatgggctaaagaacatgcttagtggcatttttggcaatgttttcataggggttttcttattctttgctccttttatccttttgatacttttctttatgtttggatggagaatcctgttctgctttaaatgttgcagaagaactagaggcctttttaagtacagacacctcaaggacgatgaagaaaccggttacaggaaaatcattgagagactgaacaacaaaaaagggaaaaacaaactgcttgatggtgaaagattagctgataggaagattgctgagctgttctccacaaagacacacattggctaa

SEQ ID NO: 3637 - RNA, 5055 nt, synthetic construct
  misc_feature 1..5055: note = derived and/or modified CDS sequence (wt) from CCHFV(SPU 383/87)__KJ682806.1__GP
  source 1..5055: mol_type = other RNA
atgtacacaccactattgtgtgctattctttgtttgcagctgtggagcttagaaggaatttatggattgtccaacagaacccaacacaatgacactagtaccataaaggtgcccgaagagagtcaaaaaaccagtctgcccgcgaacacagcatcgcccatcacgtcagaccccccctccaccacatccacagcatcagccagtggaccagaaggctcaggggacacgagcacctctcccccagtcaccacacaaggcccgaccccaccagaaaccacgccagagccccacacaacaattgacatcgataaatcaagcacagccatcgctgacatcagcacacagacagtcaaggacatccccacaccaacaacccacaccagtttgcccagcactctcagcgcgccaactataccgcaagaagcacatcacactgcaaggggcctactgtcaattaccagcacaaaaccaggagaagcatcaacaccaataagcccaggggaagcaagcacagaggccagcagcccacaaccaaccatcagcgagacaccatccccccccccaacagcccaagctcccaccgaaatcaacagccccaacacatccagacagcccatgccctcaacacaaccagcagctcccaactcagtgacccatccagcacagccaactccctctcagagcgacgtccccacggctgctcaagatatacaccccaatccaataaacagatctaaaagaaatcttgaaatggaaataattctgactttgtctcaaggtttgaagaagtactacggcaaggtactaaaacttctggatcttactttagaagaagacactgaaggcctgttagagtcgtgtaagagaaaccttggtctgacctgcgatgacaacttctttcagaagagaatagaagagttttttttaactggtgaaggtcacttcaatgaagtgctgcagttcaaaacaccaagcacactaagccctacggaacctgctcgtgttgagtcaccgacagtagaaccctttaaatcttactttgctaaaggcttcctctcaatggactcaggttatttctctgccaagtgttactcaaagtcatccaattcaggacttcagctgatcaacgtcacccaacatttaattagaataacagacacacctgggcctaagatcactaatctgaaaaccatcaattgcataaacttgaaggcattagtcttcaaagagcatagggagattgaaatcaatgttctcctccctcaagtcgcggtcaacctctcaaactgccatgtgctgatcaaatctcatgtttgtgactactctttagacatcgacgggccggtaagactgccccgtatccaccatgaaggaactttcataccaggaacttacaaaatagttatagataaaaacaacaagcagaacgacagatgcactttggtcactaactgtgtgataaaaggaagggaaattcgcaaaggccagtcagtgttaaggcaatacagaacagaaattaagattggcaaggcatcttctggttctagaagactattgtctgaagagtctaatgatgactgtttatcaaggactcagctattgaggacagagaatgcggaaattcacagtgacaactatggtggtccaggtgacaagataactatctgcaacggttcaactattgtagatcagagattgggcagtgaactagggtgttacactatcaatagagtgaaatcatttaagctctgcgaaaacagtgctacaggtaaatcttgtgaaatagatagcaccccagtcagatgtaggcagggtttctgcttgaaaattactcaggagggaaggggccacgtgaagctatcaagaggctcagaagttgtcttggacgcctgcgactcaagctgtgaaataatgataccaaagggcactggggacatcctagttgactgttcaggtgggcagcaacatttcctaaaagataacctggttgatttaggatgccccaacatcccactgttaggcaaaatggcaatctacatttgtagaatgtcaaatcatcccaagacaactatggctttccttttttggtttagctttggttatgtgataacctgtatactttgtaaagtaatcttctatctattagtagttgtagggacattagggaaaaagttcaaacagtacagagagttaaaacctcagacctgtaccatatgtgaaacgaatcctgttaatgcaatagatgctgagatgcacgacctcaactgcagttacaatatatgtccttattgtgcatctaggttaacctcagatggtcttgccagacatgtaatacaatgccccaaacggaaggaaaaaatagaagaaaccgaattatatttaaacttggaaagaatcccttgggttgttaggaaattactgcaggtgtcagaatccaccggtgtagcactaaagaggagtagttggctggttatactacttgtgctactcacagtttcattgtcaccagtacaatcagcacctatcagccatggagagacagtcgaagtatatcaaaccagagaagggtacacaagtatttgcctttttgtactaggaagcatcctgtttttggtatcctgcctgatgaaggggttggttgacagtgtcggcaatagctttttccctggcttgtccatttgtaagacatgttctattggcagtataaacggctttgaaattgaatctcacaaatgttactgtagcctattttgctgcccctactgtagacactgctctgccgatatagaaatacataggttgcacttgagcatctgcaagaaaaggaaaactgggagtaatgtcatgttagccgtctgtaagcgcatgtgctttagggcaactgtggaagtaagcaataaagctttacttatccgaaacatcatcaacaccacttttgttgtgtgcatactgatattagcagtttgtgttgtcagcacctctgcagtggagatggaaaacctgccagcaggcacttgggaaaaagaggaagacctgacaaatttctgtcatcaggaatgccaggttactgagactgaatgcctctgtccttatgaagctcttgtgctcaggaaacccttgtttttggacagtattgttaagggcatgaagaacttgctaaattcaacaagcctagaaacaagcttatcaattgaggcaccatggggggcaataaatgtccagtcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaattgctcactgtctctgtaatggacttgtcacaaatgtattctcctgtctttgagtacctatcaggtgatagacaagtggaggaatggcccaaggcaacctgcacaggagattgcccagaaagatgcggctgcacgtcatcaacctgcctacacaaggaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgactatcacattgtcagagccaagaaacattcagcagaagctccctccagaaatagtcacattgcatcctaggattgaagaaggcttctttgacttaatgcatatacaaaaagtgctatcagcaagtacagtatgtaagctacagagttgcacacatggcgtgccaggagacctacagatctaccacattggaaacttgttaaaaggagacaaggtgaacgggcacctgattcacaaaattgaaccacacttcaacacctcctggatgtcttgggacggctgtgacctagactactactgtaatatgggggattggccatcttgctcatatactggcgtaacccaacacaatcatgctgcatttgtaaacatgctcaacatcgaaactgattatacaaaaaacttccactttcactctaagagagttacagcacatggagacacaccacaattagatttaaaagctagaccaacttatggtgcaggtgaaatcactgtgctggtagaggttgctgacatggagttgcatacaaagaaaattgagatatcaggtttgaagtttgcaagcttaacttgcacaggctgttatgcttgtagttctggtatctcctgtaaggttaggatccatgtagatgaaccagatgagcttacagtacatgtgaagagcgaggatccagacatagttgctgctagttcaagtctcatggctaggaagcttgaatttgggacagatagcacatttaaagccttttcagccatgcccaaaacctccttgtgcttttacattgtggagagggaatactgcaaaagctgtagtaaagaagacacacaaaaatgtgtcaacacaaagcttgaacaaccacaaagcattttaatcgagcacaaagggacgatatttggaaagcagaacgacacttgtacagccaaagcaagttgctggttagagtcagttaagagttttttttatggactaaagaatatgcttagtggcatttttggcaatgttttcataggggttttcttattcctcgctccttttatcatgctaatacttttcttcatgtttggatggaggatcctgttctgctttaagtgttgcagaagaactagaggcttatttaagtatagacacctcaaagacgatgaagaaatcggttacaggaaaatcattgagaggctaaacaacaaaaaagggaaaaacaaactgcttgacggtgaaagactagctgataggaagattgctgagctgttctctacaaaaacacacattggctaa

SEQ ID NO: 3638 - RNA, 5055 nt, synthetic construct
  misc_feature 1..5055: note = derived and/or modified CDS sequence (wt) from CCHFV(SPU 497/88)__KJ682808.1__GP
  source 1..5055: mol_type = other RNA
atgtacacaccactattgtgtgccattctttgtttgcagctgtggagcttagaaggaatttatggattgtccaacaaaacccaacacaatgacactagtaccataaaggtgcccgaagagagtcaaaaaaccagtctgcccgcgaacatagcatcgcccaccacgtcagaccccccctccgccacatccacagcatcagccagtggaccagaaggctcaggggacacgagcacctctccctcagtcaccacacaaggcccgaccccactagaaatcacgccagagccccacacaacaattgacatcgataaatcaagcacatccatcgctgacatcagcacacggacagtcaaggacatccccacaccaacaacccacaccagtttgcccagcactcccagcgcgccaactataccgcaagaagtacatcacactgcaaggggcctactgtcagtcaccagcacaaaaccagaagaagcatcaacactaacaagcccaggggaagcaagcacagaggccagcagcccacaaccaaccatcagcgagacaccatcccctcccccaacaacccaagctcccaccgaaatcaacaaccccaacacatccagacagcccatgccctcaacacaaccagcagctcccaactcagtgacccctccagtacagccaaccttctctcagagtgacgtttccacggctgctcaagatatacaccccagcccaacaaacagatctaaaagaaatcttgaaatggaaataattttgactttatctcaaggtttgaagaagtactacggcaaggtacttaaacttctggatcttactttagaagaagacactgaaggcctgttagagtggtgtaagagaaaccttggcctaacctgcgatgacaacttctttcagaagagaatagaagagttttttttaactggtgaaggtcacttcaatgaagtgttgcagttcaaaacaccaagcacactaagccctacggaaccagctcgtgttgagtcgccgacagtagaaccctttaaatcttactttgctaaaggcttcctctcaatggactcaggttacttctccgccaagtgttacccaaagtcatccaattcaggacttcagctgatcaatgtcacccaacatttaattaggataacagacacacctgggcctaagatcactaatctgaaaaccatcaattgcataaacttgaaggcattagtcttcaaagagcatagggagattgaaatcaatgttctcctccctcaagtcgcggtcaacctctcaaactgccatgtgctgatcaaatctcatgtttgtgactactctttagacatcgacgggccggtaagactgccccgtatccaccatgaaggaacctttataccaggaacttacaaaatagttatagataaaaaaaccaagcaaaacgacagatgcactttggtcaccaactgtgtgataaaaggaagggaaatccgcaaaggccagtcagtgttaaggcaatacagaacagaaattaaaattggcaaagcatcttctggttctagaagactattgtctgaagagtctaacgatgactgtttatcaaggactcagctattgaggacagagaatgcggaaattcacagtgacaactatggtggtccaggtgacaagataactatctgcaacggttcaactattgtagatcagagactgggcagtgaactagggtgttacaccatcaatagagtgaaatcatttaagctctgcgaaaacagtgctacaggtaaatcttgtgaaatagatagcaccccagtcagatgtaggcagggtttttgcttgaaaattactcaggagggaaagggccacgtgaagctatcaagaggctcagaggttgtcctggacgcctgtgattcaagctgtgaaataatgataccaaagggcacaggggacatcctagttgactgttcaggtgggcagcaacatttcctaaaagataacctggttgatctaggatgccccaacatcccactgttaggcaaaatggccatctacatttgtagaatgtcaaatcatcccaagacaactatggttttccttttttggtttagctttggctatgtgataacctgtatactttgtaaagtaatcttctatctattaatagttgtagggacgttaggaaaaaagttcaaacagtacagagagttaaaacctcagacctgtaccatatgtgaaacaaaccctgttaatgcaatagatgctgagatgcacgacctcaactgcagttacaatatatgtccttattgtgcatctaggttaacctcagatggtcttgccagacatgtaatgcaatgccccaaacggaaggaaaaaatagaagaaaccgaattatatttaaacttagaaagaatcccttgggttgttaggaaattactgcaggtgtcagaatccaccggtgtagcactaaagaggagtagttggctggttatactacttgtgctactcacagtttcattgtcaccagtacaatcagcacctatcagccatggagagacagtcgaagtatatcaaaccagagaagggtacacaagtatttgcctttttgtactaggaggcatcctgtttttggtatcctgcctgatgaaggggttggttgacagtgtcggcaatagttttttccctggcttgtccatttgtaagacatgctctattggcagtataaacggctttgaaattgaatctcacaaatgttactgtagcctattttgctgcccctactgtagacactgctctgccgatatagaaatacacaagttgcacttgagcatctgcaagaaaaggaaaacttggagtaatgtcatgttagccgtctgtaagcgcatgtgctttagggcaactgtggaagtaagcaataaagctttacttatccgaaacatcatcaacaccactttcgttgtgtgcatactgatattagcaatttgtgttgtcagcacctctgcagtggagatggaaaacctgccagcaggcacttgggaaaaggaggaagacctgacaaatttctgtcatcaggaatgccaggtcactgagactgaatgcctctgtccttatgaagctcttgtactcaggaaacccttgtttttggacagtattgttaaaggcatgaggaacttgctaaattcaacaagcctagaaacaagcttatcaattgaggcaccatggggggcaataaatgtccagtcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaactgctcactgtctctgttatggacttgtcacaaatgtattctcctgtctttgaatacctatcaggtgatagacaagtggaggaatggcccaaggcaacctgcacaggagattgcccagaaagatgcggctgcacgtcatcaacctgcctacacaaggaatggccccattcaagaaactggagatgcaaccctacttggtgttggggagtcggcactggatgcacctgttgtgggttggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgaccatcacattgtcagaaccaaggaacattcagcaaaagctccctccagaaatagtcacattgcatcctaggattgaagaaggcttctttgacttaatgcatatacaaaaagtactatcagcaagtacagtatgtaagctacagagttgcacacatggcgtgccaggagacctacagatctaccacattggaaacttgttaaaaggagacaaggtgaacgggcacctgattcacaaaattgaaccacacttcaacacctcctggatgtcttgggacggctgtgacctagactactactgtaacatgggggattggccatcttgctcatatactggcgtaacccaacacaatcatgctgcatttgtaaacatgctcaacatcgaaactgattatacaaaaaacttccactttcactctaagagagttacagcacatggagacacaccacaattagatttaaaagctagaccaacttatggtgcaggtgaaatcactgtgctggtagaggttgctgacatggagttgcatacaaagaaaattgagatatcaggtttgaagtttgcaagcttaacttgcacaggctgttatgcttgtagttctggtatctcctgtaaggttaggatccatgtagatgaaccagatgagcttacagtacatgtgaagagcgaggatccagacatagttgctgctagttcaagtctcatggctaggaagcttgaatttgggacagatagcacatttaaagccttttcagccatgcccaaaacctccttgtgcttttacattgtggagagggaatactgcaaaagctgtagtaaagaagacacacaaaaatgtgtcaacacaaagcttgaacaaccacaaagcattttaatcgagcacaaagggacgataattggaaaacagaacgacacttgtacagccagagcaagttgctggttagagtcaatcaagagttttttttatggactgaagaatatgcttagtggcatttttggcaatgttttcatagggattttcttattcttcgctccttttatcatgctaatacttttctttatgtttggatggaggatcctgttctgctttaagtgttgcagaagaactagaggcttgtttaagtatagacacctcaaagacgatgaagaagtcggttacaggaaaatcattgagaggctaaacaacaaaaaagggaaaaacaaactgcttgacggtgaaagactagctgataggaagatcgctgagctgttctctacaaaaacacacattggctaa

SEQ ID NO: 3639 - RNA, 5055 nt, synthetic construct
  misc_feature 1..5055: note = derived and/or modified CDS sequence (wt) from CCHFV(88166)__AB069675.1__GP
  source 1..5055: mol_type = other RNA
atgtacacaccacttttgtgtgctgttctttgcttacagctgtggagtttagaagggtctcatggactgtccaacaaaacccaacacagtaatacaagcaccacaaaggcgcctgaagtaagccaggaacttggattgcctgtgagcacagtatcgactatcacgtcagaccctccttccatcacatccgcagtatcagtcagtggatcagaaggctcaggagacacgaacacctctccctcggtcaccacacaaggcccgactttgccagaaaccacgctggaacccctaacaacaaccgacacagatgcatcaagcactgtcgtcgtcgatgtcagcacacagacggtcaaggacacccctatatcaacaacctacacaagtttgcccagtactcccagcgagccaactacaccacagggtacacatcatactgcaaggggtctactgtcagtcaccagcacaaagccagaagaagcatcaacacaagcaaatccaggaaaaataagcatggagaccaatagcccgcgcctagccatcagcgagacaccatccttctctccaacaactcaggctcctaccgaaaacagcaaccccatcacatccaaacagcttatgctctcagcacaaccagtaaccccaaacccaatgacctctccagtacagccagctctctctcagagtgacacgtccacggccatccaagatatacacccaagcccaacaggcagatctaaaagaaaccttgagatggaaataattttgactttatctcaaggtttgaagaagtactacggcaagatactaaaacttctggaccttactttggaagaagacactgaaggcctgctagagtggtgtaagagaaatcttggtttggtctgtgatgacaacttctttcagaagaggatagaagagttttttttgactgggaagggtcacttcaatgaagtcttacagttcaaaacaccaagcacactaagccccacgggaccagcccgaactgggtcaccaacagtggaaccttttaaatcttacttcgctaaagggttcctttcaatggactcaggctacttctctgccaagtgttatccaagagcatccaattcaggacttcagctgatcaatgtcacccaacattcaactagaataacagacacacctggacccaagatcactaatctgaagaccatcaattgcataaacttaaaggcatcagtctttaaagagcatagagagattgaaatcaatgttcttctccctcaagtcgcagttaacctctcaagctgccacgtgttgatcaaatcgcatgtctgtgactactctttggacattgacgggccagtaagactaccccgcatccaccatgaaggaactttcataccaggaacttacaaaatagttatagacaaaaaaaacaaacaaaatgatagatgcactttggtcaccaactgtgtaataaaaggaagggaaattcgtaagggccagtcagtgttaagacaatacaggacagaaatcaagattggcaaggcatcttctggttccagaagactattgtccgaagagtctggtgatgactgcatatcaagaactcagctattgaggacagagactgcggaaattcacagtgataactatggtggtccaggtgacaagataaccatctgcaatggttcaactgttgtggatcagagattgggcagtgaactagggtgttacactatcaatagagtaaagtcatttaagctttgcgagaacagtgccacaggcaaatcctgtgaaatagatagcaccccagtcaaatgcaggcagggtttctgtttgaaaattactcaggagggaaggggccacgtgaagctatcgagaggttcagaagttgtcctggacgcctgcgattcaagctgtgaaataatgataccaaagggcactggagacatcctagttgactgttcaggtggacagcaacatttcttaaaagataacttgattgatctaggatgcccaaacatcccactattaggcaagatggctatctacatttgtagaatgtcaaatcatcctaaaacgactatgggttttcttttttggtttagctttggttatgtggtgacctgtatactctgtaaggtcatcttctatctattaatagttgtggggacgttggggaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagatggccttgccagacatgtaatgcagtgccctaagcggaaggaaaaaatagaagaaaccgaattatacttaaacttggaaagaatcccctgggttgttaggaaattactgcaggtgtcagaatccaccggtgtggcactaaagaggagtagttggctggttgtgctacttgtgttacttacagtttcattgtcaccagtacaatcagcacctatcggccatggaaagacagttgaaacatatcaaaccagagaaggatacacaagtatttgcctctttgtactaggaagcatcttatttatagtctcttgcctaatgaaggggttggttgacagtgttggtaacagtttttttcctggtttgtccatttgtaagacatgttctattggcagtgtaaatggctttgagattgaatctcacaaatgttactgtagcctattttgttgtccctactgtagacactgctctgccgatagagaaatacataggttgcacttgagcatctgcaagaaaaggaagacttggagtaatgtcatgctggccgtctgtaagcgcatgtgctttagggcaactgtggaagtaagcaacaaggctctacttatccgaaacatcatcaacaccacttttgttctgtgcatactgatattagcagtttgtgttgtcagcacctccgcagtggagatggaaagcctgccagctggcacttgggagagagaagaagatctgacaaatttctgtcatcaagaatgccaagtcactgagactgaatgcctctgtccctacgaagctcttgtgctcaggaaacccttgttttcagacagcattgtcaaaggcatgaagaacttgctaaattcaacaagcttagaaacaagcttatcaattgaggcaccatggggagcaataaatgtccaatcaaccttcaaacctaccatgtcagctgcgaatatagctcttagttggagctcagtggaacacaggggtaataagattttggtttcaggtagatcagagtcaatcatgaagctagaggaaaggacaggaatcagctggaatctaggggtagaagatgcttctgagtctaaattgcttactgtctctgttatggacttgtcacagatgtactctcctgtctttgagtacctatcaggtgacagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttatcaagtggaaagttgagtacattaaaacagaagctatagtgtgtgttgagcttactagccaagagagacaatgtaccttgattgaggcaggcacaagattcaacttaggtcctgtgaccatcacattgtcagagccaagaaacattcagcaaaagctccctccagagatagttacattgcaccccagaattgaagaaggtttctttgatttaatgcatgtacaaaaggtgctatcagcaagtacagtgtgtaagctacagagttgcacacatggtgtgccaggggacctacaggtctatcacataggaaacttgttaaaaggagacaaggtgaatgggcacctgattcacaaaattgaaccacacttcaacacttcctggatgtcttgggacggctgtgacctagactactactgtaatatgggggattggccatcttgcacatatactggagtaacccagcacaatcatgctgcatttgtaaacatgctcaacatcgaaactgattatacaaaaaacttccactttcactctaagagagttactgcacatggagacacaccacaattagatttgaaagctagaccaacttatggtgcaggtgaaatcactgtgctggtggaagttgctgacatggagttacacacaaagaaaattgagatatcaggtttgaagtttgcaagcttaacttgcacaggctgttatgcttgtagctctggtatctcctgtaaggttagaatccatgtagatgagccagatgagcttacagtacatgtgaagagtgaagacccagacttagttgctgctagctcaagtctcatggctagaaaacttgaatttgggacagatagtacattcaaagccttttcagccatgcccaaaacctccttatgcttttacattgtggagagagaatattgtaaaagctgcagcaaagaagatacacaaaaatgtgtcaacacaaagcttgagcaaccacagagcattttaatcgagcacaaaggaacgataattggtaagcagaacaacacatgcacagctaaagcaagctgttggctagagtcagtcaagagcttcttttatgggctaaagaacatgcttagtggcatttttggcaatgttttcataggggttttcttattctttgctccttttatccttttgatacttttctttatgtttggatggagaatcctgttctgctttaaatgttgcagaagaactagaggcctttttaagtacagacacctcaaggacgatgaagaaaccggttacaggaaaatcattgagagactgaacaacaaaaaagggaaaaacaaactgcttgatggtgaaagattagctgataggaagattgctgagctgttctccacaaagacacacattggctaa

SEQ ID NO: 3640 - RNA, 5055 nt, synthetic construct
  misc_feature 1..5055: note = derived and/or modified CDS sequence (wt) from CCHFV(strain BA88166)__AF338470.1__GP
  source 1..5055: mol_type = other RNA
atgtacacaccacttttgtgtgctgttctttgcttacagctgtggagtttagaagggtctcatggactgtccaacaaaacccaacacagtaatacaagcaccacaaaggcgcctgaagtaagccaggaacttggattgcctgtgagcacagtatcgactatcacgtcagaccctccttccatcacatccgcagtatcagtcagtggatcagaaggctcaggagacacgaacacctctccctcggtcaccacacaaggcccgactttgccagaaaccacgctggaacccctaacaacaaccgacacagatgcatcaagcactgtcgtcgtcgatgtcagcacacagacggtcaaggacacccctatatcaacaacctacacaagtttgcccagtactcccagcgagccaactacaccacagggtacacatcatactgcaaggggtctactgtcagtcaccagcacaaagccagaagaagcatcaacacaagcaaatccaggaaaaataagcatggagaccaatagcccgcgcctagccatcagcgagacaccatccttctctccaacaactcaggctcctaccgaaaacagcaaccccatcacatccaaacagcttatgctctcagcacaaccagtaaccccaaacccaatgacctctccagtacagccagctctctctcagagtgacacgtccacggccatccaagatatacacccaagcccaacaggcagatctaaaagaaaccttgagatggaaataattttgactttatctcaaggtttgaagaagtactacggcaagatactaaaacttctggaccttactttggaagaagacactgaaggcctgctagagtggtgtaagagaaatcttggtttggtctgtgatgacaacttctttcagaagaggatagaagagttttttttgactgggaagggtcacttcaatgaagtcttacagttcaaaacaccaagcacactaagccccacgggaccagcccgaactgggtcaccaacagtggaaccttttaaatcttacttcgctaaagggttcctttcaatggactcaggctacttctctgccaagtgttatccaagagcatccaattcaggacttcagctgatcaatgtcacccaacattcaactagaataacagacacacctggacccaagatcactaatctgaagaccatcaattgcataaacttaaaggcatcagtctttaaagagcatagagagattgaaatcaatgttcttctccctcaagtcgcagttaacctctcaagctgccacgtgttgatcaaatcgcatgtctgtgactactctttggacattgacgggccagtaagactaccccgcatccaccatgaaggaactttcataccaggaacttacaaaatagttatagacaaaaaaaacaaacaaaatgatagatgcactttggtcaccaactgtgtaataaaaggaagggaaattcgtaagggccagtcagtgttaagacaatacaggacagaaatcaagattggcaaggcatcttctggttccagaagactattgtccgaagagtctggtgatgactgcatatcaagaactcagctattgaggacagagactgcggaaattcacagtgataactatggtggtccaggtgacaagataaccatctgcaatggttcaactgttgtggatcagagattgggcagtgaactagggtgttacactatcaatagagtaaagtcatttaagctttgcgagaacagtgccacaggcaaatcctgtgaaatagatagcaccccagtcaaatgcaggcagggtttctgtttgaaaattactcaggagggaaggggccacgtgaagctatcgagaggttcagaagttgtcctggacgcctgcgattcaagctgtgaaataatgataccaaagggcactggagacatcctagttgactgttcaggtggacagcaacatttcttaaaagataacttgattgatctaggatgcccaaacatcccactattaggcaagatggctatctacatttgtagaatgtcaaatcatcctaaaacgactatgggttttcttttttggtttagctttggttatgtggtgacctgtatactctgtaagggcatcttctatctattaatagttgtggggacgttggggaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagatggccttgccagacatgtaatgcagtgccctaagcggaaggaaaaaatagaagaaaccgaattatacttaaacttggaaagaatcccctgggttgttaggaaattactgcaggtgtcagaatccaccggtgtggcactaaagaggagtagttggctggttgtgctacttgtgttacttacagtttcattgtcaccagtacaatcagcacctatcggccatggaaagacagttgaaacatatcaaaccagagaaggatacacaagtatttgcctctttgtactaggaagcatcttatttatagtctcttgcctaatgaaggggttggttgacagtgttggtaacagtttttttcctggtttgtccatttgtaagacatgttctattggcagtgtaaatggctttgagattgaatctcacaaatgttactgtagcctattttgttgtccctactgtagacactgctctgccgatagagaaatacataggttgcacttgagcatctgcaagaaaaggaagacttggagtaatgtcatgctggccgtctgtaagcgcatgtgctttagggcaactgtggaagtaagcaacaaggctctacttatccgaaacatcatcaacaccacttttgttctgtgcatactgatattagcagtttgtgttgtcagcacctccgcagtggagatggaaagcctgccagctggcacttgggagagagaggaagatctgacaaatttctgtcatcaagaatgccaagtcactgagactgaatgcctctgtccctacgaagctcttgtgctcaggaaacccttgtatttagacagcattgtcaaaggcatgaagaacttgctaaattcaacaagcttagaaacaagcttatcaattgaggcaccatggggagcaataaatgtccaatcaaccttcaaacctaccatgtcagctgcgaatatagctcttagttggagctcagtggaacacaggggtaataagattttggtttcaggtagatcagagtcaatcatgaagctagaggaaaggacaggaatcagctggaatctaggggtagaagatgcttctgagtctaaattgcttactgtctctgttatggacttgtcacagatgtactctcctgtctttgagtacctatcaggtgacagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttatcaagtggaaagttgagtacattaaaacagaagctatagtgtgtgttgagcttactagccaagagagacaatgtaccttgattgaggcaggcacaagattcaacttaggtcctgtgatcatcacattgtcagagccaagaaacattcagcaaaagctccctccagagatagttacattgcaccccagaattgaagaaggtttctttgatttaatgcatgtacaaaaggtgctatcagcaagtacagtgtgtaagctacagagttgcacacatggtgtgccaggggacctacaggtctatcacataggaaacttgttaaaaggagacaaggtgaatgggcacctgattcacaaaattgaaccacacttcaacacttcctggatgtcttgggacggctgtgacctagactactactgtaatatgggggattggccatcttgcacatatactggagtaacccagcacaatcatgctgcatttgtaaacatgctcaacatcgaaactgattatacaaaaaacttccactttcactctaagagagttactgcacatggagacacaccacaattagatttgaaagctagaccaacttatggtgcaggtgaaatcactgtgctggtggaagttgctgacatggagttacacacaaagaaaattgagatatcaggtttgaagtttgcaagcttaacttgcacaggctgttatgcttgtagctctggtatctcctgtaaggttagaatccatgtagatgagccagatgagcttacagtacatgtgaagagtgaagacccagacatagttgctgctagctcaagtctcatggctagaaaacttgaatttgggacagatagtacattcaaagccttttcagccatgcccaaaacctccttatgcttttacattgtggagagagaatattgtaaaagctgcagcaaagaagatacacaaaaatgtgtcaacacaaagcttgagcaaccacagagcattttaatcgagcacaaaggaacgataattggtaagcagaacaacacatgcacagctaaagcaagctgttggctagagtcagtcaagagcttcttttatgggctaaagaacatgcttagtggcatttttggcaatgttttcataggggttttcttattctttgctccttttatccttttgatacttttctttatgtttggatggagaatcctgttctgctttaaatgttgcagaagaactagaggcctttttaagtacagacacctcaaggacgatgaagaaaccggttacaggaaaatcattgagagactgaacaacaaaaaagggaaaaacaaactgcttgatggtgaaagattagctgataggaagattgctgagctgttctccacaaagacacacattggctaa

SEQ ID NO: 3641 - RNA, 5055 nt, synthetic construct
  misc_feature 1..5055: note = derived and/or modified CDS sequence (wt) from CCHFV(SPU 130/89)__KJ682807.1__GP
  source 1..5055: mol_type = other RNA
atgtacacaccactattgtgtgctattctttgtttgcagctgtggagcttagaaggaatttatggattgtccaacaaaacccaacacaatgacaatagtaccacaaaggcgcccgaagagagtcacaaaaccagtctgcccgcgaacacagcatcgcccatcacgtcagatcccccctccaccacatccacaacatcagccagtggtccagaaggctcaggggacacgagcacctctcccccagtcaccacacaaggcccggcctcaccagaaaccacgccagagccccacacaacaattgacatcgataaatcaagcacagccatcgctgacatcagcacacagacagtcaaggacatccccacaccaacaacccacaccagtttgcccagcactctcagcgcgccaactataccgcaagaagcacatcacactgcaaggggcctactgtcagtcaccagacacaaaccaggagaagcatcaaaaccaacaagcccaggggaagcaagcacagaggccagcagctcacaaccaaccatcagcgagacaccatccccccccccaacaacccaagctcccaccgaaatcaacaaccccaacacatccagacagcccatgccctcaacacaaccagcagctcccagctcagtgacccatccagcacagccaaccccatctcagagcgacgtccccacggctgctcaagatatacaccccagcccaacaaacagatctaaaagaaatcttgaaatggaaataatattgactttatctcaaggtttgaagaagtactacggcaaggtactaaaacttctggatcttactttagaagaagacactgaaggcctgttagagtggtgtaagagaaaccttggtctgacctgcgatgacaacttctttcagaagagaatagaagagttttttttaactggtgaaggtcacttcaatgaagtgttgcagttcaaaacaccaagcacgctaagccctacggaacctgctcgtgttgagtcaccgacagtagaaccctttaaatcttactttgctaaaggcttcctctcaatggactcaggttacttctccgccaagtgttacccaaagtcatccaattcaggacttcagctgatcaacgtcacccaacatttaattagaataacagacacacctgggcctaagatcactaatctgaaaaccatcaattgcataaacctgaaggcattagtcttcaaagagcatagggagattgaaatcaatgttctcctccctcaagtcgcggtcaacctctcaaactgccatgtgctgatcaaatctcatgtttgtgactactctttagacatcgacgggccggtaagactgcccagtatccaccatgaaggaacttttataccaggaacttacaaaatagttatagataaaaaaaacaagcagaacgacagatgcactttggtcactaactgtgtaataaaaggaagggaaattcgcaaaggccagtcagtgttgaggcaatacagaacagaaattaagattggcaaggcatcttctggttctagaagactattgtctgaagagcctaattatgactgtttatcaaggactcagctattgaggacagagaatgcggaaattcacagtgacaactatggtggtccaggtgacaagataactatctgcaacggttcaactattgtagatcagagattgggcagtgaactagggtgttacactatcaatagggtgaaatcatttaagctctgcgaaaacagtgctacaggtaaatcttgtgaaatagatagcaccccagtcagatgtaggcagggtttttgcttgaaaattactcaggagggaaggggccacgtgaagctatcaagaggctcagaagttgtcttggacgcctgtgactcaagctgtgaaataatgataccaaagggcactggggacatcctagttgactgttcaggtgggcagcaacatttcctaaaagataacctggttgatttaggatgccccaacatcccactgttaggcaaaatggccatctacatttgtagaatgtcaaatcatcccaagacaaccatggctttccttttttggtttagctttggttatgtgataacctgcatactttgtaaagtaatcttctatctattaatagttgtagggacattaggaaaaaagttcaaacagtacagagagttaaaacctcagacctgtaccatatgtgaaacgaatcctgttaatgcaatagatgctgagatgcatgacctcaactgcagttacaatatatgtccttattgtgcatctaggttaacctcagatggtcttgccagacatgtaatgcaatgccccaaacggaaggaaaaaatagaagaaaccgaattatatttgaacttagaaagaatcccttgggttgttaggaaattactgcaggtgtcagaatccaccggtgtagcactaaagaggagtagttggctggttgtactacttgtgctactcacagtttcattgtcaccagtacaatcagcacctatcagccatggagagacagtcgaagtatatcaaaccagagaagggtacacaagtatttgcctttttgtactaggaagcatcctgtttctggtgtcctgcctgatgaaggggttggttgacagtgtcggcaatagttttttccctggcttgtccatttgtaagacatgttctattggcagtataaacggctttgaaattgaatctcacaaatgttactgtagcctattttgctgcccctactgtagacactgctctgccgatatagaaatacataagttgcacttgagcatctgcaagaaaaggaaaactgggagtaatgtcatgttagccgtctgtaagcgcatgtgctttagggcaactgtggaagtaagcaataaagctttacttatccgaaacatcatcaacaccacttttgttgtgtgcatactgatattagcagtttgtgttgtcagcacctctgcagtggagatggaaaacctgccagcaggcacttgggaaaaagaggaagacctgacaaatttctgtcatcaggaatgccaggtcactgagactgaatgcctctgcccttatgaagctcttgtgctcaggaaacccttgtctttggacagtattgttaaaggcatgaagaacttgctaaattcaacaagcctagaaacaagcttatcaattgaggcaccatggggggcaataaatgtccagtcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaattgctcactgtctctgtaatggacttgtcacaaatgtattctcctgtctttgagtacctatcaggtgatagacaagtggaggaatggcccaaggcaacctgtacaggagattgcccagaaagatgcggctgcacgtcatcaacctgcctacacaaagaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgaccatcacattgtcagagccaagaaacattcagcagaagctccctccagaaatagtcacattgcatcctaggattgaagaaggcttctttgacttaatgcatatacaaaaagtgctatcagcaagtacagtatgtaagctacagagttgcacacatggcgtgccaggagacctacagatctaccacattggaaacttgttaaaaggagacaaggtgaacgggcacctgattcacaaaattgaaccacacttcaacacctcctggatgtcttgggacggctgtgacctagactactactgtaatatgggggattggccatcttgctcatacactggcgtaacccaacacaaccatgctgcatttgtaaacatgctcaacatcgaaactgattatacaaaaaacttccactttcactctaagagagttacagcacatggggacacaccacaattagatttaaaagctagaccaacttatggtgcaggtgaaatcactgtgctggtagaggttgctgacatggagttgcatacaaagaaagttgagatatcaggtttgaagtttgcaagcttaacttgcacaggctgttatgcttgtagttctggtatctcctgtaaggtcaggatccatgtagatgaaccagatgagcttacagtacatgtgaagagcgaggatccagacatagttgctgctagttcaagtctcatggctaggaagcttgaatttgggacagatagcacatttaaagccttttcagccatgcccaaaacctccttgtgcttttacattgtggagagggaacactgcaaaagctgtagtaaagaagacacacaaagatgtgtcaacacaaagcttgaacaaccacaaagcattttaatcgagcacaaagggacgataattggaaagcagaacgacacttgtacagccaaagcaagttgctggttagagtcaattaagagttttttttatggactaaagaatatgcttagtggcatttttggcaatgttttcataggggttttcttattcctcgctccttttatcatactaatacttttcttcatgtttggatggaggatcctgttctgctttaagtgttgcagaagaactagaggcttacttaagtatagacacctcaaagacgatgaggaaatcggttacaggaaaatcattgagaggctaaacaacaaaaaagggaaaaacaaactgcttgacggtgaaagactagctgataggaagatcgctgagctgttctctacaaaaacacacattggctaa

SEQ ID NO: 3642 - RNA, 5052 nt, synthetic construct
  misc_feature 1..5052: note = derived and/or modified CDS sequence (wt) from CCHFV(4701-ST-2009)__KR814872.1__GP
  source 1..5052: mol_type = other RNA
atgcatacactattagtgtgcttcattctttacctacagctatcgggtttaggaggagctcatggacagtcaaacgcaactgaacacaatggaacaaacaccaccacagcacccggcacaagtcaaagtcccaagccacccgcgagcaccactctaccacacacaccagaatcctccaccgtcaaactcaccacaccaacaagcgaaacagaaggctcaggggaaacgaccccacccccaaacaccacccagggcctgcccctaacagggaccacaccagaacgctccgcaacaaccgccacaagcacgtcaagcacagacaacatgaattccaccacacaggtgaccgacaacacccccacatcaacagtcagcataagtccatccagcagctccagcatgccatccacaccacaaggcacacatcatcccgtaaggagtctattgtcagtctcgagccctaagacagtaacaacaccgacaccaatgagccctggagagatgagcccggaaaccagcagtcagcactcagccatgagcagagtaccaaccctctacacagcaacccaggtctccactgagaacaccgatcgcagcacacctagacaatctgagtcctcagtacagccggcaacccaaagcccaataacttccccagcgcaaacaatccttctgatgagtgctgctcctaaagctattcaggacatgcatcccagcccaacaaacaggtccaagaggaaccttgaggtggaaataattttaactctgtctcaaggtctaaagaaatattacggtaaaatactgaagcttctgcaccttaccttggaagaggatactgaaggcctgttagaatggtgtaagagaaaccttgggtcaaattgtgatgatgacttctttcaaaagagaatagaagaattcttcataactggtgagggctacttcaatgaagtcctacaatttaaaacactaagcacactaagccccacggagccgtctcatgtcaggctaccaacagcggagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtactttcataccaggaacttataaaatagtgatagacaggaaaaataagctaaatgaccgatgctcgctagtcactaactgtgtgataaaaggaagagaggttcgtaagggccaatcagtgctgaggcagtacaaaacagaaattaagataggcaaggcatcaacaggctctaggaaactactgtccgaagagccaggtgacgactgcatatcaagaactcagctattgaagacagaaacagcagagatccatgacgacaactatggtggtccaggtgacaaaataactatctgcaatggttcaaccgttgtagatcagagactgggcagtgaactagggtgttataccatcaacagggtgaagtcattcaagctatgcgaaaacagtgccacagggaaaacctgtgagatagacagcactccggttaagtgcaggcaagggttttgtttgaaaatcacccaagagggaaggggccacgtaaaattatccaggggctcagaggttgttttggatgcttgcgactcaagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctggctaggcatgtgacacaatgccctaagcgaaaagagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggtcatggtaagacaatcgaaacatatcagaccagagagggattcacaagtatctgtctctttatgttaggaagcatcctattcatagtttcttgcctggtaaaggggctggttgacagtgtcagtgacagcttcttccccggcctgtctgtctgtaagacatgctctattggcagtataaatggctttgaaattgaatcgcataaatgctactgtagtttattttgctgcccctactgtaggcactgctctgctgacagagaaattcaccagttgcacttgagtatctgcaaaaaaagaaaaacggggagcaatgtcatgctggctgtctgcaagcgcatgtgctttaaggcaaccatagaagcaagcagaagagccctgctcatccgaagcattatcaataccacttttgtaatgtgcattctaacattagcaatctgtgttgttagcacctctgcagtagagatggaagaccttccggcaggcacttgggagagagaggaagacctaacaaatttctgccatcaggaatgccaggtgaccgagacggaatgcctctgtccatacgaagctcttgtgctcaggaaaccccttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgtacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagagtaaacggccatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaatattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaaaaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtggttttttcgtaggcattttgttattccttgcccctttcgtcttgttggtacttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaaggaaaaaacagactgcttgatggtgagaggttggctgataggaaaattgctgagctgttctctacaaaaacacacattggctaa

SEQ ID NO: 3643 - RNA, 5052 nt, synthetic construct
  misc_feature 1..5052: note = derived and/or modified CDS sequence (wt) from CCHFV(36-ST-2014)__KR814857.1__GP
  source 1..5052: mol_type = other RNA
atgcatacactattagtgtgcttcattctttacctacagctgtcgggtttaggaggagctcatggacagtcaaacgcaactgaacacaatggaacaaacaccaccacagtacccggcacaagtcaaagccccaagccacccgcgagcaccactctaccacacacaccagaatcctccaccgtcaaactcaccacaccaacaagcgaaacagaaggctcaggggaaacgaccccacccccaaacaccacccagggcctgcccccaccagggaccacaccagaacgccccgcaacaaccgccacaagcatgtcaagcacagacaacatgaattccaccacacaggtgaccgacaacacccccacatcaacagtcagcataagtccatccagcagccccagcatgccatccacatcacaaggcatacattatcccgtaaggagtctattgtcagtctcgagccctaagacagtaacaacaccgacaccaatgagccctggagagatgagcccggaaaccagcagtcaacactcagccatgagcagaataccaaccctctacacagcaacccaggtctccactgagaacaccaaccgcagcacacctagacaatccgagtcctcagcacagccggcaacccaaagcccaacaacttccccaacgcaaacaatccttctgatgagtgctgctcctaaagctattcaggacatgcatcccagcccaacaaacaggtccaagaggaaccttgaggtggaaataattttaactctgtctcaaggtctaaagaagtattacggtaaaatactgaagcttctgcaccttaccttggaagaggatactgaaggcctgttagaatggtgtaagagaaaccttgggtcaaattgtgatgatgacttctttcaaaagagaatagaagaattcttcataactggtgagggctacttcaatgaagtcctacaatttaaaacactaagcacactaagccccacggagccgtctcatgtcaggctaccaacagcggagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctaaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtactttcataccaggaacttataaaatagtgatagacaaaaaaaataagctaaatgaccgatgctcgctagtcactaactgtgtgataaagggaagagaggttcgtaaaggccaatcagtgctgaggcagtacaaaacagaaattaagataggcaaggcatcaacaggctctaggaaactactgtccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtaaagtcattcaagctatgcgaaaacagtgccacagggaaaacctgtgagatagacagcactccggtcaagtgcaggcaaggtttttgtttgaaaatcacccaagaggggaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaagctcttttttattcattgataattattgggacactaggaaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgaagcagctggctgattgtgctgcttgtgttactcacagtctcattgtcaccggttcaatcagcacctgttggtcatggtaagacaattgaaacatatcagaccagagaaggattcacaaatatctgtctctttatgttaggaagcatcctattcatagtttcttgcctggtaaaggggctggttgacagtgtcagtgacagctttttccccggcctgtctgtctgtaagacatgctctattggcagtataaatggctttgaaattgaatcgcataaatgctactgtagtttattttgctgcccctactgtaggcactgctctgctgacagagaaattcaccagttgcacttgggtatctgcaaaaaaagaaaaacggggagcaatgtcatgctggctgtctgcaagcgcatgtgctttaaggcaaccatagaagcaagcagaagagccttgctcatccgaagcattatcaataccacttttgtaatatgcatcctaacattagcaatctgtgttgttagcacttctgcagtagagatggaaaatcttccagcaggcacttgggagagagaggaagacctgacaaatttctgccatcaggaatgccaggtaagcgagacggaatgcctctgtccatacgaagctcttgtgctcaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccattctaaaagagtcacagcacatggagacacaccacaattagacttaaaagcaaggccgacttacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgatcagccacagagcatactaattgagcacaaagggaccataattggaaagcagaatgacacttgcacagccaaggcaagttgttggctagagtcagtcaagagttttttttatggattgaagaatatgcttggcagtgtttttggtaattttttcgtaggcattttgttattccttgccccctttgtcttgttggtgcttttctttatgtgtggatggaaattcttgttttgctttaagtgttgcaggaggaccagaggcttgtttaagtatagacacctcaaagatgatgaggaaacaggctacagaaggattattgaaagactgaacagcaaaaaaggaaagaacagactgcttgatggtgagaggttggctgataggaaaattgctgagctgttctctacaaaatcacacattggctaa

SEQ ID NO: 3644 - RNA, 5055 nt, synthetic construct
  misc_feature 1..5055: note = derived and/or modified CDS sequence (wt) from CCHFV(Matin)__AF467769.2__GP
  source 1..5055: mol_type = other RNA
atgtacacactactgttgtgtgcaattctttgctcacagctgtggagttcagaaggtattcatggactgtccaacgaaacccaacatggtaatgcaagcaccataaaggcgcccgaagtgagccaaggacttggattgcctgtgagcacagcaccacccattacgtcagaccctccctccatcacatctgcagcgtcagtcagtggaccagaaggttcaggagacacgaacacctctcctccggtcaccacacaaggcttgactttgccagaaaccacactggaactcctcacaacaaccaacacaggtgcatcaagcacagtcatcgtcgatgtcagcacacagacggtcaaggacacccccgtgtcaacagcccacacaagcccgcccggcacccccagcgcgccaaccacaccacagggcacacatcacactgcaaggggtctactgtcagtcaccagcacaaagtcagaagaagcatcaacacaaacaaatccaaaaaaaacaagcatggagaccaacagcccgggcccagccaccagcgaaacaccatccccctctccaacaacccaggcccccaccgaaaacaacaaccccaatacacccaggcagcccacgcccccgacacaaccagcaaccccaagcccagtgacctctccagcactgctagcctcctctcagggtgacacgtctacggctgttcaagatgtacatcccagcccaacaaacagatctaagagaaaccttgagatggagataattttgactttatctcaaggtttgaagaagtactatggcaagatactaaaacttctggaccttactttggaggaagacactgaaggcctgttagagtggtgtaagagaaatcttggtttggtctgtgatgacagcttctttcagaagaggatagaagagttttttttgaccggtgaaggtcacttcaatgaagtcttacagtttaaaacaccaagcacactaagccccacggaaccagctcgagctgggtcaccaacagttgaacccttcaaatcttatttcgccagaggcctcctttcaatggactcaggttacttctctgccaagtgttatccaagagcatccaattcaggacttcagttgatcaacatcacccaacattcagctagaataacagacacacctggacccaagatcactaatctaaaaaccatcaattgcataaacttaaaggcatcaaccttcaaagagcatagagagattgaaatcaatgttcttctccctcaagtcgcagtcaacctctcaagctgccacgtactgatcaaatcgcatgtctgtgactactctttggacattgacgggccagtgagactacctcgtatccaccatgaaggtactttcataccaggaacttacaaaatagttatagacaaaaaaaacaaacagaacgacaggtgcactatagtcaccaactgtgtaataaaaggaagggaaattcgtaagggtcagtcggtgttaagacaatacaagacagaaatcaagattggcaaggcatcttctggttccagaagactgttgtccgaagagtctggtgatgactgtatatcaagaactcagctattgaggacagagactgcggaaattcacagtgatagctatggtggaccaggtgataagataaccatctgcaatggttcaactgttgtagatcagaggttgggcagtgaactagggtgttacactataaatagagtaaagtcatttaagctttgcgagaacagtgccacaggtaaatcctgtgaaatagatagcaccccagttaaatgcaggcagggtttttgcttaaaaattactcaggagggaaggggccacgtgaagctgtcgagaggttcagaagttgtcttggatgcctgtgactcaagctgtgaaataatgataccaaagggcactggagacatcctagttgactgttcaggtgggcagcaacatttcttaaaagataacctgattgatctgggatgccccaacattccactattaggcaaaatggccatctacatttgtagaatgtcaaatcatcccaaaacaactatggtttttcttttttggtttagctttggttatgtaataacctgtatactctgtaaggtcatcttctatctattaatagttgtagggacattagggaaaaagttcaaacagtatagagagttgaaacctcagacctgtaccatatgcgaaacaactcctgttaatgcaatagatgctgaaatgcacgaccttaactgcagttacaatatatgtccttactgtgcatccaggttgacatcagatggtcttgccagacatgtaatgcagtgccccaaacggaaggaaaaaatagaagaaaccgaattatacttaaacttagaaaggatcccttgggttgttaggaaattactgcaggtgtcagaatctaccggtgtggcactaaagaggagtagctggctggttgtgctacttgtgttacttacagtttcactatcaccagtacaatcagcacctatcggccatggaaagacagttgaaacatatcagatcagagaagggtacacaagtgtttgcctttttgtactagggagcatcttgtttatagtctcttgcctaatgaaagggctggttgacagtgacggtaacagttttttccctggtttgtccatttgcaagacatgttctattggcagtataaatggctttgaaattgaatctcacaaatgttactgtagcctattttgttgcccctactgtagacactgctctacagatagagaaatacataaattgcacttgagcatctgcaagaaaaggaaaactggaagtaatgtcatgttggccgtctgtaagcgcatgtgctttagggcaactgtagaagtaagcaacaaggctctactaatccgaagcatcatcaacaccacttttgttgtgtgtatactgatattagcagtttgtgttgtcagtacctccgcagtggagatggaaagcctgccagctggcacttgggagagagaagaagacctgataaatttctgtcatcaggaatgccaagtcactgagactgaatgtctctgtccttacgaagctcttgtgctcagaaaacccttgtttttagacagtattattaagggtatgaagaacttgctaaattcaacaagcttagaaacaagcttatcaattgaggcaccatggggagcaataaatgtccaatcaactttcaaacctactatgtcagctgcgaacatagcgctaagttggagctcagtggaacacagaggtaataagattttggtttcaggcagatcagagtcgatcatgaagctagaggaaaggacaggaatcagctgggatctaggagtagaagatgcctctgagtctaaattgcttactgtatctgttatggacttatcacagatgtattctcctgtctttgagtacttatcaggtgatagacaagtggaggaatggcccaaggcaacctgcacaggcgattgtccagaaagatgtggctgcacatcatcaacctgcctacacaaagaatggccccattcaagaaactggagatgcaatcctacttggtgttggggagtcggcactggatgtacctgctgtgggctagacgtaaaagacctttttactgattacatgtttgtcaagtggaaagttgaatacattaaaacggaagttatagtgtgtgttgagcttactagccaagaaagacaatgtagcttgattgaggcaggcacaagattcaacttaggtcctgtgaccattacattgtcagagccaagaaacattcagcaaaagctccctccagagatagtcacattgcatcccagaattgaagaaggtttctttgatttaatgcatgtacaaaaagtgctatcagcaagtacagtgtgcaagctacagagttgcacacatggtgtgccaggggacctacaggtctaccacataggaaacttgttaaaaggagataaggtgaacgggcacttgattcacaaaattgaaccacacttcaacacttcctggatgtcttgggacggctgtgacctagactactactgtaatatgggggattggccatcttgctcatatactggagtaacccaacacaatcatgctgcatttgtaaacatgctcagcatcgaaactgattatacaaaaaacttccactttcactctaagagagttactgcacatggagacacaccacaattagatctgaaagctaggccaacttacggtgcaggtgaaatcactgtgctggtagaggttgctgacatggaattacatacaaagaaaattgagatatcaggtttgaagtttgcaagcttaacttgcacaggatgttatgcttgtagctctggtatctcctgtaaggttagaatccatgtagatgaaccagatgagcttacagtacatgtgaagagtgaagacccagacatagttgctgctagctcaagtctcatggctagaaagcttgaatttgggacagatagtacattcaaagccttttcagccatgcccaaaacctccttatgcttttacattgtggagagagaatattgtaaaagttgcagtaaagaagacacacaaaaatgtgtcaacacaaagcttgagcaaccacagagcatcttaatcgagcataaagggacgataattggaaagcaaaacgacacctgtacagccaaagcaagctgctggctggagtcagtcaaaagttttttttatggactaaagaacatgcttagtggcatttttggcaatgttttcatagggattttcttattccttgctccttttgcccttttaatacttttctttatgtttggatggagaatcctgttctgctttaaatgttgcagaagaactagaggcctatttaaatacagacacctcaaggacgacgaagaaaccggttacaggaaaatcattgagaggctgaacaacaaaaaaggtaaaaacaaactgctcgacggtgaaagactagctgacaggaagatcgctgagctgttctccacaaaaacacacgttggctaa

SEQ ID NO: 3645 - RNA, 5052 nt, synthetic construct
  misc_feature 1..5052: note = derived and/or modified CDS sequence (wt) from CCHFV(UCCR4405)__KY484029.1__GP
  source 1..5052: mol_type = other RNA
atgcatgcactattagtgtgcttcattctttacctacagctatcgggtttaggaggagctcatagacagtcaaacgcaactgaacacaatggaacaaacaccaccacagcacccggcacaagtcaaagccctaagccacccgtgagcaccactctaccacacacaccagaagcctccaccatcaaactcaccacaccaacaagcgaaacagaaggctcaggggaaacgaccccacccccaaacaccacccagggcctgcccctaccagggaccacaccagaacgctccgcaacaaccgccacaagcacgtcaagcacagacgacatgaattccaccacacagatgaccgacaacacccccacatcaacagtcagcataggtctatccagcagccccagcatgccatccacatcacaaggcatacattatcccgtaaggagtctattgtcagtctcgagccctaagacagcaacaacaccaacaccaatgagccctggagaggtgagcccggaaaccagcagtcagcactcagccatgagcagaataccaaccctctacacagcaacccaggtctccactgagaacaccaaccgcagcatacctagacaatctgagtcctcagtgcagccggcaacccaaagcccaataacttccccagcgcaaacaatccttctgatgagtgctgctcctacagctattcaggacatgcatcccagcccaaaaaacaggtccaagaggaaccttgaggtggaaataattttaactctgtctcaaggtctaaagaaatattacggcaaaatactgaagcttctgcaccttaccttggaagaggatactgaaggcctgttagaatggtgtaagagaaaccttgggtcgaattgtgatgatgacttctttcaaaagagaatagaagaattcttcataactggtgagggctacttcaatgaagtcctacaatttaaaacaccaagcacactaagccccacggagccgtctcatgtcaggctaccaacagcagagcccttcaaatcttacttcgctaagggcttcctttcaatagattctggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtgctttcataccaggaacttataaaatagtgatagacaaaaaaaataagctaaatgaccgatgctcgctagtcactaactgtgtaataaagggaagagaggttcgtaagggccaatcagtgctgaggcagtacaaaacagaaatcaagataggcaaggcatcaacaggctctaggaaactactgtctgaagagccaggtgacgactgcatatcaagaactcagctattgaagacagaaacagcagagatccatgacgacaactatggtggtccaggtgacaaaataactatctgcaatggttcaaccattgtggatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaagtaatgatacctaaaggcactggagatatcctagtagactgttcaggtggacagcagcatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttactcattgataattattgggacactagggaaaaaaatcaagcaatatagggagctgaaacctcaaacttgcaccatatgtgagacagctcctgtcaatgcaatagatgctgaaatgcatgacctcaaatgtagttacaatatatgcccttattgtgcatcaagattgacctctgatgggctagctaggcatgtgacacaatgccctaagcgaaaggagaaagttgaggagactgaactgtacttgaacctggaaagaattccttggatagtcagaaagctattgcaagtgtcagagtccactggtgtagcattgaaacgaagcagttggctgattgtgctgcttgtgttactcacagtctcattgtcaccggttcaatcagcacctgttggtcatggtaagacaattgaaacatatcagaccagagaaggattcacaagtatctgtctctttatgttaggaagcatcctattcatagtctcttgcctagtaaaggggctggttgacagtgtcagtgacagcttcttccccggcctgtctgtctgtaagacatgctctattggcagtataaatggctttgaaattgaatcgcataaatgctactgtagtttattttgctgcccctactgtaggcactactctgctgacagagaaattcaccagttgcacttgagtatctgcaaaaaaaggaaaacggggagcaatgtcatgctggctgtctgcaaacgcatgtgctttaaggcaactatagaagcaagcagaagagccctgctcatccgaagtattatcaacaccacttttgtaatatgtattctaatattagcaatctgtgttgttagcacctctgcagtagagatggaaaaccttccagcaggcacttgggagagagaggaagacctgacaaatttctgccaccaggaatgccaggtgaccgagacggaatgcctctgtccatacgaagctcttgtgctcaggaaacctcttttcttagacagtacagttaaaggtatgaaaaatttgctaaactcaacaagcttggaaacaagcttatcaattgaggcaccatggggagcaataaatgtccagtcaacctttaaaccaacagtatcgactgcaaacatagcactcagttggagctcagtggagcacagaggcaacaagatcttggtcacaggcaggtctgaatcaattatgaaactagaggaaaggacaggagtcagctgggatctaggcgtagaagatgcctctgaatccaaattacttaccgtctccatcatggatttgtcacaaatgtattcccctgtttttgagtacttatcaggagatagacaggttgaagaatggcccaaggcaacctgtacaggtgattgcccagaaaggtgtggctgcacatcatcaacctgcttgcataaagaatggcctcactcaagaaactggagatgtaaccccacttggtgctggggagtaggaaccggctgcacatgctgcggagtggatgtaaaagacctttttacagatcacatgtttgtcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtacaaaaagtgttatctgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactattgcaacatggggaattggccttcttgcacatacacaggagtgacccaacataatcatgctgcatttgtaaatttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctggtttgcacgggttgctatgcttgtagctctggcatttcctgtaaagtcagaattcatgtagatgaaccagatgagctcacagtgcatgtaaagagcagtgatccagatgtggttgcagctagcacaagccttatggcaaggaagcttgaatttgggacagatagcatattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggtgcttttctttatgtttggatggaaaatcttgttttgctttaagtgttgcaggaggaccagaggcttgtttaagtatagacacctcaaagacgatgaggaaacaggctacagaaggattattgaaagactgaatagtaaaaaaggaaaaaacagactgcttgatggtgagaggttggctgataggaaaattgctgagctgttctccacaaaaacacacattggctaa

SEQ ID NO: 3646 - RNA, 5052 nt, synthetic construct
  misc_feature 1..5052: note = derived and/or modified CDS sequence (wt) from CCHFV(Drosdov)__DQ211630.1__GP
  source 1..5052: mol_type = other RNA
atgcatgcactattagtgtgcttcattctttacctacagctatcgggtttaggaggagctcatagacagtcaaacgcaactgaacacaatggaacaaacaccaccacagcacccggcacaagtcaaagccctaagccacccgtgagcaccactctaccacacacaccagaagcctccaccatcaaactcaccacaccaacaagcgaaacagaaggctcaggggaaacgaccccacccccaaacaccacccagggcctgcccctaccagggaccacaccagaacgctccgcaacaaccgccacaagcacgtcaagcacagacgacatgaattccaccacacagatgaccgacaacacccccacatcaacagtcagcataggtctatccagcagccccagcatgccatccacatcacaaggcatacattatcccgtaaggagtctattgtcagtctcgagccctaagacagcaacaacaccaacaccaatgagccctggagaggtgagcccggaaaccagcagtcagcactcagccatgagcagaataccaaccctctacacagcaacccaggtctccactgagaacaccaaccgcagcatacctagacaatctgagtcctcagtgcagccggcaacccaaagcccaataacttccccagcgcaaacaatccttctgatgagtgctgctcctacagctattcaggacatgcatcccagcccaaaaaacaggtccaagaggaaccttgaggtggaaataattttaactctgtctcaaggtctaaagaaatattacggcaaaatactgaagcttctgcaccttaccttggaagaggatactgaaggcctgttagaatggtgtaagagaaaccttgggtcgaattgtgatgatgacttctttcaaaagagaatagaagaattcttcataactggtgagggctacttcaatgaagtcctacaatttaaaacaccaagcacactaagccccacggagccgtctcatgtcaggctaccaacagcagagcccttcaaatcttacttcgctaagggcttcctttcaatagattctggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtgctttcataccaggaacttataaaatagtgatagacaaaaaaaataagctaaatgaccgatgctcgctagtcactaactgtgtaataaagggaagagaggttcgtaagggccaatcagtgctgaggcagtacaaaacagaaatcaagataggcaaggcatcaacaggctctaggaaactactgtctgaagagccaggtgacgactgcatatcaagaactcagctattgaagacagaaacagcagagatccatgacgacaactatggtggtccaggtgacaaaataactatctgcaatggttcaaccattgtggatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaagtaatgatacctaaaggcactggagatatcctagtagactgttcaggtggacagcagcatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttactcattgataattattgggacactagggaaaaaaatcaagcaatatagggagctgaaacctcaaacttgcaccatatgtgagacagctcctgtcaatgcaatagatgctgaaatgcatgacctcaaatgtagttacaatatatgcccttattgtgcatcaagattgacctctgatgggctagctaggcatgtgacacaatgccctaagcgaaaggagaaagttgaggagactgaactgtacttgaacctggaaagaattccttggatagtcagaaagctattgcaagtgtcagagtccactggtgtagcattgaaacgaagcagttggctgattgtgctgcttgtgttactcacagtctcattgtcaccggttcaatcagcacctgttggtcatggtaagacaattgaaacatatcagaccagagaaggattcacaagtatctgtctctttatgttaggaagcatcctattcatagtctcttgcctagtaaaggggctggttgacagtgtcagtgacagcttcttccccggcctgtctgtctgtaagacatgctctattggcagtataaatggctttgaaattgaatcgcataaatgctactgtagtttattttgctgcccctactgtaggcactactctgctgacagagaaattcaccagttgcacttgagtatctgcaaaaaaaggaaaacggggagcaatgtcatgctggctgtctgcaaacgcatgtgctttaaggcaactatagaagcaagcagaagagccctgctcatccgaagtattatcaacaccacttttgtaatatgtattctaatattagcaatctgtgttgttagcacctctgcagtagagatggaaaaccttccagcaggcacttgggagagagaggaagacctgacaaatttctgccaccaggaatgccaggtgaccgagacggaatgcctctgtccatacgaagctcttgtgctcaggaaacctcttttcttagacagtacagttaaaggtatgaaaaatttgctaaactcaacaagcttggaaacaagcttatcaattgaggcaccatggggagcaataaatgtccagtcaacctttaaaccaacagtatcgactgcaaacatagcactcagttggagctcagtggagcacagaggcaacaagatcttggtcacaggcaggtctgaatcaattatgaaactagaggaaaggacaggagtcagctgggatctaggcgtagaagatgcctctgaatccaaattacttaccgtctccatcatggatttgtcacaaatgtattcccctgtttttgagtacttatcaggagatagacaggttgaagaatggcccaaggcaacctgtacaggtgattgcccagaaaggtgtggctgcacatcatcaacctgcttgcataaagaatggcctcactcaagaaactggagatgtaaccccacttggtgctggggagtaggaaccggctgcacatgctgcggagtggatgtaaaagacctttttacagatcacatgtttgtcaaatggaaggttgaatatatgaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtacaaaaagtgttatctgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactattgcaacatggggaattggccttcttgcacatacacaggagtgacccaacataatcatgctgcatttgtaaatttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctggtttgcacgggttgctatgcttgtagctctggcatttcctgtaaagtcagaattcatgtagatgaaccagatgagctcacagtgcatgtaaagagcagtgatccagatgtggttgcagctagcacaagccttatggcaaggaagcttgaatttgggacagatagcatattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggtgcttttctttatgtttggatggaaaatcttgttttgctttaagtgttgcaggaggaccagaggcttgtttaagtatagacacctcaaagacgatgaggaaacaggctacagaaggattattgaaagactgaatagtaaaaaaggaaaaaacagactgcttgatggtgagaggttggctgataggaaaattgctgagctgttctccacaaaaacacacattggctaa

SEQ ID NO: 3647 - RNA, 5052 nt, synthetic construct
  misc_feature 1..5052: note = derived and/or modified CDS sequence (wt) from CCHFV(44-ST-2010)__KR814859.1__GP
  source 1..5052: mol_type = other RNA
atgcatacactattagtgtgcttcattctttacctacagctatcgggtttaggaggagctcatggacagtcaaacgcaactgaacacaatggaacaaacaccaccacagtacccggcacaagtcaaagccccaagccacccgcgagcaccactctaccacacacaccagaatcctccaccgtcaaactcaccacaccaacaagcgaaacagaaggctcaggggaaacgaccccacccccaaacaccacccagggcctgcccccaccagggaccacaccagaacgccccgcaacaaccgccacaagcatgtcaagcacagacaacatgaattccaccacacaggtgaccgacaacacccccacatcaacagtcagcataagtccatccagcagccccagcatgccatccacatcacaaggcatacattatcccgtaaggagtctattgtcagtctcgagccctaagacagtaacaacaccgacaccaatgagccctggagagatgagcccggaaaccagcagtcaacactcagccatgagcagaataccaaccctctacacagcaacccaggtctccactgagaacaccaaccgcagcacacctagacaatccgagtcctcagcacagccggcaacccaaagcccaacaacttccccaacgcaaacaatccttctgatgagtgctgctcctaaagctattcaggacatgcatcccagcccaacaaacaggtccaagaggaaccttgaggtggaaataattttaactctgtctcaaggtctaaagaagtattacggtaaaatactgaagcttctgcaccttaccttggaagaggatactgaaggcctgttagaatggtgtaagagaaaccttgggtcaaattgtgatgatgacttctttcaaaagagaatagaagaattcttcataactggtgagggctacttcaatgaagtcctacaatttaaaacactaagcacactaagccccacggagccgtctcatgtcaggctaccaacagcggagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctaaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtactttcataccaggaacttataaaatagtgatagacaaaaaaaataagctaaatgaccgatgctcgctagtcactaactgtgtgataaagggaagagaggttcgtaaaggccaatcagtgctgaggcagtacaaaacagaaattaagataggcaaggcatcaacaggctctaggaaactactgtccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtaaagtcattcaagctatgcgaaaacagtgccacagggaaaacctgtgagatagacagcactccggtcaagtgcaggcaaggtttttgtttgaaaatcacccaagaggggaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaagatggccatttacatttgcagaatgtcaaatcatcccaggacaaccatggctttcctcctctggttcagttttggctatgtaatcacctgtatattttgcaaagctcttttttattcattgataattattgggacactaggaaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgaagcagctggctgattgtgctgcttgtgttactcacagtctcattgtcaccggttcaatcagcacctgttggtcatggtaagacaattgaaacatatcagaccagagaaggattcacaaatatctgtctctttatgttaggaagcatcctattcatagtttcttgcctggtaaaggggctggttgacagtgtcagtgacagctttttccccggcctgtctgtctgtaagacatgctcttttggcagtataaatggctttgaaattgaatcgcataaatgctactgtagtttattttgctgcccctactgtaggcactgctctgctgacagagaaattcaccagttgcacttgggtatctgcaaaaaaagaaaaacggggagcaatgtcatgctggctgtctgcaagcgcatgtgctttaaggcaaccatagaagcaagcagaagagccttgctcatccgaagcattatcaataccacttttgtaatatgcatcctaacattagcaatctgtgttgttagcacttctgcagtagagatggaaaatcttccagcaggcacttgggagagagaggaagacctgacaaatttctgccatcaggaatgccaggtaagcgagacggaatgcctctgtccatacgaagctcttgtgctcaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccattctaaaagagtcacagcacatggagacacaccacaattagacttaaaagcaaggccgacttacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgatcagccacagagcatactaattgagcacaaagggaccataattggaaagcagaatgacacttgcacagccaaggcaagttgttggctagagtcagtcaagagttttttttatggattgaagaatatgcttggcagtgtttttggtaattttttcgtaggcattttgttattccttgccccctttgtcttgttggtgcttttctttatgtgtggatggaaaatcttgttttgctttaagtgttgcaggaggaccagaggcttgtttaagtatagacacctcaaagatgatgaggaaacaggctacagaaggattattgaaagactgaacagcaaaaaaggaaagaacagactgcttgatggtgagaggttggctgataggaaaattgctgagctgttctctacaaaatcacacattggctaa

SEQ ID NO: 3648 - RNA, 5052 nt, synthetic construct
  misc_feature 1..5052: note = derived and/or modified CDS sequence (wt) from CCHFV(3756-ST-2007)__KR814866.1__GP
  source 1..5052: mol_type = other RNA
atgcatacactattagtgtgcttcattctttacctacagctgtcgggtttaggaggagctcatggacagtcaaacgcaactgaacacaatagaacaaacaccaccacagtacccggcacaagtcaaagccccaagccacccgcgagcaccactctaccacacacaccagaatcctccaccgtcaaactcaccacaccaacaagcgaaacagaaggctcaggggaaacgaccccacccccaaacaccacccagggcctgcccctaccagggaccacaccagaacgctccgcaacaaccgccacaagcacgtcaagcacagacaacatgaataccaccacacaggtgaccgacaacacccccacatcaacagtcagcataagtccatccagcagccccagcatgccatccacatcacaaggcatacattatcccgtaaggagtctattgtcagtctcgagccctaagacagtaacaacaccgacaccaatgagccctggagagatgagcccggaaaccagcagtcagcactcagccatgagcagaataccaaccctctacacagcaacccaggtctccactgagaacatcaaccgcagcacacctagacaatctgagtcctcagtacagccggcaacccaaagcccaataacttccccagcgcaaacaatccttctgatgagtgctgctcctaaagctattcaggacatgcatcccagcccaacaaacaggtccaagaggaaccttgaggtggaaataattttaactctgtctcaaggtctaaagaaatattacggtaaaatactgaagcttctgcaccttaccttggaagaggatactgaaggcctgttagaatggtgtaagagaaaccttgggtcaaattgtgatgatgacttctttcaaaagagaattgaagaattcttcataactggtgagggctacttcaatgaagtcctacaatttaaaacactaagcacactaagccccacggagccgtctcatgtcaggctaccaacagcggagcccttcaaatcttactttgctaagggcttcctttcaatagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtactttcataccaggaacttataaaatagtgatagacagaaaaaataagctaaatgaccgatgctcgctagtcactaactgtgtgataaagggaagagaggttcgtaagggccaatcagtgctgaggcagtacaaaacagaaattaagataggcaaggcatcaacaggctctaggaaactactgtccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccattaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccctggatagtcagaaagctattgcaagtgtcagagtccactggtgtggcattgaaacgaagcagttggctgattgtgctgcttgtgttactcacagtctcattgtcaccggtccaatcagcacctgttggtcatggtaagacaatcgaaacatatcagaccagagaaggattcacaagtatctgtctctttatgttaggaagcatcctattcatagtttcttgcctggtaaaggggctggttgacagtgtcagtgacagcttcttccccggcctgtctgtctgtaagacatgctctattggcagcataaatggctttgaaattgaatcgcataaatgctactgtagtttattttgctgcccctactgtaggcactgctctgctgacagagaaattcaccagttgcacttgagtatctgcaaaaaaagaaaaacggggagcaatgtcatgctggctgtctgcaagcgcatgtgctttaaggcaaccatagaagcaagcagaagagccctgctcatccgaagcattatcaataccacttttgtaatatgcattctaacattagcaatctgtgttgttagcacctctgcagtagagatggaagaccttccagcaggcacttgggagagagaggaagacctaacaaatttctgccatcaggaatgccaggtaaccgagacggaatgcctctgtccatacgaagctcttgtgctcaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgttttcgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacaatgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggcataccaggagatctacaaatttaccacattggcaacttgttgaaaggggatagagtaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcggtcaagagttttttttatggattgaagaatatgcttggcagtgtttttggtagttttttcgtaggcattttgttattccttaccccttttgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaaggaaaaaacagactgcttgatggtgagaggttggctgataggaaaattgctgagctgttctctacaaaaacacacattggctaa

SEQ ID NO: 3649 - RNA, 5052 nt, synthetic construct
  misc_feature 1..5052: note = derived and/or modified CDS sequence (wt) from CCHFV(47-ST-2013)__KR814861.1__GP
  source 1..5052: mol_type = other RNA
atgcatacactattagcgtgcttcattctttacctacagctgtcgggtttaggaggagctcatggacagtcaaacgcaactgaacacaatggaacaaacaccaccacagtacccggcacaagtcaaagccccaaaccacccgcgagcaccactttaccacacacaccagaatcctccaccgtcaaactcaccacaccaacaagcgaaacagaaggctcaggggaaacgaccccacccccaaacaccacccagggcctgcccccaccagggaccacaccagaacgctccgcaacaaccgccacaagcacgtcaagcacagacaacatgaattccaccacacagatgaccggcaacacccccacaccaacagtcaacatgagtccatccagcagccccagcatgccatccacatcacaaggcatacattatcccgtaaggagtctattgtcagtcccgagccccaagacagcaacaacaccgacaccagtgagccctggagagatgagcccggaaaccagcagtcagcactcagccacgagcagaataccaaccctctacacagcaacccaggtttccactgagaacaccaaccgcagcacacctagacaatctaagtcctcagtacagccggcaacccaaagcccaataactcccccagcgcaaacaatccttctgatgagtgctgctcctaaagctattcaggacatgcatcccagcccaacaaacaggtccaagaggaaccttgaggtggaaataattttaactctgtctcaaggtctaaagaaatattacggtaaaatactgaagcttctgcaccttaccttggaagaggatactgaaggcctgttagaatggtgcaagagaaaccttgggtcaaattgtgatgatgacttctttcaaaagagaatagaagaattcttcataactggtgagggctacttcaatgaagtcctacaatttaaaacactaagcacactaagccccacggagccgtctcatgtcaggctaccaacagcggagcccttcaaatcttactacgctaagggcttcctttcattagattcgggttacttctctgccaaatgttatccaagatcatccacttcagggcttcagctgatcaatgtcacccaacacccagctaggatagcagaaacacctggacccaaaacaacaagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattatcctttagacactgacgggccagtgaggcttcctcgcattcaccatgaaggtactttcataccaggaacttataaaatagtgatagacaaaaaaaataagctaaatgaccgatgctcgctagtcactaactgtgtgataaagggaagagaggttcgtaagggccaatcagtgctgaggcagtacaaaacagaaattaagataggcaaggcatcaacaggctctaggaaactactgtccgaagagccaggtgacgactgcatatcaagaactcagctgttgaagacagaaacagcagagatccatgacgacaactatggtggtccaggtgacaaaataactatctgcaatggttcaaccattgtagatcagagactgggtagtgaactagggtgttataccatcaacagggtgaagtcattcaagctatgcaaaaacagtgccacagggaaaacctgtgagatagacagcactccggtcaagtgcaggcaaggtttttgtttgaaaatcacccaagagggaaggggccacgttaaattatccaggggctcagaggttgttttggatgcttgcgactcgagctgtgaaataatgatacctaaaggcactggagatatcctagtagactgctcaggtggacagcaacatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagattgacctctgatgggctagctagacatgtgacacaatgccctaagcgaaaggagaaagttgaggagactgaactgtatttgaacctggaaagaattccttggatagtcagaaagttattgcaagtgtcagagtccactggtgtggcattgaaacgaagcagttggctgattgtgctgcttgtgttactcacagtctcattgtcaccggttcaatcagcacctgttggtcatggtaagacaattgaaacatatcagaccagagaaggattcacaagtatctgtctctttatgttaggaagcatcctattcatagtttcctgcctggtaaaggggctggttgacagtgtcagtgacagcttcttccccggcctgtctgtctgtagaacatgctctattggcagtataaatggctttgaaattgaatcgcacaaatgctactgtagtttattttgctgcccctactgtaggcactgctctgctgacagagaaattcaccagttgcacttgagtatctgcaaaaaaagaaaaacggggagcaatgtcatgctggctgtctgcaagcgcatgtgctttaaggcaaccatagaagcaagcagaagagccctgttcatccggagcattatcaataccacttttgtaacatgcattctaacattagcaatctgtgttgttagcacctctgcagtagagatggaagaccttccagcaggcacttgggagagagaggaagacctgacaaatttctgccatcaggaatgccaggtgaccgagacggaatgcctctgtccatacgaagctcttgtgctcaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcctggtcacaggcaggtctgaatcaattatgaaactagaggaaaggacaggagtcagctgggatctaggtgtagaagatgcctctgaatccaaattacttaccgtctctatcatggatttgtcacaaatgtattcccctgtttttgagtacttatcaggagatagacaggttgaagaatggcccaaggcaacctgcacaggtgaatgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttaggtcctgtgactatcaccctgtctgagccaagaaacattcagcagaagcttccccctgagatcattacgctgcatcccaaaattgaagaaggcttctttgacttgatgcatgtacaaaaagtgttatctgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactactgcaacatgggggattggccttcttgcacatacacaggagtgacccaacataatcatgctgcatttgtaaacttgcttaacattgaaactgattacacaaaaaccttccacttccactctaaaagagtcacagcacatggagacacaccacaattagacttaaaagcaaggccgacctacggtgcaggtgagatcaccgtgctggttgaggttgctgacatggagttgcataccaagaaagttgaggtatcaggcttgaaatttgcaagtctggcttgcacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagtacattcaaggcattttcagctatgcctaaaacctctttatgcttttacattgtggagagggaatactgcaaaagctgcagtgaagatgatacaaaaaaatgtgttgacacaaaacttgaacagccacagagcatactaattgagcacaaagggacaataattggaaagcagaatgatacttgcacagccaaggcaagttgttggctagagtcagtcaagagttttttttatggattgaagaatatgcttggcagtgtttttggtaatttttttgtaggcattttgttattccttgccccttttgtcttgttggtgcttttctttatgtttggatggaaaatcttgttttgctttaagtgttgcaggaggaccagaggcttgtttaagtatagacacctcaaagatgatgaggaaacaggctacagaaggattattgaaagactgaacagcaaaaaagggaaaaacagactgcttgatggtgagaggttggctgataggaaaattgctgagctgttctctacgaaaacacacattggctaa

SEQ ID NO: 3650 - RNA, 5052 nt, synthetic construct
  misc_feature 1..5052: note = derived and/or modified CDS sequence (wt) from CCHFV(1-CR/HU-2015)__KU161584.1__GP
  source 1..5052: mol_type = other RNA
atgcatacactattagtgtgcttcattctttacctacagctgttgggtctaggaggggctcatgaacagtcaaacgcaactgatcacaatagaacaaacaccatcacagcacccagcacaagtcaaaaccccaagccacccgcgagcacaaccccaccacacacaccggaatcatccaccatcaagctcatcacatcaacaggcgaagcagaaggctcaggggaaacgactccacccctaaacaccacccagggcccattcccaccagagaccacatcagaacaccctgcatcaaccgccacaaacacgtcaagcacaaacagcatgaattccaccacacagatgaccgataataccctcacatcaacagtcagcacaagtctatccatcagccccagcacgccatccacatcacaaggcatacattatcccgtaaggagtctattgtcagtctcgagccctaagacagcagcaacaccaacaccaatgagcactagagagatgagctcagaaaccagcagtcagcactcagccatgagcagaacaccaaccttccacacagcaactcaggtctccactgagaacgccaaccgcagcacccctagacagtctgaatcctcagcacagccggcaacccaaagcccaatgacttccccagcgcaatcaatctttctggtgagtgctgctcctacaaccattcagaacatacatcccagcccaacaaacaggtccaagaggaaccttgagatggaaataattttgactctgcctcaaggtctaaagaaatactacggtaaaatactgaagcttctgcaccttaccctagaagaggacactgaaggcctgttagaatggtgtaagagaaaccttggatcgaactgtgatgatgaattcttccaaaagagaatagaagaattcttcataactggtgagggctacttcaatgaggtcctacaatttaaaacactaagcacactaagccccacggagccgtctcatgccaggccaccaacagcggaacccttcaaatcttacttcgctaagggcttcctttcaatagattcaggttacttctctgccaaatgttatccaagatcatccacttcagggcttcagctgattaatattacccaacacccagctaggatagcagaaacacctggtcccaaaacaacgagtctgaaaaccatcaactgtatcaatctaagagcatctgttttcaaagaacacagagaagttgagatcaatgtacttcttcctcagattgcagtcaacctttcaaactgccatgttgtgatcaattcacatgtctgtgattactctttagacactgatgggcctgtgaggcttcctcgcatttaccatgaaggaactttcataccagggacttataaaatagtgatagacaaaaaaaacaagctaaatgaccggtgcacgctagtcactaactgtgtgataaagggaagagaagttcgtaagggccaatcagtgctgaggcaatacaaaacagaaattaagataggcaaggcatcaacaggctctaggaaactactgtccgaagagccaggtgatgactgcatatcaagaactcagctattgaggacagaaacagcagagatccatgacgacaactacggcggtccaggtgacaaaataactatctgcaatggttcaaccatcgtagatcagagactgggcagtgaactagggtgttataccatcaacagggtgaagtcattcaagctatgcgaaaacagcgctacagggaaaacctgtgagatagacagcactccggtcaagtgcaggcaaggtttctgtttaaaaatcacccaagagggaaggggccacgtaaaattatctagaggctcagaggttgtcttggatgcttgcgactcaagctgtgaagtgatgatacctaaaggcaccggagatatcctagtagactgttcaggtggacagcagcattttttaaaagacaacttgattgacctagggtgcccccacatcccgctattgggtaagatggccatttacatttgcagaatgtcaaatcatcctaggacaaccatggcttttctcttctggttcagctttggctatgtgatcacctgtatattttgcaaggctcttttttattcattaataattattgggacactagggaaaaagatcaagcagtatagagaactaaaacctcaaacttgtactatatgtgagacagctcctgtcaatgcaatagatgctgaaatgcatgacctcaactgtagttacaatatatgcccttattgtgcatcaagactgacctctgatgggctagctaggcatgtaacgcaatgccctaagcgaaaggagaaagttgaggagactgaactgtacttgaacctagaaagaattccttggatcgtcagaaagctattgcaagtgtcagagtccactggtgtggccttgaaacgaagcagttggttgattgtgctgcttgtgttactcacagtttcattgtcaccggttcaatcagcacctgttggtcatggtaagacaatcgaaacatatcagaccagagaaggattcacaagtatctgtctctttatgttaggaagcatcctattcatagtctcttgcttggtgaaggggctggttgacagcgtcagtgacagcttcttccccggcctgtctgtctgtaggacatgctctattggcagcataaatggctttgaaattgagtcgcataagtgctactgtagcttattttgctgcccctactgtaggcactgttctgctgacagagaaattcaccagttacacttgagtatctgcaaaaaaagaaaaacggggagcaatgtcatgctggctgtctgcaaacgcatgtgttttagggcaaccatggaggcaagcagaagagccctgctcatccgaagcattatcaataccacttttgtaatatgcattctaacattaacaatctgtgttgtcagcacctctgcagtagagatggaaaaccttccagcaggcacttgggagagagaggaagacctgacaaatttctgtcatcaggaatgccaggtaaccgagacggagtgcctctgtccatacgaagctcttgtgctcaggaaaccccttttcctagacagtatagttaaaggtatgaaaaatttgctaaactcgacaagcttagaaacaagcttatcaattgaggcaccatggggagcaataaatgtccagtcaacctttaaaccaacagtatcaactgcaaacatagcactcagttggagctcagtggagcacagaggcaacaagatcttagtcacaggcaggtctgaatcaattatgaaactagaggaaaggacaggagtcagctgggatctaggcgtagaagatgcctctgaatccaaattacttaccgtctctataatggatttatcacaaatgtattcccctgtttttgagtacttgtcaggagacagacaggttgaagagtggcccaaagcaacttgtacaggtgattgcccagaaaggtgtggctgcacatcatcaacctgcttgcataaagaatggcctcactcaagaaactggagatgtaatcccacttggtgctggggagtaggaaccggctgcacctgttgcggggtggatgtaaaagacctttttacagatcacatgtttgtcaaatggaaggttgaatatataaaaactgaagccatagtatgtgttgagctcaccagccaggaaagacagtgcagtcttattgaggcaggtacaagattcaacttaggccctgtgactatcaccctgtctgagccaagaaacattcagcagaagcttccccctgagatcattacgttgcatcccaaaattgaagaaggcttctttgacttgatgcatgtacaaaaagtgttgtctgcaagtacagtgtgtaaactgcagagttgcacacatggtataccaggagacctacaagtttaccacattggcaacttgttgaaaggggatagagtaaacgggcatctaattcacaaaattgaaccacattttaacacctcttggatgtcctgggatggttgtgatctagactactactgcaacatgggggactggccttcttgcacatacacaggagtgacccagcataatcatgctgcatttgtaaacttgcttaacattgaaactgattacacgaaaaccttccacttccactctaaaagagtcacagcacatggtgacacaccacaattagacttaaaagcaaggccgacctacggtgcaggtgagatcactgtgctggttgaggttgctgacatggagttgcataccaaaaaagttgagatatcaggcttgaaatttgcaagcctggcatgcacgggttgctatgcttgtagctctggcatctcctgtaaagtcagaattcatgtagatgaaccagatgagctcacagtgcatgtaaagagcagtgatccagacgtggttgcagctagcacaagtcttatggcaaggaagcttgaatttgggacagacagcacattcaaggccttttcagctatgcctaaaacctctttatgtttttacattgtggagagagaatactgcaagagctgcagtgaagatgataccaaaaaatgtgttgacacaaaacttgagcagccacagagcatactaattgagcacaaagggacgataattggaaagcagaatgatacttgcacagccaaggcaagctgttggctagagtcagtcaagagttttttttatggattgaagaatatgctcggcagtgtttttggcaatttttttataggcattttgttattccttgccccttttgtcctgttggtgcttttctttatgtttggatggaaaatcttgttttgctttaaatgttgcaggaggaccagaggcttgtttaagtatagacacctcaaagacgatgaggaaacaggctacagaaggattattgaaagactgaacaacaaaaaggggaaaaacagactgcttgatggtgaaaggttggctgataggaaaattgctgagctgttctccacaaaaacacacattggctaa

SEQ ID NO: 3651 - RNA, 5049 nt, synthetic construct
  misc_feature 1..5049: note = derived and/or modified CDS sequence (wt) from CCHFV(3820-ST-2007)__KR814868.1__GP
  source 1..5049: mol_type = other RNA
atgcatacactattagtgtgcttcattctttacctacagctgtcgggtttaggaggagctcatggacagtcaaacgcaactgaacacaatggaacaaacaccaccacagtacccggcacaagtcaaagccccaagccacccgcgagcaccactctaccacacacaccagaatcctccaccgtcaaactcaccacaccaacaagcgaaacagaaggctcaggggaaacgacccccccaaacaccacccagggcctgcccctaccagggaccacaccagaacgctccgcaacaaccgccacaagcacgtcaagcacagacaacatgaattccaccacacaggtgaccgataacacccccacatcaacagtcagcataagtccatccagcagctccagcatgccatccacatcacaaggcatacatcatcccgtaaggagtctattgtcagtctcgagccctaagacagtaacaacaccgacaccaatgagccctggagagatgagcccggaaaccagcagtcagcactcagccatgagcagagtaccaaccctctacacagcaacccagatctccactgagaacaccgaccgcagcacacctagacaatctgagtcctcagtacagccggcaacccaaagcccaataacttccccagcgcaaacaatccttctgatgagtgctgctcctaaagctattcaggacatgcatcccagcccaacaaacaggtccaagaggaaccttgaggtggaaataattttaactctgtctcaaggtctaaagaaatattacggtaaaatactgaagcttctgcaccttaccttggaagaggatactgaaggcctgttagaatggtgtaagagaaaccttgggtcaaattgtgatgatgacttctttcaaaagagaatagaagaattcttcataactggtgagggctacttcaatgaagtcctacaatttaaaacactaagcacactaagccccacggagccgtctcatgtcaggctaccaacagcggagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtactttcataccaggaacttataaaatagtgatagacagaaaaaataagctaaatgaccgatgctcgctagtcactaactgtgtgataaagggaagagaggttcgtaagggccaatcagtgctgaggcagtacaaaacagaaattaagataggcaagacatcaacaggctctaggaaactactgtccgaagagccaggtgacgactgcatatcaagaactcagctattgaagacagaaacagcagagatccatgacgacaactatggtagtccaggtgacaaaatcactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcactgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctggctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcgcagtctcattgtcaccggtccaatcagcacctgttggtcatggtaagacaatcgaaacatatcagaccagagagggattcacaagcatctgtctctttatgttaggaagcatcctattcatagtttcttgcctggtaaaggggctggttgacagtgtcagtgacagcttcttccccggcctgtctgtctgtaagacatgctctattggcagtataaatggctttgaaattgaatcgcataaatgctactgtagtttattttgctgcccctactgtaggcactgctctgctgacagagaaattcaccagttgcacttgagtatctgcaaaaaaagaaaaacggggagcaatgtcatgctggctgtctgcaagcgcatgtgctttaaggcaaccatagaagcaagcagaagagccctgctcatccgaagcattatcaataccacttttgtaatgtgcattctaacattagcaatctgtgttgttagcacctctgcagtagagatggaagaccttccagcaggcacttgggagagagaggaagacctaacaaatttctgccatcaggaatgccaggtgaccgagacggaatgcctctgtccatacgaagctcttgtgctcaggaaaccccttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggacctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagagtaaacggccatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaaaaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtagttttttcgtaggcattttgttattccttgcccctttcgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaaggaaaaaacagactgcttgatggtgagaggttggctgataggaaaattgctgagctgttctctacaaaaacacacattggctaa

SEQ ID NO: 3652 - RNA, 5052 nt, synthetic construct
  misc_feature 1..5052: note = derived and/or modified CDS sequence (wt) from CCHFV(Ast199)__KX056051.1__GP
  source 1..5052: mol_type = other RNA
atgcatacactattagtgtgcttcattctttacctacagctgtcgggtttaggaggagctcatgtacagtcaaacgcaactgaacacaatggaacaaacaccaccacagtacccggcacaagtcaaagccccaagccacccgcgagcaccactctaccacacacaccagaatcctccaccgtcaaactcaccacaccaacaagcgaaacagaaggctcaggggaaacgaccccacccccaaacaccacccagggcctgcccccaccagggaccacaccagaacgccccgcaacaaccgccacaaccacgtcaagcacagacaacatgaactccaccacacaggtgaccgacaacacccccacatcaacagtcagcataagtccatccagcaaccccagcatgccatccacatcacaaggcatacattatcccgtaaggagtctattgtcagtctcgagccccaagacagtaacaacaccgacaccaatgagccctggagagatgagcccggaaaccagcagtcagcactcagccatgagcagaataccaaccctctacacagcagcccaggtctccactgagaacaccaaccgcagcacacctagacaatcagagtcctcagcacagccggcaacccagagcccaacaactttcccagcgcaaacaatccccctgatgagtgctgctcccaaagccattcaggacatgcatcccagcccaacaaacaggtccaagaggaaccttgaggtggaaataattttaactctgtctcaaggtctaaagaagtattacggtaaaatactgaagcttctgcaccttaccttggaagaggatactgaaggcctgttagaatggtgtaagagaaaccttgggtcaaattgtgatgatgacttctttcaaaagagaatagaagaattcttcataactggtgagggctacttcaatgaagtcctacaatttaaaacaccaagcacactaagccccacggagccgtctcatgttaggctaccaacagcagagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgagggtactttcataccaggaacttataaaatagtgatagacaaaaaaaataagctaaatgaccgatgctcgctagtcactaactgtgtgataaagggaagagaggttcgtaagggccaatcagtgctgaggcagtacaaaacagaaattaagataggcaaggcatcaacaggctctaggaaactactgtccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttacaccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgcgaaataatgatacctaaaggcactggagatatcctagtagactgttcaggtggacagcaacatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgatgcagctggctgattgtgctgcttgtgttactcacagtctcattgtcaccggttcaatcagcacctgttggtcatggtaagacaatcgaaacatatcagaccagagaaggattcacaaatatctgtctctttatgttaggaagcatcctattcatagtttcttgcctggtaaaggggctggttgacagtgtcagtgacagcttcttccccggcctatctgtctgtaagacatgctctattggcagtataaatggctttgaaattgaatcgcacaaatgctactgtagtttattttgctgcccctactgtaggcactgctctgctgacagagaaattcaccagctgcacttgggtatctgcaaaaaaagaaaaacggggagcaatgtcatgctggctgtctgcaagcgcatgtgctttaaggcaaccatagaagcaagcagaagagccctactcatccgaagcattatcaataccacttttgtaatatgcatcctaacattagcaatctgtgttgttagcacctctgcagtagagatggaaaatcttccagcaggcacttgggagagagaggaagacctgacaaatttctgccatcaggaatgccaggtaaccgagacggaatgcctctgtccatacgaagctcttgtgctcaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaaggaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgaggtatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttgtgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggtgcttttctttatatttggatggaaaatcttgttttgctttaagtgttgcaggaggaccagaggcttgtttaagtatagacacctcaaagatgatgaggaaacaggctacagaaagattattgaaagactgaacagcaaaaaaggaaaaaacagactgcttgatggtgagaggttggctgataggaaaattgctgagctgttctctacaaaaacacacattggctaa

SEQ ID NO: 3653 - RNA, 5052 nt, synthetic construct
  misc_feature 1..5052: note = derived and/or modified CDS sequence (wt) from CCHFV(Turkey200310849)__DQ211636.1__GP
  source 1..5052: mol_type = other RNA
atgcatacactgttggtgtgcttcattctttacctacagctgttgtgtctaggaggagctcatgggcagttaaacacaactgaacacaatggaacaaacaacaccacagcacctggcgcaagccaaagccccaagccacccatgagcacaaccccaccacacgcaccggaatcatccaccatcaaacccaccacaccaataagcgaagcagaaggctcaggggaaacgacttcaaccccaaacaccacccagggcctgtcctcgccagagaccacatcagaacgccctgcaacaactgccataagcacgtcaagcacagacagcacgaaccccaccacacagatgaccgacaacacccccacactaacagtcagtacaagcccatccagcagccccagcacgccatccacaccacaaggcatatatcatcctgcaaggagtctattgtcagtctcgagccctaagacagtaacaacaccaacaccaacgagccctggagagatgagctcggaaaccagcagtcagcactcagccatgagcagaataccaaccccccacacagcaacccgggtctccactgagaacaccaaccacagcacacctagacaatctgaatcctcagcacagcagacaaccccaagcccaatgacttccccagcgcaatcgatccttctaatgagtgctgctcctacagctgttcaagacatacatcccagcccaacaaacaggtctaagaggaaccttgagacggaaataattttaactctatctcaaggtctaaagaaatactacggtaagatactgaagcttctgcacctcaccttagaagaggacaccgaaggcctgttagaatggtgtaagagaaaccttgggtcaaactgtgatgatgacttctttcaaaagagaatagaagaattcttcatgactggtgagggctacttcaatgaagtcttacaatttaaaacactaagcacactaagccccacggagccgtctcatgccaggctaccaacagcagaacccttcaaatcttactttgctaagggcttcctttcaatagattcaggttacttctctgccaaatgttatccaagatcatctgcttcagggcttcagctgatcaatgttacccaacacccagctaggatagcagaaacacctggacccaagacaacgagtctgaaaaccatcaactgtataaacctaagagcatcagtcttcaaagaacacagagaaattgagatcaatgtgcttcttcctcagattgcagtcaacctctcaaactgccatgttgtgatcaattcacatgtctgtgattactctttagacactgatgggccagtgaggcttcctcgcatttatcatgaagggactttcataccaggaacttataaaatagtgatagacaaaaaaaataagctaaatgaccgttgtacactggtcaccaactgtgtgataaagggaagagaggttcgtaaggggcaatcagtgctgaggcagtacaaaacagaaatcaagataggcaaggcatcaacaggctttaggaaactactgtccgaagagccaggtgatgactgcatatcaagaactcagctattgaggacagaaacagcagagatccatgatgacaactatggtggtccaggtgataaaataactatctgcaacggttcaaccattgtagatcagagactgggcagtgaactagggtgttataccatcaacagggtgaagtcattcaagctatgcgaaaacagcgccacagggaaaacctgtgaggtagacagcactccggttaagtgcaggcaaggtttttgtttaaaaatcacccaagagggaaggggccacgtaaaattatctagaggctcagaggttgtcctggatgcttgcgactcaagctgtgaagtaatgatacctaaaggcactggggatatcctagtggactgttcaggtgggcagcaacatttcttaaaagacaacttaattgacctagggtgcccccatatcccgctattgggtaagatggctatttacatttgcagaatgtcaaatcatcctagaacaaccatggcttttctcttctggttcagctttggctatgttatcacctgtatatcttgcaaggctcttttttattcattgataattattggaacactaggaaaaaagatcaagcaatatagggaactgaaacctcaaacctgcaccatatgtgagacagctcctgtcaatgcaatagatgctgaaatgcatgacctcaactgtagttacaatatatgcccttattgtgcatcaagattgacctccgatgggctagccaggcatgtaacgcaatgccccaagcggaaagagaaggttgaagagactgaactgtacctgaacctggaaagaattccttggattgtcagaaagctattgcaggtgtcagagtccactggtgtggcattaaaacgaagcagctggctgattgtactgcttgtgttactaacagtttcattgtcaccggttcaatcagcacctgttggtcatggaaagacaatcgaaatatatcagaccagggaaggattcgcaagcatctgtctctttatgttaggaagcattctatttatagtctcttgcttggtgaaagggctagttgacagtgtcagtgacagcttcttccccggcctatctgtctgtaagacatgctctattggcagtgtaaatggctttgaaattgaatcgcacaaatgctactgtagcctattttgctgcccctactgcaggcactgctctgctgacagagaaattcaccagttacacttgagtatctgcaaaaaaaggaaaacggggagcaatgtcatgctggccgtctgcaaacgcatgtgctttagggcaaccatagaagcaagcagaagagccctgctcatccgaagcattatcaataccacttttgtaatatgcattctaacattgacaatctgtgttgttagcacctctgcagtggagatggaaaaccttccagcaggaacttgggagagggaggaagatctgacaaatttctgtcatcaggaatgccaggtaactgagacagaatgcctctgtccatacgaagctcttgtgctcagaaaacctcttttcttggacagtatagttaaaggtatgaaaaatttgctaaactcaacaagcttggaaacaagcttatcaattgaggcaccatggggagcaataaatgtccagtcaacctttaaaccagctgtatcgactgcaaacatagcactcagttggagctcagtggagcacagaggcaacaagatcttagtcacaggcaggtctgaatcaattatgaaactggaggaaaggacaggagtcagctgggatctaggtgtagaagatgcctctgaatccaaattacttaccgtttctatcatggatttgtcacaaatgtattctcctgtttttgagtacttgtcaggagacagacaggttgaagaatggcccaaagcaacttgtacaggtgattgcccggagaggtgtggttgcacatcatcaacctgcttacataaagaatggcctcactcaagaaactggagatgtaatcccacttggtgctggggagtaggaaccggctgcacctgctgcggggtggatgtaaaagatctttttacagatcacatgtttgtcaaatggaaagttgaatacataaaaactgaagctatagtatgtgttgaactcaccagccaagaaagacagtgcagtctgattgaggcaggtactagattcaacttgggccctgtgactattaccctgtctgagccaagaaacattcagcagaagcttcctcctgagattatcacgttgcatcccaaaattgaagaaggcttctttgacttgatgcatgtacaaaaagtgttgtctgcaagtacagtgtgtaaactgcagagttgcacacatggtataccaggagatctacaagtttaccacattggcaacttgttgaaaggggatagagtaaacgggcatctaattcacaaaattgaatcacatttcaacacctcttggatgtcctgggatggttgtgacttagactactactgcaacatgggggattggccatcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgaaatatcaggcttgaaatttgcaagtctggcttgcacgggttgctatgcttgtagctctggcatctcctgtaaagttagaattcatgtagatgaaccagatgagctcacagtacatgtaaagagcagtgatccagatgtggttgcagctagcacaagtctcatggcgaggaagcttgaatttgggacagacagcacattcaaggccttttcagctatgcccaaaacctctttatgtttttacattgtggagagagaatactgcaagagctgcagtgaagatgatacacaaaaatgtgttgacacaagacttgagcagccacagagcatactaattgagcacaaaggaacgataattggaaagcagaatgatacttgcacagccaaggcaagctgttggttagagtcagtcaagagttttttttatggattgaagaatatgcttggcagtgtttttggtaatcttttcataggcattttgttattccttgccccttttgtcctgttggtgcttttctttatgtttgggtggaaaatcttgttttgctttaaatgttgcaggaggaccagaggcttatttaagtatagacacctcaaagacgatgaggaaacaggctacagaaggattattgaaagactgaacagcaaaaaagggaaaaacaggctgcttgatggtgatagactggctgataggaaaattgctgagctgttctccacaaaaacacacattggctaa

SEQ ID NO: 3654 - RNA, 5052 nt, synthetic construct
  misc_feature 1..5052: note = derived and/or modified CDS sequence (wt) from CCHFV(5170-R-2011)__KR814873.1__GP
  source 1..5052: mol_type = other RNA
atgcatacactattagtgtgcttcattctttacctacagctgtcgggtttaggaggggctcatggacagtcaaacgaaactgaacacaatggaacaaacaccaccacagtacccggcacaagtcaaagccccaagccacccgcgagcaccactctacaacacacaccagaatcctccaccgtcaaactcaccacaccaacaagcgaaacagaaggctcaggggaaacgaccccacccccaaacaccacccagggcctgcccccaccagggaccacaccagaacgctccgcaacaaccgccacaagcacgtcaagcacagacaacatgaattccaccacacaggtgaccgacaacacccccacatcaacagtcagcataagtccatccagcagccccagcatgccatccacatcacaaggcatacattatcccataaggagtctattgtcagtctcgagccctaagacagtaacaacaccgacaccaataagccctggagagatgagcccggaaaccagcagtcagcactcagccatgagcagaataccaaccctctacacagcaacccaggtctccactgagaacaccaaccgcagcacacctagacaatctgagtcttcagtacagccggcaacccaaagcccaataacttccccagcgcaaacaatccttctgatgagtgctgctcctaaagctattcaggacatgcatcccagcccaacaaacaggtccaagaggaaccttgaggtggaaataattttaactctgtctcaaggtctaaagaaatattacggtaaaatactgaagcttctgcaccttaccttggaagaggatactgaaggcctgttagaatggtgtaagagaaaccttgggtcaaattgtgatgatgacttctttcaaaagagaatagaggaattcttcataactggtgagggctacttcaatgaagtcctacaatttaaaacactaagcacactaagccccacggagctgtctcatgtcaggctaccaacagcggagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtactttcataccaggaacttataaaatagtgatagacaaaaaaaataagctaaatgaccgatgctcgctagtcactaactgtgtgataaagggaagagaggttcgtaagggccaatcagtgctgaggcagtacaaaacagaaattaagataggcaaggcatcaacaggctctaggaaactactgtccgaagagccaggtgacgactgcatatcaagaactcagctattgaagacagaaacagcagaaatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgtttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgaagggctagctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggtcatggtaagacaatcgaaacatatcagaccagagaaggattcacaagtatctgtctctttatgttaggaagcatcctattcatagtttcttgcctggtaaaggggctggttgacagtgtcagtgacagcttcttccccggcctgtctgtctgtaagacatgctctattggcagtataaatggctttgaaattgaatcgcataaatgctactgtagtttattttgctgcccctactgtaggcactgctctgctgacagagaaattcaccagttgcacttgagtatctgcaaaaaaagaaaaacagggagcaatgtcatgctggctgtctgcaagcgcatgtgctttaaggcaaccatagaagcaagcagaagagccctgctcatccgaagcattatcaataccacttttgtaatatgcattctaacattagcaatctgtgttgttagcacctctgcagtagagatggaagaccttccagcaggcacttgggagagagaggaagacctaacaaatttctgccatcaggaatgccaggtgaccgagacggaatgcctctgtccatacgaagctcttgtgctcaggaaacctcttttcttagacagtatagttaaaggtatgaaaaatttgctaaactcaacaagcttagaaacaagcttatcaattgaggcaccatggggagcaataaatgtccagtcaacctttaaaccaacagtatctactgcaaacatagcactcagttggagctcagtagagcacagaggcaacaagatcttggtcacaggcaggtctgaatcaattatgaaactagaggaaaggacaggagtcagctgggatctaggcgtggaagatgcctctgaatccaaattacttaccgtctctatcatggacttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacatcggtaacttgttgaaaggggatagagtaaacgggcatctgattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcctgtagctctggcatctcttgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagccatgcccaaaacctctttatgcttttacattgtagagagggaatactgcaagagctgcagtgaagatgatacaaaaaaatgtgttgacacaaaacttgagcagccacagagcatactaattgagcacaaggggacgataattggaaagcagaatgatacttgcacagccaaggcaagttgttggctagagtcagtcaagagttttttttatggactgaagaatatgcttggcagtgtttttggtagttttttcgtaggcattttgttattccttgccccttttgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaagggaaaaacagactgcttgatggtgagaggttggctgataggaaaattgctgagctgttctctacaaaaacacacattggctaa

SEQ ID NO: 3655 - RNA, 5055 nt, synthetic construct
  misc_feature 1..5055: note = derived and/or modified CDS sequence (wt) from CCHFV(SCT ex Afghanistan)__KC344856.1__GP
  source 1..5055: mol_type = other RNA
atgtatacactgctagtgtgtgctattctttgtccacagccgtggagtttggaagggacccatgttccgcttaacgggactaaacacaacggaactggcatcacagcagcacctggagggagtcaaggccccacgtcgcctgcaagcacagcagtatccctcacaccggaccccttcaccaccgaacccacagcatcagctgtcgaactggaaagctcgggagaagggcacacctccctctcagtcactacacaaggtctgacctcgccggaaaccacgccagggctcccaacagtaaccgacacaggagtgtctagcacaagcatcttcggcatcggcatacgggtggctggggacactcccacatcgacaacccacacaggtctgcccagcagtcccagcatgccatccacagcacagggcccacatcatgcagtaaggggtttactgtcggtttccagcaccaggccaggagaggcatcaacaataacagtcccaggagaagcaggcacagaggccaacagctcaagctcagccattagcaaaaaaccagccccttcaccaacagctgaagccatcactgaagccaacaactccagcaaccccagacaaccagagctctcaacacaaccagcaatcccaggcctagtgacctcttcagcgcagccaatcctcctacagagtgctacttccacagctgctcaagacatataccccagcccaacaaacagatctaaaagaaaccttgagatggaaataattttgactttatctcaaggtctaaagaagtactacggtaaaatactaagaattttggatctcaccttagaagaagacactgaaggcctgctagagtggtgtaagagaaatcttggtctgacctgtaatgataatttcttccaagagagaatagaagagttttttctgaccggtgaaggccactttaatgaagttttgcagtttaaaacaccaagcacactaagccccacagaaccaactcacaccagaacaccaacagttaaaccctttaaatcttattttgccagaggcttcctttcaatagactcaggctacttctctgccaagtgctattcaaagacctctaattcaggacttcagttgatcaatatcacccagcatccagctagaatagcggacacacctggacctaagatcactaatctaaaggctatcaattgtataaacttaaaggcatcagtcttcaaggagcatagggagattgagatcaatgtgcttctcccacaagtcgcggtcaacctctcaaactgccatgtcttgattaaatcacatgtctgtgattactctttagacattgatggggcagtaagactacctcatgtccaccacaaaggaacattcataccaggaacttataaaatagtaatagataaaagaaacaagcaaaatgacaggtgcaccttggtcactaattgtgtgattaaaggaaaggagattcgtaaaggccagtcagcactaaggcaatacagaacagaaatcagaataggcaaggcatctgccgggtctagaagattgctgtctgaagagtctggtgacgactgtatatcgaggactcagctattgaggacagagactgcagaggtccataatgataactatggtggtccaggtgacaaaattaccatctgcaacggttcaaccattgtagatcagagacttggcagtgaactggggtgttatactatcaacagagtgaagtcattcaagctatgcgaaaatagcgccacgggaaagtcctgtaaaatagacagcaccccggttaagtgcaggcaaggtttttgcttaaaaatcactcaggaaggaaggggccatgtgaagctatcgagaggctcagaagttgtcttagatgcctgcgattcaagctgtgaaataatgataccgaagggcactggagacatcctagtggactgttcaggtgggcagcaacatttcttaaaagataatttgattgatctaggatgccctaacattccactattaggtaaaatggctatctatatttgtagaatgtcaaatcatcccaaaacaactatggcttttctcttttggttcagttttggttatgtaataacatgtatattttgcaaagtcattttttatttattgatagttgtggggacattgggaaaaaagttcaaacagtatcgagagctgaaacctcagacttgtacaatatgtgaaacaactcctaccaatgcaatagatgctgaaatgcacgatcttaactgcagttacaatatatgtccttattgtgcatctagattaacctcggacgggcttgccaggcatgtgacacaatgccctaagcgaaaggaaaaagtagaagagactgagttgtacttgaacttggaaagaattccttggattgtcagaaaactactgcaggtgtcagagtctacaggtgtggcactgaagaggagcagttggctaattgtgttacttgtgctacttacagtttcattgtcaccggttcaatcggcacccatcgggcatggaaagacaattgagacatatcagaccagagaggggtatataagtgtttgcctgtttgtgctagggggcatactgtttgtagtctcctgcctgatcaaaggactggttgacagtgtcggcaacagtttttttcctgggttatctatttgcaagacatgttctatcggcagtgtaaatggctttgaaattgaatcccataaatgttactgtagcttactttgttgcccttattgtagacactgctctactgatagggagatccaccaattgcacttgagcatctgcaaaaaaagaaggacagggggcaatgtcatgttggctgtctgcaagcgcatgtgcttcagagcaactatggaagtaagcaacaaggtcctatttatccgaaacatcatcaataccacctttgttatatgcatactgatattagcagtctgtgtcgttagcacctctgcagtagagatggaaagcctacccgccggcacttgggaaagggaagaagacctaacaaacttctgccaccaagaatgccaagtcacagagactgaatgtctctgtccttacgaagctcttgtactcaggaaaccccttttcttaaacagtatagtcaagggcatgaaaaacctgctaaattcaactaacttggaaacaagcttatcaatcgaagcaccatggggagcaataaatgtccagtcaacctttaaacccactgtatcaactgcaaacatagcactcagctggagttcagtggaacacagaggtaataaaattctagtctcaggcagatcagagtcaattatgaagctagaagaaaggacaggaatcagctgggatttgggcgtagaagatgcctctgagtctaaatcgcttactgtttctgtcatggatttatcacagatgtattctcctgtcttcgagtatctgtcaggtgacagacaggtagaggagtggcctaaagcaacctgcacaggcgattgcccggagagatgtggctgcacatcatcaacctgcttacacaaggaatggccccattcaaggaattggagatgcaaccccacttggtgttggggagtcggcactggatgcacctgctgtgggctagatgtgaaagaccttttcacagattatatgtttgtcaagtggaaggttgaatacataaagacagaggccatagtgtgtgttgagctcactagccaagaaaggcagtgcagcttgattgaggcaggaacaaggttcaacttaggtcctgtgaccatcacgttgtcagagccaagaaacattcagcagaagcttcctcctgaaataatcacattgcatcctagaattgaggaaggctttttcgatctaatgcatgtacaaaaggtgctgtctgcaagtacagtgtgcaagctgcaaagctgcacacatggtgttccaggagacttgcaggtctaccacattggcaacttgttaaaaggggataagttaaacgggcatatgattcacaaaattgagccacacttcaatacctcttggatgtcctgggatggctgtgacctagactattactgtaatatgggggattggccctcttgcacatacactggggtgacccaacataaccatgctgcttttgttaacttacttaacatcgaaactgattacacaaagaacttccactttcactctaaaagagttactgcacatggagacacaccacaattggacttgaaagctagaccaacttacggtgcgggtgaaatcactgtactagtggaagttgctgacatggagttacacacaaaaaagattgatatatcaggtttgaaatttgcaagtctaacttgcgcgggttgctatgcttgtagctctggcatctcctgtaaagtcaggattcatgtagatgaacctgatgagcttacagtacatgtgaaaagtgaagatccggacattgttgcagctagcacaagcctcattgcaaggaagctcgaacttgggacagacagcacattcaaggccttctcagccatgcccaaaacctccttgtgcttctacattgtggagagagaatactgtaagagctgcagcaaagaggacacacagaaatgtgttaacacaaagcttgagcacccacaaggcattttaattgagcacaaaggaacaataatcggaaagcaaaatgacacctgcacagccaaagcaggctgctggttggagtcagtcaagagttttttttatggattgaagaacatgcttagtggcatcttcggcaacgtttttataggtattttcttattccttgctccttttgttctattgatactcttctttatgtttgggtggagactcctgttttgctttaagtgttgtagaagaaccagaggtttattcaagtacagacatctcaaggaagatgaagaatctggttatagaagaatcattgaaagattaaacaacaaaaaaggaaagaacaagctgcttgatggtgaaagactagctgatagaaggatcgctgagctgttctccacaaaaacacatattggttaa

SEQ ID NO: 3656 - RNA, 5055 nt, synthetic construct
  misc_feature 1..5055: note = derived and/or modified CDS sequence (wt) from CCHFV(SPU 44/08)__KJ682805.1__GP
  source 1..5055: mol_type = other RNA
atgtacacaccactattgtgtgctattctttgtttgcagctgtggagcttagaaggaatttatggattgtccaacaatacccaacacaatgacactagtaccataaaagtgcccgaggagagtcaaaaaaccagtctgcccgcgaacacagcatcacccatcacgtcagacccccccccgaccacacccacagcatcagccagtggaccagaaggctcaggggacacgagcacctctcccccagtcaccacacaaggcccgaccccaccagaaaccacgccagagccccacacaacaattgacatcgataaatcaagcacagccatcgctgacatcagcacacagacagtcaagaacatccccacaccaacagcccacaccagtttgcccagcactctcagcgcgccaaccatgccgcaagaagcacatcacactgcaaggggcctactgtcagtcaccagcacaaaaccaggagaagcatcaacaccaacaagcccaggggaagcaagcacagaggccagcagcccacaaccaaccatcagagagacaccatccccccctccaacaacccaaactcccaccgaaatcaacaaccccaacacatccagacagcccatgccctcaacacaaccagcagctcccagctcagtgacccatccagcacagccaaccccctctcagagcgacgtccccacggctgctcaagatatacaccccagcccaacaaacagatctaaaagaaatcttgaaatggaaataattttgactttatctcaaggtttgaagaagtactacggcaaggtactaaaacttctggatcttactttagaagaagacactgaaggcctgttagagtggtgtaagagaaaccttggtctgacctgcgatgacaacttctttcagaagagaatagaagagttttttttaactggtgaaggtcacttcaatgaagtgttgcagttcaaaacaccaagcacactaagccctacggaacctgctcgtgttgagtcaccgacagtagaaccctttaaatcttactttgctaaaggcttcctcttaatggactcaggttacttctccgccaagtgttacccaaagtcatccaattcaggacttcagctgattaacgtcacccaacatttaattagaataacagacacacctgggcctaagatcactaatctgaaaaccatcaattgcataaacttgaaggcattagtcttcaaagagcatagggagattgaaatcaatgttctcctccctcaagtcgcggtcaacctctcaaactgccatgtgctgatcaaatctcatgtttgtgactactctatagacatcgacgggccggtaagactgccccgtatccaccatgaaggaacttttataccaggaacttacaaaatagttatagataaaaaaaacaagcagaacgacagatgcactttggtcactaactgtgtgataaaaggaagggaaattcgcaaaggccagtcagtgttaaggcaatacagaacagaaatcaagattggcaaggcatcttctggttctagaagactattgtctgaagagtctaatgatgactgtttatcaaggactcagctattgaggacagagaatgcggaaattcacagtgacaactatggtggtccaggtgacaagataactatctgcaacggttcaactattgtagatcagagattgggcagtgaactagggtgttacactatcaatagagtgaaatcatttaagctctgcgaaaacagtgctacaggtaaatcttgtgaaatagatagcaccccagtcagatgtaggcagggtttttgcttgaaaattactcaggagggaaggggccacgtgaagctatcaagaggctcagaagttgtcttggacgcctgtgactcaagctgtgaaataatgataccaaagggcactggggacatcctagttgactgctcaggtgggcagcaacatttcctaaaagataacctggttgatttaggatgccccaacatcccactgttaggcaaaatggccatctacatttgtagaatgtcaaatcatcccaagacaactatggctttccttttttggtttagctttggttatgtgataacctgtatactttgtaaagcaatcttctatctattaatagttgtagggacattaggaaaaaagttcaaacagtacagagagttaaaacctcagacctgtaccatatgtgaaacaaatcctgttaatgcaatagatgctgagatgcacgacctcaactgcagttacaatatatgtccttattgtgcatctaggttaacctcagatggtcttgccagacatgtaatgcaatgccccaaacggaaggaaaaaatagaagaaaccgaattatatttaaacttagaaagaatcccttgggttgttaggaaattactgcaggtgtcagaatccaccggtgtagcactaaagaggagtagttggctggttatactacttgtgctgctcacagtttcattgtcaccagtacaatcagcacccatcagccatggagagacagtcgaagtatatcaaaccagagaagggtacacaagtatttgcctttttgtactaggaagcatcctgtttttggtatcctgcctgatgagggggttggttgacagtgtcagcaatagctttttccctggcttgtccatttgtaagacatgttctattggcagtataaacggctttgaaattgaatctcacaaatgttactgtagcctattttgctgcccctactgtagacactgctctgccgacatagaaatacataagttgcacttgagcatctgcaagaaaaggaaaactgggagtaatgtcatgttagccgtctgtaagcgcatgtgctttagggcaactgtggaagttagcaataaagctttacttatccgaaacatcatcaacaccacttttgttgtgtgcatactgatattagcagtttgtgttgtcagcacctctgcagtggagatggaaaatctgccagcaggcacttgggaaaaagaggaagacctgacaaatttctgtcatcaggaatgccaagtcactgagactgaatgcctctgtccttatgaagctcttgtgctcaggaaacccttgtttttggacagtattgttaaaggcatgaagaacttgctaaattcaacaagcctagaaacaagcttatcaattgaggcaccatggggggcaataaatgtccaatcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaattgctcactgtctctgtaatggacttgtcacaaatgtattctcctgtctttgagtacctatcaggtgatagacaagtggaagaatggcccaaggcaacctgcacaggagattgcccagaaagatgcggctgcacgtcatcaacctgcctacacaaggaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgaccatcacattgtcagagccaagaaacattcagcagaagctccctccagaaatagttacattgcatcctaggattgaagaaggcttctttgacttaatgcatatacaaaaagtgctatcagcaagtacagtatgtaagctacagagttgcacacatggcgtgccaggagacctacagatctaccacattggaaacttgttaaaaggagacaaggtgaacgggcacctgattcacaaaattgaaccacacttcaacacctcctggatgtcttgggacggctgtgacctagactactactgtaatatgggggattggccgtcttgctcatatactggcgtaacccaacacaatcatgctgcatttgtaaacatgctcaacatcgaaactgattatacaaaaaacttccactttcactctaagagagttacagcacatggggacacaccacaattagatttaaaagctagaccaacttatggtgcaggtgaaatcactgtgctggtagaggttgctgacatggagttgcatacaaagaaaattgagatatcaggtttgaagtttgcaagcttaacttgcacaggctgttatgcttgtagttctggcatctcctgtaaggttaggatccatgtagatgaaccagatgagcttacagtacatgtgaagagcgaggatccagacatagttgctgctagttcaagtctcatggctaggaagcttgaatttgggacagatagcacatttaaagccttttcagccatgcccaaaacctccttgtgcttttacattgtggagagggaatactgcaaaagctgtagtaaagaagacacacaaaaatgtgtcaacacaaagcttgaacaaccacaaagcattttaatcgagcacaaagggacgataatcggaaagcagaacgacacttgtacagccaaagcaagttgctggttagagtcaattaagagttttttttatggactaaagaatatgcttagtggcatttttggcaatgttttcatagggattttcttattcctcgctccttttatcatgctaatacttttcttcatgtttggatggaggatcctgttctgcttcaagtgttgcagaagaactagaggcttatttaagtatagacacctcaaagacgatgaagaaatcggttacaggaaaatcattgagaggctaaacaacaaaaaagggaaaaacaaactacttgacggtgaaagactagctgataggaagatcgctgagctgttctctacaaaaacacacattggctaa

SEQ ID NO: 3657 - RNA, 5052 nt, synthetic construct
  misc_feature 1..5052: note = derived and/or modified CDS sequence (wt) from CCHFV(K323_27)__KX013472.1__GP
  source 1..5052: mol_type = other RNA
atgcatacactattagtgtgcttcattctttacctacagctgtcaggtttaggaggagctcatggacagtcaaatgcaactgaacacaatggaacaaacaccaccacagtacccggcacaagtcaaagccccaagccacccgcgagcaccactctaccacacacaccagaatcctccaccgtcaagctcaccacaccaacaagcgaaacagaaggctcaggggaaacgaccccacccccaaacaccacccagggcctgcccctaccagggaccacaccagaacgctccgcaacaaccgccacaagcacgtcaagcacagacaacatgaattccaccacacaggtgaccgacaacacccccacatcaacagtcagcataagtccatccagcagccccagcatgccatccacatcacaaggcatacatcatcccgtaaggagtctattgtcagtctcgagccctaagacagtaacaacaccgacaccaatgagccctggagagatgagcccggaaaccagcagtcagcactcagccatgagcagaataccaaccctctacacagcaacccaggtctccactgagaacaccgaccgcagcacacctagacaatctgagtcctcagtacagccggcaacccaaagcccaataacttccccagcgcaaacaatccttctgatgagtgctgctcccaaagctattcaggacatgcatcccagcccaacaaacaggtccaagaggaaccttgaggtggaaataattttaactctgtctcaaggtctaaagaaatattacggtaaaatactgaagcttctgcaccttaccttggaagaggatactgaaggcctgttagaatggtgtaagagaaaccttgggtcaaattgtgatgatgacttctttcaaaagagaatagaagaattcttcataactggtgagggctacttcaatgaagtcctacaatttaaaacactaagcacactaagccccacggagtcgtctcatgtcaggctaccaacagcggagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcagctcacatgtctgtgattactctttagacactgacggaccagtgaggctccctcgcattcaccatgaaggtactttcataccaggaacttataaaatagtgatagacagaaaagataagctaaatgaccgatgctcgctagtcactaactgtgtgataaagggaagagaggttcgtaagggccaatcagtgctgaggcagtacaaaacagaaattaagataggcaaggcatcaacaggctctaggaagctactgtccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaagctcttttttatttattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgactgtgctgcttgtgttactcacagtctcattgtcaccggtccaatcagcacctgttggccatggtaatacaatcgaaacatatcagaccagagagggattcacaagtatctgtctctttatgttaggaagcatcctattcatagtttcttgcctggtaaaggggctggttgacagtgtcagtgacagcttcttccccggcctgtctgtctgtaagacatgctctattggcagtataaatggctttgaaattgaatcgcataaatgctactgtagtttattttgctgcccccactgtaggcaccgctctgctgacagagaaattcaccagttgcacttgagtatctgcaaaaaaagaaaaacggggagcaatgtcatgctggctgtctgcaagcgcatgtgccccaaggcaaccatagaagcaagcagaagagccctgcccatccgaagcatcatcaacaccactcttgtaatgtgcattctaacattagcaatctgtgttgttagcacctctgcagtagagatggaagaccttccagcaggcacctgggagagagaggaagacctaacaaatttctgccatcaggaatgccaggtgaccgagacggaatgcctctgtccatacgaagctcttgtgctcaggaaacctcttttcttagacagtatagccaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatacataaaaaccgaagccatagtatgtgttgagctcaccggccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgttgttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctggagtcagtcaagagttttttttatggattgaagaatatgcttggcagtgtttttggtagttttttcgtaggcattttgttattccttgccccttttgtcttgttggtgcttttctttatgtttggatggaaaatcttgttttgctttaagtgttgcaggaggaccagaggcttgtttaagtatagacacctcaatgatgacgaggaaacaggctacagaaggatcattgaaagactgaacagcaaaaaaggaaaaaacagactgcttgatggtgagaggttggctgataggaaaattgctgagctgttctctacaaaaacacacattggctaa

SEQ ID NO: 3658 - RNA, 5052 nt, synthetic construct
  misc_feature 1..5052: note = derived and/or modified CDS sequence (wt) from CCHFV(1231-CR/TI-2015)__KU161585.1__GP
  source 1..5052: mol_type = other RNA
atgcatacactattagtgtgcttcattctttacctacagctgttgggtctaggaggggctcatgaacagtcaaacgcaactgatcacaatagaacaaacaccatcacagcacccagcacaagtcaaaaccccaagccacccgcgagcacaaccccaccacacacaccggaatcatccaccatcaagctcatcacatcaacaggcgaagcagaaggctcaggggaaacgaccccacccctaaacaccacccagggcccgttcccaccagagaccacatcagaacaccctgcatcaaccgccacaaacacgtcaagcacaaacagcatgaattccaccacacagatgactgataaaaccctcacatcaacagtcagcacaagtctatccatcagccccagcacgccatccacatcacaaggcatacattatccgataaggagtctattgtcagtctcgagccctaggacagcagcaacaccaacaccaatgagcactagagagatgagctcggaaacaaacagtcagcactcagccgtgagcagaacaccaaccttccacacagcaacccaggtctccactgagaacgacaaccgcagcacccctagacagtctgaatcctcagcacagccggcaacccaaagcccaatgacttccccagcgcaatcaatccttctggtgagtgctgctcctacaaccattcagaacatacatcccagcccaacaaacaggtccaagaggaaccttgagatggaaataattttgactctgcctcaaggtctaaagaaatactacggtaaaatactgaagcttctgcaccttaccctagaagaggacactgaaggcctgttagaatggtgtaagagaaaccttgggtcgaactgtgatgatgaattcttccaaaagagaatagaagaattcttcataactggtgagggctacttcaatgaagtcctacaatttaaaacactaagcacactaagccccatggagccgtctcatgccaggccaccaacagcggaacccttcaaatcttacttcgctaagggcttcctttcaatagattcaggttacttctctgccaaatgttatccaagatcatcctcttcagggcttcagctgattaatattacccaacatccagctaggatagcagaaacacctggtcccaaaacaacgagtctgaaaaccatcaactgtatcaatctaagagcatctgttttcaaagaacacagagaagttgagatcaatgtgcttcttcctcagattgcagtcaacctttcaaactgccatgttgtgatcaattcacatgtctgtgattactctttagacactgatgggcctgtgaggcttcctcgcatttaccatgaaggaactttcataccagggacttataaaatagtgatagacaaaaaaaacaagctaaatgaccgatgcacgctagtcactaactgtgtgacaaagggaagagaagttcgtaagggccaatcagtgctgaggcaatacaaaacagaaattaagataggcaaggcatcaacaggctctaggaaactactgtccgaagagccaggtgatgactgcatatcaagaactcagctattgaggacagaaacagcagagatccatgacgacaactacggcggtccaggtgacaaaataactatctgcaatggttcaaccatcgtagatcagagactgggcagtgaactagggtgttataccatcaacagggtgaagtcattcaagctatgcgaaaacagcgctacagggaaaacctgtgagatagacagcactccggtcaagtgcaggcaaggtttctgtttaaaaatcacccaagagggaaggggccacgtaaaattatctagaggctcagaggttgtcttggatgcttgcgactcaagctgtgaagtaatgatacctaaaggcaccggagatatcctagtagactgttcaggtggacagcagcattttttaaaagacaacttgattgatctagggtgcccccacatcccgctattgggtaagatggccatttacatttgcagaatgtcaaatcatcctagaacaaccatggcttttctcttctggttcagctttggctatgtgatcacctgtatattttgcaaggctcttttttattcattaataattattgggacactagggaaaaagatcaagcaatatagagaactgaaacctcaaacttgtactatatgtgagacagctcctgtcaatgcaatagatgctgaaatgcatgacctcaactgtagttacaatatatgcccctattgtgcatcaagactgacctctgatgggctagctaggcatgtaacgcaatgccctaagagaaaggagaaagttgaggagactgaactgtacttgaacctagaaagaattccttggatcgtcagaaagctattgcaagtgtcagagtccactggtgtggccttgaaacgaagcagttggttgattgtgctgcttgtgttactcacagtttcattgtcaccggttcaatcagcacctgttggtcatggtaagacaatcgaaacatatcagaccagagaaggattcacaagtatctgtctctttatgttaggaagcatcctattcatagtctcttgcttggtgaaggggctggttgaaagtgtcagtgatagcttcttccccggcctgtctgtctgtaggacatgctctattggcagcataaatggctttgaaattgagtcgcataagtgctactgtagcttattttgctgcccctactgtaggcactgttctgctgacagagaaattcaccagttacacttgagtatctgcaaaaaaagaaaaacggggagcaatgtcatgctggctgtctgcaaacgcatgtgttttagggcaaccatggaagcaagcagaagagccctgcttatccgaagcattatcaataccacttttgtaatatgcattctaacattaacaatctgtgttgtcagcacctctgcagtagagatggaaaaccttccagcaggcacttgggagagagaggaagacctgacaaatttctgtcatcaagaatgccaggtaaccgagacggagtgcctctgtccatatgaagctcttgtgctcaggaaaccccttttcctagacagtatagttaaaggtatgaaaaatttgctaaactcgacaagcttagaaacgagcttatcaattgaggcaccatggggagcaataaatgtccagtcaacctttaaaccaacagtatcaactgcaaacatagcactcagttggagctcagtggagcacagaggcaacaagatcttagtcacaggcaggtctgaatcaattatgaaactagaggaaaggacaggagtcagctgggatctaggtgtagaagatgcctctgaatccaaattacttaccgtctctataatggatttatcacaaatgtattcccctgtttttgagtacttgtcaggagacagacaggttgaagagtggcccaaagcaacttgtacaggtgattgcccagaaaggtgtggctgcacatcatcaacctgcttgcataaagaatggcctcactcaagaaactggagatgtaatcccacttggtgctggggagtaggaaccggctgcacctgttgcggggtggatgtaaaagacctttttacagatcacatgtttgtcaaatggaaggttgaatatataaaaactgaagccatagtatgtgttgagctcaccagccaggaaagacagtgcagtcttattgaggcaggtacaagattcaacttaggccctgtgactatcaccctgtctgagccaagaaacattcagcagaagcttccccctgagatcattacgttgcatcccaaaattgaagaaggcttctttgacttgatgcatgtacaaaaagtgttgtctgcaagtacagtgtgtaaactgcagagttgcacacatggtataccaggagacctacaagtttaccacattggcaacttgttgaaaggggatagagtaaacgggcatctaattcacaaaattgaaccacattttaacacctcttggatgtcctgggatggttgtgatctagactactactgcaacatgggggactggccttcttgcacatacacaggagtgacccagcataatcatgctgcatttgtaaacttgcttaacattgaaactgattacacgaaaaccttccacttccactctaaaagagtcacagcacatggtgacacaccacaattagacttaaaagcaaggccgacctacggtgcaggtgagatcactgtgctggttgaggttgctgacatggagttgcatacaaaaaaagttgagatatcaggcttgaaatttgcaagcctggcatgcacgggttgctatgcttgtagctctggcatctcctgcaaagtcagaattcatgtagatgaaccagatgagctcacagtgcatgtaaagagcagtgatccagatgtggttgcggctagcacaagccttatggcaaggaagcttgaatttgggacagacagcacattcaaggccttttcagctatgcctaaaacctctttatgtttttacattgtggagagagaatactgcaagagctgcagtgaagatgatacaaaaaaatgtgttgacacaaaacttgagcagccacagagcatactaattgagcacaaagggacgataattggaaagcagaatgatacttgcacagccaaggcaagctgttggttagagtcagtcaagagttttttttatggattgaagaatatgctcggcagtgtttttggcaatttttttataggcattttgttattccttgccccttttgtcctgttggtgcttttctttatgtttggatggaaaatcttgttttgctttaaatgttgcaggaggaccagaggcttgtttaagtatagacacctcaaagacgatgaggaaacaggctacagaaggattattgaaagactgaacaacaaaaaggggaaaaacagactgcttgatggtgaaaggttggctgataggaaaattgctgagctgttctccacaaaaacacacattggctaa

SEQ ID NO: 3659 - RNA, 5052 nt, synthetic construct
  misc_feature 1..5052: note = derived and/or modified CDS sequence (wt) from CCHFV(K229_194)__KX013463.1__GP
  source 1..5052: mol_type = other RNA
atgcatacactattagtgtgcttcattctttacctacagctgtcgggtttaggaggagctcatggacagtcaaacgcaactgaacacaatggaacaaacaccaccacagtacccggcacaagtcaaagccccaagccacccgcgagcaccactctaccacacacaccagaatcctccaccgtcaaactcaccacaccaacaagcgaaacagaaggctcaggggaaacgaccccacccccaaacaccacccagggcctgcccccaccagggaccacaccagaacgccccgcaacaaccgccacaagcacgtcaagcacagacaacatgaattccaccacacaggtgaccgacaacacccccatatcaacagtcagcataagtccatccagcagccccagcatgccatccacatcacaaggcatacattatcccgtaaggagtctattgtcagtctcgagccctaagacagtaacaacaccgacaccaatgagccctggagagatgagcccggaaaccagcagtcaacactcagccatgagcagaataccaaccctctacacagcaacccaggtctccactgagaacaccaaccgcagcacacctagacaatccgagtcctcagcacagccggcaacccaaagcccaacaacttccccaacgcaaacaatccttctgatgagtgctgctcctaaagctattcaggacatgcatcccagcccaacaaacaggtccaagaggaaccttgaggtggaaataattttaactctgtctcaaggtctaaagaagtattacggtaaaatactgaagcttctgcaccttaccttggaagaggatactgaaggcctgttagagtggtgtaagagaaaccttgggtcaaattgtgatgatgacttctttcagaagagaatagaagaattcttcataactggtgagggctacttcaatgaagtcctacaatttaaaacactaaacacactaagccccacggagccgtctcatgtcaggctaccaacagcggagcccttcaaatcttacttcgctaagggcttcctttcagtagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtactttcataccaggaacttataaaatagtgatagacaaaaaaaataagctaaatgaccgatgctcgctagtcactaactgtgtgataaagggaagagaggttcgtaagggccaatcagtgctgaggcagtacaaaacagaaattaagataggcaaggcatcaacaggctctaggaaactactgtccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaaggcaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtatcagagtccactggtgtggcattgaaacgaagcagctggctgattgtgctgcttgtgttactcacagtctcattgtcaccggttcaatcagcacctgttggtcatggtaagacaatcgaaacatatcagaccagagaaggattcacaaatatctgtctctttatgttaggaagcatcctattcatagtttcttgcctggtgaaggggctggttgacagtgtcagtgacagcttcttccccggcctgtctgtctgtaagacatgctctattggcagtataaatggctttgaaattgaatcgcataaatgctactgtagtttattttgctgcccctactgtaggcactgctctgctgacagagaaattcaccagttgcacttgggtatctgcaaaaaaagaaaaacggggagcaatgtcatgctggctgtctgcaagcgcatgtgctttaaggcaaccatagaagcaagcagaagagccctgctcatccgaagcattatcaataccacttttgtaatatgcatcctaacattagcaatctgtgttgttagcacctctgcagtagagatggaaaatcttccagcaggcacttgggagagagaggaagacctgacaagtttctgccatcaggaatgccaggtaaccgagacggaatgcctctgtccatacgaagctcttgtgctcaggaaacctctttttttagacagtatagttaaaggtaagaaaaatctgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggacctgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacctgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctattcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttatgtttttacattgtggagagggaatactgcaagagctgcagtgaagatgatacaaaaaaatgtgttgacacaaaacttgagcagccacagagcatactaattgagcacaaagggacgataattggaaagcaaaatgacacttgcacagccaaggcaagttgttggctagagtcagtcaagagttttttttatggattgaagaatatgcttggcagtgtttttggtaattttttcgtaggcattttgttattccttgccccctttgtcttgttggtgcttttctttatgtttggatggaaaatcttgttttgctttaagtgttgcaggaggaccagaggcttgtttaagtatagacacctcaaagatgatgaggaaacaggctacagaaagattattgaaagactgaacagcaaaaaaggaaaaaacagactgcttgatggtgagaggttggctgataggaaaattgctgagctgttctctacaaaaacacacattggctaa

SEQ ID NO: 3660 - RNA, 5052 nt, synthetic construct
  misc_feature 1..5052: note = derived and/or modified CDS sequence (wt) from CCHFV(K315_14)__KX013469.1__GP
  source 1..5052: mol_type = other RNA
atgcatacactattagtgtgcttcattctttacctacagctgtcgggtttaggaggggctcatggacagtcaaacgaaactgaacacaatggaacaaacaccaccacagtacccggcacaagtcaaagccccaagccacccgcgagcaccactctacaacacacaccagaatcctccaccgtcaaactcaccacaccaacaagcgaaacagaaggctcaggggaaacgaccccacccccaaacaccacccagggcctgcccccaccagggaccacaccagaacgctccgcaacaaccgccacaagcacgtcaagcacagacaacatgaattccaccacacaggtgaccgacaacacccccacatcaacagtcagcataagtccatccagcagccccagcatgccatccacatcacaaggcatacattatcccataaggagtctattgtcagtctcgagccctaagacagtaacaacaccgacaccaataagccctggagagatgagcccggaaaccagcagtcagcactcagccatgagcagaataccaaccctctacacagcaacccaggtctccactgagaacaccaaccgcagcacacctagacaatctgagtcttcagtacagccggcaacccaaagcccaataacttccccagcgcaaacaatccttctgatgagtgctgctcctaaagctattcaggacatgcatcccagcccaacaaacaggtccaagaggaaccttgaggtggaaataattttaactctgtctcaaggtctaaagaaatattacggtaaaatactgaagcttctgcaccttaccttggaagaggatactgaaggcctgttagaatggtgtaagagaaaccttgggtcaaattgtgatgatgacttctttcaaaagagaatagaggaattcttcataactggtgagggctacttcaatgaagtcctacaatttaaaacactaagcacactaagccccacggagccgtctcatgtcaggctaccaacagcggagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtactttcataccaggaacttataaaatagtgatagacaaaaaaaataagctaaatgaccgatgctcgctagtcactaactgtgtgataaagggaagagaggttcgtaagggccaatcagtgctgaggcagtacaaaacagaaattagaataggcaaggcatcaacaggctctaggaaactactgtccgaagagccaggtgacgactgcatatcaagaactcagctattgaagacagaaacagcagaaatccatgacgacaactatggtggtccaggtgacaaaataactatctgcaatggttcaaccgttgtggatcagagactgggcagtgaactagggtgttataccatcaacagggtgaagtcattcaagctatgcaaaaacagtgccacagggaaaacctgtgagatagacagcactccggtcaagtgcaggcaaggtttttgtttgaaaatcacccaagagggaaggggccacgtaaaattatccaggggctcagaggttgttttggatgtttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgaagggctagctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggtcatggtaagacaatcgaaacatatcagaccagagaaggattcacaagtatctgtctctttatgttaggaagcatcctattcatagtttcttgcctggtaaaggggctggtttacagtgtcagtgacagcttcttccccggcctgtctgtctgtaagacatgctctattggcagtataaatggctttgaaattgaatcgcataaatgctactgtagtttattttgctgcccctactgtaggcactgctctgctgacagagaaattcaccagttgcacttgagtatctgcaaaaaaagaaaaacagggagcaatgtcatgctggctgtctgcaagcgcatgtgctttaaggcaaccatagaagcaagcagaagagccctgctcatccgaagcattatcaataccacttttgtaatatgcattctaacattagcaatctgtgttgttagcacctctgcagtagagatggaagaccttccagcaggcacttgggagagagaggaagacctaacaaatttctgccatcaggaatgccaggtgaccgagacggaatgcctctgtccatacgaagctcttgtgctcaggaaacctcttttcttagacagtatagttaaaggtatgaaaaaattgctaaactcaacaagcttagaaacaagcttatcaattgaggcaccatggggagcaataaatgtccagtcaacctttaaaccaacagtatctactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggacttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacatcggtaacttgttgaaaggggatagagtaaacgggcatctgattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcctgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagccatgcccaaaacctctttatgcttttacattgtagagagggaatactgcaagagctgcagtgaagatgatacaaaaaaatgtgttgacacaaaacttgagcagccacagagcatactaattgagcacaaggggacaataattggaaagcagaatgatacttgcacagccaaggcaagttgttggctagagtcagtcaagagttttttttatggactgaagaatatgcttggcagtgtttttggtagttttttcgtaggcattttgttattccttgccccttttgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaagggaaaaacagactgcttgatggtgagaggttggctgataggaaaattgctgagctgttctctacaaaaacacacattggctaa

SEQ ID NO: 3661 - RNA, 5055 nt, synthetic construct
  misc_feature 1..5055: note = derived and/or modified CDS sequence (wt) from CCHFV(BA8402)__AF350449.1__GP
  source 1..5055: mol_type = other RNA
atgtacacaccacttttgtgtgctgttctttgcttacagctgtggagtttagaagggtctcatggactgtccaacaaaacccaacacagtaatacaagcaccacaaaggcgcctgaagtaagccaggaacttggattgcctgtgagcacagtatcgactatcacgtcagaacctccttccatcacatccgcagtatcagtcagtggatcagaaggctcaggagacacgaacacctctccctcggtcaccacacaaggcccgactttgccagaaaccacgctggaacccctaacaacaaccgacacagatgcatcaagcactgtcgtcgtcgatgtcagcacacagacggtcaaggacacccctatatcaacaacctacacaagtttgcccagtactcccagcgagccaactacaccacagggtacacatcatactgcaaggggtctactgtcagtcaccagcacaaagccagaagaagcatcaccacaagcaaatccaggaaaaataagcatggagaccaatggcccgcgcctagccatcagcgagacaccatccttctctccaacaactcaggctcctaccgaaaacagcaaccccatcacatccaaacagcttatgctctcagcacaaccagtaaccccaaacccaatgacctctccagtacagccagccctctctcagagtgacacgtccacggccatccaagatgtacacccaagcccaacaggcagatctaaaagaaaccttgagatggaaataattttgactttatctcaaggtttgaagaagtactacggcaagatactaaaacttctggaccttactttggaagaagacactgaaggcctgctagagtggtgtaagagaaatcttggtttggtctgtgatgacaacttctttcagaagaggatagaagagttttttttgactgggaagggtcacttcaatgaagtcttacagttcaaaacaccaagcacactaagccccacgggaccagcccgaactgggtcaccaacagtggaaccttttaaatcttacttcgctaaagggttcctttcaatggactcaggctacttctctgccaagtgttatccaagagcatccaattcaggacttcagctgatcaatgtcacccaacattcaactagaataacagacacacctggacccaagatcactaatctgaagaccatcaattgcataaacttaaaggcatcagtctttaaagagcatagagagattgaaatcaatgttcttctccctcaagtcgcagttaacctctcaagctgccacgtgttgatcaaatcgcatgtctgtgactactctttggacattgacgggccagtaagactaccccgcatccaccatgaaggaactttcataccaggaacttacaaaatagttatagacaaaaaaaacaaacaaaatgatagatgcactttggtcaccaactgtgtaataaaaggaagggaaattcgtaagggccagtcagtgttaagacaatacaggacagaaatcaagattggcaaggcatcttctggttccagaagactattgtccgaagagtctggtgatgactgcatatcaagaactcagctattgaggacagagactgcggaaattcacaatgataactatggtggtccaggtgacaagataaccatctgcaatggttcaactgttgtggatcagagattgggcagtgaactggggtgttacactatcaatagagtaaactcttttaacctttgcgaaaacactgccacgggcaaatcctgtgaaatagatagcaccccagtcaaatgcaggcagggtttctgtttgaaaattactcaggagggaaggggccacgtgaagctatcgagaggttcagaagttgtcctggacgcctgcgaatcaagctgtgaaataatgataccaaagggcaccggagacatcctagttgactgttcaggtggacagcaacatttcttaaaagataacttgattgatctaggatgcccaaacatcccactattaggcaagatggctatctacatttgtagaatgtcaaatcatcctaaaacgactatggcttttcttttttggtttagctttggttatgtggtgacctgtatactctgtaaggtcatcttctatctattaatagttgtggggacgttggggaaaaagttcaaacagtatagagagttgaaacctcagacctgtaccatatgcgaaacaactcctgttaatgcaatagatgctgaaatgcacgacctcaattgcagttacaatatatgtccatactgtgcatctaggccaacctcagatggtcttgccagacatgttatgcagtgccctaagcggaaggaaaaaattgaagaaaccgcattatacttaaacttggaaagaatcccctgggttgttaggaaattactgcaggtgtcagaatccaccggtgtggcactaaagaggagtagttggctggttgtgctacttgtgctacttacagtttcattgtcaccagtacaatcagcacctatcggccatggaaagacagttgaaacatatcaaaccagagaaggatacacaagtatttgcctctttgtactaggaagcatcttatttatagtctcttgcctaatgaaggggttggttgacagtgttggtaacagttttttccctggtttgtccatttgtaagacatgttctattggcagtgtaaatggctttgagattgaatctcacaaatgttactgtagcctattttgttgtccctactgtagacactgctctgccgatagagaaatacataggttgcacttgagcatctgcaagaaaaggaagactgggagtaatgtcatgctggccgtctgtaagcgcatgtgctttagggcaactgtggaagtaagcaacaaggctctactcatccgaaacatcatcaacaccacttttgttctgtgcatactgatattagcagtttgtgttgtcagcacctccgcagtggagatggaaagcctgccagctggcacttgggagagagaggaagatctgacaaatttctgtcatcaagaatgccaagtcactgagactgaatgcctctgtccctacgaagctcttgtgctcaggaaacccttgttttcagacagcattgtcaaaggcatgaagaacttgctaaattcaacaagcttagaaacaagcttatcaattgaggcaccatggggagcaataaatgtccaatcaaccttcaaacctactgtgtcagctgcgaatatagctcttagttggagctcagtggaacacaggggtaataagattttggtttcaggtagatcagaatcaatcatgaagctagaagaaaggacaggaatcagctgggatctaggggtagaagatgcttctgaatctaaattgcttactgtctctgttatggacttgtcacagatgtactctcctgtctttgagtacctatcaggtgacagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttatcaagtggaaagttgagtacattaaaacagaagctatagtgtgtgttgagcttactagccaagagagacaatgtaccttgattgaggcaggcacaagattcaacttaggtcctgtgaccatcacattgtcagagccaagaaacattcagcaaaagctccctccagagatagttacattgcaccccagaattgaagaaggtttctttgatttaatgcatgtacaaaaggtgctatcagcaagtacagtgtgtaagctacagagttgcacacatggtgtgccaggggacctacaggtctatcacataggaaacttgttaaaaggagacaaggtgaatgggcacctgattcacaaaattgaaccacacttcaacacttcctggatgtcttgggacggctgtgacctacactactactgtaatatgggggattggccatcttgcacatatactggagtcacccagcacaatcatgctgcatttgtaaacatgctcaacatcgaaactgattatacaaaaaacttccactttcactctaagagagttactgcacatggagacacaccacaattagatttgaaagctagaccaacttatggtgcaggtgaaatcactgtgctggtggaagttgctgacatggagttacacacaaagaaaattgagatatcaggtttgaagtttgcaagcttaacttgcacaggctgttatgcttgtagctctggtatctcctgtaaggttagaatccatgtagatgagccagatgagcttacagtacatgtgaagagtgaagaccccgacatagttgctgctagctcaagtctcatggctaggaagcttgaatttgggacagatagtacattcaaagccttttcagccatgcccaaaacctccttatgcttctacattgtggagagagaatattgtgaaagctgcagcaaagaagatacacaaaaatgtgttaacacaaagcttgagcaaccacagagcattttaatcgagcacaaaggcacgataattggtaagcagagcaacacctgcacagctaaagcaagctgttggctagagtcagtcaagagcttcttttatgggctaaagaacatgcttagtggcatttttggcaatgttttcataggggttttcttattctttgctccttttatccttttgatacttttctttatgtttggatggagaatcctgttctgctttaaatgttgcagaagaactagaggcctttttaagtacagacacctcaaggacgatgaagaaaccggttacaggaaaatcattgagagactgaacaacaaaaaagggaaaaacaaactgcttgatggtgaaagattagctgataggaagattgctgagctgttctccacaaagacacacattggctaa

SEQ ID NO: 3662 - RNA, 5055 nt, synthetic construct
  misc_feature 1..5055: note = derived and/or modified CDS sequence (wt) from CCHFV(UCCR4459)__KY484032.1__GP
  source 1..5055: mol_type = other RNA
atgtacacaccacttttgtgtgctgttctttgcttacagctgtggagtttagaagggtctcatggactgtccaacaaaacccaacacagtaatacaagcaccacaaaggcgcctgaagtaagccaggaatttggattgcctgtgagcacagtatcgactatcacgtcagaccctccttccatcacatccgcagtatcagtcagtggatcagaaggctcaggagacacgaacacctctccctcggtcaccacacaaggcctgactttgccagaaaccacgctggaactccttacaacaaccgacacagatgcatcaagcactgtcgtcgtcgatgtcagcacacagacggtcaaggacacccccatatcaacaacccacacaagtttgcccagtactcctagcgcgacaactacaccacagggtacacaccatactgcaaggggtctactgtcagtcaccagcacaaagccagaaggagcatcaacacaagcaaatccagaaaaaataagcatggagaccaatagcccgcgcctagccatcagcgagacaccatccttctctccaacaactcaggctcctaccgaaaacagcaaccccatcacatccaaacagctcatattctcagcacaaccagtaaccccaaacccagtgacccctccagtacagccagccctctctcagagtgacacgtccacggccatccaggatatacaccccagcccaacaagcagatctaagagaaaccttgagatggaaataattttgactttatctcagggtttgaagaagtactacggcaagatactaaaacttctggaccttactttggaagaagacactgaaggcctgctagagtggtgcaagagaaatcttggtttggtctgtgatgatgacttctttcagaagagaatagaagagttttttttgactggggagggtcacttcaatgaagtcttacagttcaaaacaccaagcacactaagccccacgggaccagcccgaactgggtcaccaacagtggaaccttttaaatcttacttcgctaaagggtttctttcaatggactcaggctacttctctgccaagtgttatccaagagcatccaattcaggacttcagctgatcaacgtcacccaacattcaactagaataacagacacacctggacccaaggtcactaatctgaagaccatcaattgcataaacttaaaggcatcagtctttaaagagcatagagagattgaaatcaatgttcttctccctcaagtcgcagttaacctctcaagctgccacgtgttgatcaaatcgcatgtctgtgactactctttggacattgatgggccagtaaggctaccccgcatccaccatgaaggaactttcataccaggaacttacaaattagttatagacaaaaaaaacaaacaaaatgacagatgcactttgatcaccaactgtgtaataaaaggaagggaaattcgtaagggccagtcagtgttaagacaatacaggacagaaatcaagattggcaaggcatcttctggttccagaagactattgtccgaagagtctggtgatgactgcatatcaagaactcagctatcgaggacagagactgcggaaattcacagtgataactatggtggtccaggtgacaagataaccatctgcaatggttcaactattgtagatcagagattgggcagtgaactagggtgttacactatcaatagagtaaagtcatttaagctttgcgagaacagtgccacaggtaaatcctgtgaaatagatagcaccccaattaaatgcaggcagggtttttgtttaaaaattactcaggagggaaggggccacgtgaagctatcaagaggttcagaagttgtcttggacgcctgtgattcaagctgtgagataatgataccaaagggcactggagacatcctagttgactgttcaggtggacagcaacatttcttaaaagataacttgattgatctgggatgcccaaacatcccactattaggtaagatggctatctacatttgtagaatgtcaaatcatcctaaaacgactatggcttttcttttttggtttagctttggttatgtgataacctgtatactctgtaaggtcatcttctacctattaatagttgtggggacgttgggaaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagacggtcttgccagacatgtaatgcagtgccctaagcggaaggaaaaagtagaagaaaccgaattatacttaaacttagaaagaatcccctgggttgttaggaaattactgcaggtgtcagaatccaccggtgtggcactaaagaggagtagttggctggttgtgctacttgtgttacttacagtttcattgtcaccagtacaatcagcacctatcggccatggaaagacagttgaaacatatcaaaccagagaagggtacacaagcatttgcctttttgtactaggaagcatcttatttatagtctcttgcctaatgaaggggttggttgacagtgttggtaacagttttttccctggtttgtccatttgtaagacatgttctattggcagcataaatggctttgagattgaatctcacaaatgttactgtagcctattttgttgcccctactgtagacactgctctgccgatagagaaatacataagttgcacttgagcatctgcaagaaaaggaagactgggagtaatgtcatgttggccgtctgtaagcgcatgtgctttagggcaactgtggaagtaagcaacaaggctctacttatccgaaacatcatcaataccacttttgttgtgtgcatactgatattagcagtttgtgttgtcagcacctccgcagtggagatggaaagcctgccagctggcacttgggagagagaggaagatctgacaaatttctgtcatcaagaatgccaagtcactgagactgaatgcctctgtccttacgaagctcttgtgctcaggaaacccttgttttcagacagtattgtcaaaggcatgaagaacttgctaaattcaacaagcttagaaacaagcttatcaattgaggcaccatggggagctataaatgtccaatcaaccttcaaacctactgtgtccgctgcgaacatagctcttagttggagctcagtggaacacaggggtaataagattttggtttcaggtagatcagagtcaattatgaagctagaggaaaggacaggaatcagctgggatctaggggtagaagatgcctctgagtctaaattgcttactgtctctattatggacttgtcacagatgtattctcctgtctttgagtacctatcaggtgatagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttgtcaagtggaaagttgagtacattaaaacagaagctatagtgtgtgttgagcttactagccaagagagacaatgtagcttgattgaggcaggcacaagattcaacttaggtcctgtgaccatcacattgtcagagccaagaaacattcagcaaaagctccctccagagatagttacattgcatcccagaattgaagaaggtttctttgatttaatgcatgtaaaaaaagtgctatcagcaagtacagtatgtaagctacagagttgcacacatggtgtgccaggggacctacaggtctaccacataggaaacttgttaaaaggagacaaggtgaatgggcacctgattcacaaaattgaaccacacttcaacacttcctggatgtcttgggacggctgtgacctagactactactgtaatatgggagactggccatcttgctcatatactggagtaacccagcacaatcatgctgcatttgtaaacatgctcaacatcgaaactgattatacaaaaatcttccactttcactctaagagagttactgcacatggagacacaccacaattagatttgaaagctagaccaacttatggtgcaggtgaaatcactgtgctagtggaagttgctgacatggagttacacacaaagaaaattgagatatcaggtttaaagtttgcaagcttaacttgcacaggctgttatgcttgtagctctggtatctcctgtaaggttagaatccatgtagatgagcctgatgagcttacagtacatgtgaagagtgaagacccagacatagttgctgctagctcaagtctcatggctagaaaacttgaatttgggacagatagcacattcaaagccttttcagccatgcccaaaacctccttgtgcttttacattgtggagagagaatattgtaaaagctgcagtaaagaagatacacaaaaatgtgtcaacacaaagcttgagcaaccacagagcattttaattgagcacaaaggaacgataattggtaagcaaaacgacacctgcacatctaaagcaggctgttggctagagtcagtcaagagcttcttttatgggctaaaaaacatgcttagtggcatttttggcaatgttttcatagggattttcttattccttgctccttttatccttttaatacttttctttatgtttggatggagaatcctgttctgctttaaatgttgcagaagaactagaggcttatttaagtacagacacctcaaggacgatgaagaaaccggttacaggaaaatcattgagaggctgaacaacaaaaaagggaaaaacaaactgcttgatggtgaaagattagctgataggaagattgctgagctgttctccacaaagacacacattggctaa

SEQ ID NO: 3663 - RNA, 5052 nt, synthetic construct
  misc_feature 1..5052: note = derived and/or modified CDS sequence (wt) from CCHFV(Ast149)__KX056054.1__GP
  source 1..5052: mol_type = other RNA
atgcatacactattagtgtgcttcattctttacctacagctgtcgggtttaggaggagctcatggacagtcaaacgcaactgaacacaacggaacaaacaccaccacagcacccggcacaagtcaaagccccaagccacccgcgagcaccactccaccacacacaccagaatcctccaccgtcaaactcaccacaccaacgagcgaaacagaaggctcaggggaaacgaccccacccccaaacaccacccagggcctgcccccaccagggaccacaccagaacgccccgcaacaaccgccacaagcacgtcaagcacagacaacatgaactccaccacacaggtgaccgacaacacccccacatcaacagtcagcacaagtccatccagcagccccagcatgccatccacatcacaaggcatacattatcccgtaaggagtctattgtcagtctcgagccctaagacagtaacaacaccgacaccaatgagccctggagagatgagcccggaaaccagcagtcagcactcagccatgagcagaataccaaccctctacacagcagcccaggtctccactgagaacgccaaccgcagcacacctagacaatcagagtcctcagcacagccggcaacccaaagcccaacaactttcccagcgcaaacaatccttctgatgagtgctgctcctaaagctattcaggacatgcatcccagcccaacaaacaggtccaagaggaaccttgaggtggaaataattttaactctgtctcaaggtctaaagaagtattatggtaaaatactgaagcttctgcaccttaccttggaagaggatactgaaggcctgttagaatggtgtaagagaaaccttgggtcaaattgtgatgatgacttctttcaaaagagaatagaagaattcttcataactggtgagggctacttcaatgaagtcctacaatttaaaacactaagcacactaagccccacggagccgtctcatgtcaggctaccaacagcagagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatctactcacatgtctgtgattactctttagacactgacgggccagtgaggcttcctcgcattcaccatgagggtactttcataccaggaacttataaaatagtgatagacaaaaaaaataagctaaatgaccgatgctcgctagtcactaactgtgtgataaagggaagagaggttcgtaagggccaatcagtgctgaggcagtacaaaacagaaattaagataggcaaggcatcaacaggctctaggaaactactgtccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttattcgttgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgaagcagctggctgattgtgctacttgtgttactcacagtctcattgtcaccggttcaatcagcacctgttggtcatggtaagacaatcgaaacatatcagaccagagaaggattcacaaatatctgtctctttatgttaggaagcatcctattcatagtttcttgcctggtaaaggggctggttgacagtgtcagtgacagcttcttccccggcctatctgtctgtaagacatgctctattggcagtataaatggctttgaaattgaatcgcacaaatgctactgtagtttattttgctgcccctactgtaggcactgctctgctgacagagaaattcaccagctgcacttgggtatctgcaaaaaaagaaaaacggggagcaatgtcatgctggctgtctgcaagcgcatgtgctttaaggcaaccatagaagcaagcagaagagccctacccatccgaagcattatcaataccacttttgtaatatgcatactaacattagcaatctgtgttgttagcacctctgcagtagagatggaaaatcttccagcaggcacttgggagagagaggaagacctgacaaatttctgccatcaggaatgccaggtaaccgagacggaatgcctctgtccatacgaagctcttgtgctcaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaaggaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgaggtatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttgtgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggcgcttttctttatatttggatggaaaatcttgttttgctttaagtgttgcaggaggaccagaggcttgtttaagtatagacacctcaaagatgatgaggaaacaggctacagaaagattattgaaagactgaacagcaaaaaaggaaaaaacagactgcttgatggtgagaggttggctgataggaaaattgctgagctgttctctacaaaaacacacattggctaa

SEQ ID NO: 3664 - RNA, 5052 nt, synthetic construct
  misc_feature 1..5052: note = derived and/or modified CDS sequence (wt) from CCHFV(Ast137)__KX056057.1__GP
  source 1..5052: mol_type = other RNA
atgcatacactattagtgtgcttcattctttacctacagctgtcgggtttaggaggagctcatggacagtcaaacgcaactgaacacaatggaacaaacaccaccacagtacccggcacaagtcaaagccccaagccacccgcaagcaccactctaccacacacaccagaatcctccaccgtcaaactcaccacaccaacaagcgaaacagaaggctcaggggaaacgaccccacccccaaacaccacccagggcctgcccccaccagggaccacaccagagcgccccgcaacaaccgccacaagcacgtcaagcacagacaacatgaactccaccacacaggtgaccgacaacacccccacatcaacagtcagcataagtccatccagcagccccagcatgccatccacatcacaaggcatacattatcccgtaaggagtctattgtcagtctcgagccctaagacagtaacaacaccgacaccaatgagccctggagagatgagcccggaaaccagcagtcagcactcagccatgagcagaataccaaccctctacacagcagcccaggtctccactgagaacaccaaccgcagcacacctagacaatcagagtcctcagcacagccggcaacccaaagcccaacaactttcccagcgcaaacaatccttctgatgagtgctgctcctaaagctattcaggacatgcatcccagcccaacaaacaggtccaagaggaaccttgaggtggaaataattttaactctgtctcaaggtctaaagaagtattacggtaaaatactgaagcttctgcaccttaccttggaagaggatactgaaggcctgttagaatggtgtaagagaaaccttgggtcaaattgtgatgatgacttctttcaaaagagaatagaagaattcttcataactggtgaaggctacttcaatgaagtcctacaatttaaaacactaagcacactaagccccacggagccgtctcatgtcaggctaccaacagcagagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgagggtactttcataccaggaacttataaaatagtgatagacaaaaaaaataagctaaatgaccgatgctcgctagtcactaactgtgtgataaagggaagagaggttcgtaagggccaatcagtactgaggcagtacaaaacagaaattaagataggcaaggcatcaacaggctctaggaaactactgtccgaagagccaggtgacgactgcatatcaagaactcagctattgaagacagaaacagcagagatccatgacgacaactatggtggtccaggtgacaaaataactatctgcaatggttcaaccattgtggatcagagactgggcagtgaactagggtgttataccatcaacagggtgaagtcattcaagctatgcgaaaacagtgccacagggaaaacctgtgagatagacagcactccggtcaagtgcaggcaagggttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaagatggccattcacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgaagcagctggctgattgtgctgcttgtgttactcacagtctcattgtcaccggttcaatcagcacctgttggtcatggtaagacaatcgaaacatatcagaccagagaaggattcacaaatatctgtctctttatgttaggaagcatcctattcatagtttcttacctggtaaaggggctggttgacagtgtcagtgacagcttcttccccggcctatctgtctgtaagacatgctctattggcagtataaatggctttgaaattgaatcgcacaaatgctactgtagtttattttgctgcccctactgtaggcactgctctgctgacagagaaattcaccagctgcacttgggtatctgcaaaaaaagaaaaacggggagcaatgtcatgctggctgtctgcaagcgcatgtgctttaaggcaaccatagaagcaagcagaagagccctactcatccgaagcattatcaataccacttttgtaatatgcatcctaacattagcaatctgtgttgttagcacctctgcagtagagatggaaaatcttccagcaggcacttgggagagagaggaagacctgacaaatttctgccatcaggaatgccaggtaaccgagacggaatgcctctgtccatacgaagctcttgtgctcaggaaacctcttttcttagacagtatagttaaaggtacgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaaggaacattcagcagaagcttccccctgagatcattacgctgcatcctaaaattgaagaaggcttctttgacttaatgcatgtgcaaaaagtgttatctgcaagtacagtgtgtaaactgcagagttgcacacatggtataccgggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagggtcacagcacatggagacacaccacaattagacttaaaagcaaggccgacctacggtgcaggtgagatcactgtgctggttgaggttgctgacatggagttgcataccaagaaagttgaggtatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttgtgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggtgcttttctttatatttggatggaaaatcttgttttgctttaagtgttgcaggaggaccagaggcttgtttaagtatagacacctcaaagatgatgaggaaacaggctacagaaagattattgaaagactgaacagcaaaaaaggaaaaaacagactgcttgatggtgagaggttggctgataggaaaattgctgagctgttctctacaaaaacacacattggctaa

SEQ ID NO: 3665 - RNA, 5055 nt, synthetic construct
  misc_feature 1..5055: note = derived and/or modified CDS sequence (wt) from CCHFV(C-68031)__DQ211629.1__GP
  source 1..5055: mol_type = other RNA
atgtacacaccacttttgtgtgctgttctttgcttacagctgtggagtttagaagggtctcatggactgtccaacaaaacccaacacagtaatacaagcaccacaaaggcgcctgaagtaagccaggaatttggattgcctgtgagcacagtatcgactatcacgtcagaccctccttccatcacatccgcagtatcagtcagtggatcagaaggctcaggagacacgaacacctctccctcggtcaccacacaaggcctgactttgccagaaaccacgctggaactccttacaacaaccgacacagatgcatcaagcactgtcgtcgtcgatgtcagcacacagacggtcaaggacacccccatatcaacaacccacacaagtttgcccagtactcctagcgcgccaactacaccacagggtacacaccatactgcaaggggtctactgtcagtcaccagcacaaagccagaaggagcatcaacacaagcaaatccagaaaaaataagcatggagaccaatagcccgcgcctagccatcagcgagacaccatccttctctccaacaactcaggctcctaccgaaaacagcaaccccatcacatccaaacagctcatactctcagcacaaccagtaaccccaaacccagtgacccctccagtacagccagccctctctcagagtgacacgtccacggccatccaggatatacaccccagcccaacaagcagatctaagagaaaccttgagatggaaataattttgactttatctcagggtttgaagaagtactacggcaagatactaaaacttctggaccttactttggaagaagacactgaaggcctgctagagtggtgcaagagaaatcttggtttggtctgtgatgatgacttctttcagaagagaatagaagagttttttttgactggggagggtcacttcaatgaagtcttacagttcaaaacaccaagcacactaagccccacgggaccagcccgaactgggtcaccaacagtggaaccttttaaatcttacttcgctaaagggttcctttcaatggactcaggctacttctctgccaagtgttatccaagagcatccaattcaggacttcagctgatcaacgtcacccaacattcaactagaataacagacacacctggacccaaggtcactaatctgaagaccatcaattgcataaacttaaaggcatcagtctttaaagagcatagagagattgaaatcaatgttcttctccctcaagtcgcagttaacctctcgagctgccacgtgttgatcaaatcgcatgtctgtgactactctttggacattgatgggccagtaaggctaccccgcatccaccatgaaggaactttcataccaggaacttacaaattagttatagacaaaaaaaacaaacaaaatgacagatgcactttgatcaccaactgtgtaataaaaggaagggaaattcgtaagggccagtcagtgttaagacaatacaggacagaaatcaagattggcaaggcatcttctggttccagaagactattgtccgaagagtctggtgatgactgcatatcaagaactcagctatcgaggacagagactgcggaaattcacagtgataactatggtggtccaggtgacaagataaccatctgcaatggttcaactattgtagatcagagattgggcagtgaactagggtgttacactatcaatagagtaaagtcatttaagctttgcgagaacagtgccacaggtaaatcctgtgaaatagatagcaccccaattaaatgcaggcagggtttttgtttaaaaattactcaggagggaaggggccacgtgaagctatcaagaggttcagaagttgtcttggacgcctgtgattcaagctgtgagataatgataccaaagggcactggagacatcctagttgactgttcaggtggacagcaacatttcttaaaagataacttgattgatctgggatgcccaaacatcccactattaggtaagatggctatctacatttgtagaatgtcaaatcatcctaaaacgactatggcttttcttttttggtttagctttggttatgtgataacctgtatactctgtaaggtcatcttctacctattaatagttgtggggacgttgggaaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagacggtcttgccagacatgtaatgcagtgccctaagcggaaggaaaaagtagaagaaaccgaattatacttaaacttagaaagaatcccctgggttgttaggaaattactgcaggtgtcagaatccaccggtgtggcactaaagaggagtagttggctggttgtgctacttgtgttacttacagtttcattgtcaccagtacaatcagcacctatcggccatggaaagacagttgaaacatatcaaaccagagaagggtacacaagcatttgcctttttgtactaggaagcatcttatttatagtctcttgcctaatgaaggggttggttgacagtgttggtaacagttttttccctggtttgtccatttgtaagacatgttctattggcagcataaatggctttgagactgaatctcacaaatgttactgtagcctattttgttgcccctactgtagacactgctctgccgatagagaaatacataagttgcacttgagcatctgcaagaaaaggaagactgggagtaatgtcatgttggccgtctgtaagcgcatgtgctttagggcaactgtggaagtaagcaacaaggctctacttatccgaaacatcatcaataccacttttgttgtgtgcatactgatattagcagtttgtgttgtcagcacctccgcagtggagatggaaagcctgccagctggcacttgggagagagaggaagatctgacaaatttctgtcatcaagaatgccaagtcactgagactgaatgcctctgtccttacgaagctcttgtgctcaggaaacccttgttttcagacagtattgtcaaaggcatgaagaacttgctaaattcaacaagcttagaaacaagcttatcaattgaggcaccatggggagctataaatgtccaatcaaccttcaaacctactgtgtccgctgcgaacatagctcttagttggagctcagtggaacacaggggtaataagattttggtttcaggtagatcagagtcaattatgaagctagaggaaaggacaggaatcagctgggatctaggggtagaagatgcctctgagtctaaattgcttactgtctctattatggacttgtcacagatgtattctcctgtctttgagtacctatcaggtgatagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttgtcaagtggaaagttgagtacattaaaacagaagctatagtgtgtgttgagcttactagccaagagagacaatgtagcttgattgaggcaggcacaagattcaacttaggtcctgtgaccatcacattgtcagagccaagaaacattcagcaaaagctccctccagagatagttacattgcatcccagaattgaagaaggtttctttgatttaatgcatgtaaaaaaagtgctatcagcaagtacagtatgtaagctacagagttgcacacatggtgtgccaggggacctacaggtctaccacataggaaacttgttaaaaggagacaaggtgaatgggcacctgattcacaaaattgaaccacacttcaacacttcctggatgtcttgggacggctgtgacctagactactactgtaatatgggggactggccatcttgctcatatactggagtaacccagcacaatcatgctgcatttgtaaacatgctcaacatcgaaactgattatacaaaaatcttccactttcactctaagagagttactgcacatggagacacaccacaattagatttgaaagctagaccaacttatggtgcaggtgaaatcactgtgctagtggaagttgctgacatggagttacacacaaagaaaattgagatatcaggtttaaagtttgcaagcttaacttgcacaggctgttatgcttgtagctctggtatctcctgtaaggttagaatccatgtagatgagcctgatgagcttacagtacatgtgaagagtgaagacccagacatagttgctgctagctcaagtctcatggctagaaaacttgaatttgggacagatagcacattcaaagccttttcagccatgcccaaaacctccttgtgcttttacattgtggagagagaatattgtaaaagctgcagtaaagaagatacacaaaaatgtgtcaacacaaagcttgagcaaccacagagcattttaattgagcacaaaggaacgataattggtaagcaaaacgacacctgcacatctaaagcaggctgttggctagagtcagtcaagagcttcttttatgggctaaaaaacatgcttagtggcatttttggcaatgttttcatagggattttcttattccttgctccttttatccttttaatacttttctttatgtttggatggagaatcctgttctgctttaaatgttgcagaagaactagaggcctatttaagtacagacacctcaaggacgatgaagaaaccggttacaggaaaatcattgagaggctgaacaacaaaaaagggaaaaacaaactgcttgatggtgaaagattagctgataggaagattgctgagctgttctccacaaagacacacattggctaa

SEQ ID NO: 3666 - RNA, 5052 nt, synthetic construct
  misc_feature 1..5052: note = derived and/or modified CDS sequence (wt) from CCHFV(K340_6)__KX013475.1__GP
  source 1..5052: mol_type = other RNA
atgcatacactattagtgtgcttcattctttacctacagctgtcgggtttaggaggagctcatgtacagtcaaacgcaactgaacacaatggaacaaacaccaccacagcacccggcacaagtcaaagccccaagccacccgcgagcaccactctaccacacacaccagaatcctccaccgtcaaacccaccacaccaacaagcgaaacagaaggctcaggggaaacgaccccacccccaaacaccacccagggcctgcccccaacagggaccacaccagaacgctccgcaacaaccgccacaagcacgtcaagcacagacaacatgaactccaccacacaggtgaccgacagcacccccacatcaacagtcagcacaagtccatccagcagctccagcatgccatccacatcacaaggcatacatcatcccgtaaggagtctattgtcagtctcgagccctaagacagtaacaacaccgacaccaatgagccctggagagatgagcccggaaaccagcagtcagcactcagccatgagcagagtaccaaccctctacacagcaacccaggtctccactgagaacaccgaccgcagcacacctagacaatctgagtcctcagtacagccggcaacccaaagcccaataacttccccagcgcaaacaatccttctgatgagtgctgctcctaaagctattcaggacatgcatcccagcccaacaaacaggtccaagaggaaccttgaggtggaaataattttaactctgtctcaaggtctaaagaaatattacggtaaaatactgaagcttctgcaccttaccttggaagaggatactgaaggcctgttagaatggtgtaagagaaaccttgggtcaaattgtgatgatgacttctttcaaaagagaatagaagaattcttcataactggtgagggctacttcaatgaagtcctacaatttaaaacactaagcacactaagccccacggagccgtctcatgtcaggctaccaacagcggagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtactttcataccaggaacttataaaatagtgatagacagaaaaaataagctaaatgaccgatgctcgctagtcactaactgtgtgataaaaggaagagaggttcgtaagggccaatcagtgctgaggcagtacaaaacagaaattaagataggcaaggcatcaacaggctctaggaaactactgtccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtctttcaagctatgcgaaaacagtaccacagggaaaacctgtgagatagacagcactccggtcaagtgcaggcaaggcttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgccattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctggctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggtcatggtaagacaatcgaaacatatcagaccagagagggattcacaagtatctgtctctttatgttaggaagcatcctattcatagtttcttgcctggtaaaggggctggttgacagtgtcagtgacagcttcttccccggcctgtctgtctgtaagacatgctctattggcagtataaatggctttgaaattgaatcgcataaatgctactgtagtttattttgttgcccctactgtaggcactgctctgctgacagagaaattcaccagttgcacttgagtatctgcaaaaaaagaaaaacggggagcaatgtcatgctggctgtctgcaagcgcatgtgctttaaggcaaccatagaagcaagcagaagagccctgctcatccgaagcattatcaataccacttttgtaatgtgcattctaacattagcaatctgtgttgttagcacctctgcagtagagatggaagaccttccagcaggcacttgggagagagaggaagacctaacaaatttctgccatcaggaatgccaggtgaccgagacggaatgcctctgtccatacgaagctcttgtgctcaggaaacccctttccttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagagtaaacggccatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttactgacatggagttgcataccaaaaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtagttttttcgtaggcattttgttattccttgcccctttcgtcttgttggtgcttttctttatgtttggatggaaaatcttgttttgctttaagtgttgcaggaggaccagaggcttgtttaagtatagacacttcaaagatgacgaggaaacaggctacagaaggattattgaaagactgaacagcaaaaaaggaaaaaacagactgcttgatggtgagaggttggctgataggaaaattgctgagctgttctctacaaaaacacacattggctaa

SEQ ID NO: 3667 - RNA, 5055 nt, synthetic construct
  misc_feature 1..5055: note = derived and/or modified CDS sequence (wt) from CCHFV(Hy13)__AY900145.1__GP
  source 1..5055: mol_type = other RNA
atgtacacaccacttttgtgtgctgttctttgcttacagctgtggagtttagaagggtctcatggactgtccaacaaaacccaacacagtaatacaagcaccacaaaggcgcctgaagtaagccaggaatttggattgcctgtgagcacagtatcgactatcacgtcagaccctccttccatcacatccgcagtatcagtcagtggatcagaaggctcaggagacacgaacacctctccctcggtcaccacacaaggcctgactttgccagaaaccacgctggaactccttacaacaaccgacacagatgcatcaagcactgtcgtcgtcgatgtcagcacacagacggtcaaggacacccccatatcaacaacccacacaagtttgcccagtactcctagcgcgacaactacaccacagggtacacaccatactgcaaggggtctactgtcagtcaccagcacaaagccagaaggagcatcaacacaagcaaatccagaaaaaataagcatggagaccaatagcccgcgcctagccatcagcgagacaccatccttctctccaacaactcaggctcctaccgaaaacagcaaccccatcacatccaaacagctcatattctcagcacaaccagtaaccccaaacccagtgacccctccagtacagccagccctctctcagagtgacacgtccacggccatccaggatatacaccccagcccaacaagcagatctaagagaaaccttgagatggaaataattttgactttatctcagggtttgaagaagtactacggcaagatactaaaacttctggaccttactttggaagaagacactgaaggcctgctagagtggtgcaagagaaatcttggtttggtctgtgatgctgacttctttcagaagagaatagaagagttttttttgactggggagggtcacttcaatgaagtcttacagttcaaaacaccaagcacactaagccccacgggaccagcccgaactgggtcaccaacagtggaaccttttaaatcctacttcgctaaagggtttctttcaatggactcaggctacttctctgccaagtgttatccaagagcatccaattcaggacttcagctgatcaacgtcacccaacattcaactagaataacagacacacctggacccaaggtcactaatctgaagaccatcaattgcataaacttaaaggcatcagtctttaaagagcatagagagattgaaatcaatgttcttctccctcaagtcgcagttaacctctcaagctgccacgtgttgatcaaatcgcatgtctgtgactactctttggacattgatgggccagtaaggctaccccgcatccaccatgaaggaactttcataccaggaacttacaaattagttatagacaaaaaaaacaaacaaaatgacagatgcactttgatcaccaactgtgtaataaaaggaagggaaattcgtaagggccagtcagtgttaagacaatacaggacagaaatcaagattggcaaggcatcttctggttccagaagactattgtccgaagagtctggtgatgactgcatatcaagaactcagctatcgaggacagagactgcggaaattcacagtgataactatggtggtccaggtgacaagataaccatctgcaatggttcaactattgtagatcagagattgggcagtgaactagggtgttacactatcaatagagtaaagtcatttaagctttgcgagaacagtgccacaggtaaatcctgtgaaatagatagcaccccaattaaatgcaggcagggtttttgtttaaaaattactcaggagggaaggggccacgtgaagctatcaagaggttcagaagttgtcttggacgcctgtgattcaagctgtgagataatgataccaaagggcactggagacatcctagttgactgttcaggtggacagcaacatttcttaaaagataacttgattgatctgggatgcccaaacatcccactattaggtaagatggctatctacatttgtagaatgtcaaatcatcctaaaacgactatggcttttcttttttggtttagctttggttatgtgataacctgtatactctgtaaggtcatcttctacctattaatagttgtggggacgttgggaaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagacggtcttgccagacatgtaatgcagtgccctaagcggaaggaaaaagtagaagaaaccgaattatacttaaacttagaaagaatcccctgggttgttaggaaattactgcaggtatcagaatccaccggtgtggcactaaagaggagtagttggctggttgtgctacttgtgttacttacagtttcattgtcaccagtacaatcagcacctatcggccatggaaagacagttgaaacatatcaaaccagagaagggtacacaagcatttgcctttttgtactaggaagcatcttatttatagtctcttgcctaatgaaggggttggttgacagtgttggtaacagttttttccctggttcgtccatttgtaagacatgttctattggcagcataaatggctttgagattgaatctcacaaatgttactgtagcctattttgttgcccctactgtagacactgctctgccgatagagaaatacataagttgcacttgagcatctgcaagaaaaggaagactgggagtaatgtcatgttggccgtctgtaagcgcatgtgctttagggcaactgtggaagtaagcaacaaggctctacttatccgaaacatcatcaataccacttttgttgtgtgcatactgatattagcagtttgtgttgtcagcacctccgcagtggagatggaaagcctgccagctggcacttgggagagagaggaagatctgacaaatttctgtcatcaagaatgccaagccactgagactgaatgcctctgtccttacgaagctcttgtgctcaggaaacccttgttttcagacagtattgtcaaaggcatgaagaacttgctaaattcaacaagcttagaaacaagcttatcaattgaggcaccatggggagctataaatgtccaatcaaccttcaaacctactgtgtccgctgcgaacatagctcttagttggagctcagtggaacacaggggtaataagattttggtttcaggtagatcagagtcaattatgaagctagaggaaaggacaggaatcagctgggatctaggggtagaagatgcctctgagtctaaattgcttactgtctctattatggacttgtcacagatgtattctcctgtctttgagtacctatcaggtgatagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagatcacatgtttgtcaagtggaaagttgagtacattaaaacagaagctatagtgtgtgttgagcttactagccaagagagacaatgtagcttgattgaggcaggcacaagattcaacttaggtcctgtgaccatcacattgtcagagccaagaaacattcagcaaaagctccctccagagatagttacattgcatcccagaattgaagaaggtttctttgatttaatgcatgtaaaaaaagtgctatcagcaagtacagtatgtaagctacagagttgcacacatggtgtgccaggggacctacaggtctaccacataggaaacttgttaaaaggagacaaggtgaatgggcacctgattcacaaaattgaaccacacttcaacacttcctggatgtcttgggacggctgtgacctagactactactgtaatatgggagactggccatcttgctcatatactggagtaacccagcacaatcatgctgcatttgtaaacatgctcaacatcgaaactgattatacaaaaatcttccactttcactctaagagagttactgcacatggagacacaccacaattagatttgaaagctagaccaacttatggtgcaggtgaaatcactgtgctagtggaagttgctgacatggagttacacacaaagaaaattgagatatcaggtttaaagtttgcaagcttaacttgcacaggctgttatgcttgtagctctggtatctcctgtaaggttagaatccatgtagatgagcctgatgagcttacagtacatgtgaagagtgaagacccagacatagttgctgctagctcaagtctcatggctagaaaacttgaatttgggacagatagcacattcaaagccttttcagccatgcccaaaacctccttgtgcttttacattgtggagagagaatattgtaaaagctgcagtaaagaagatacacaaaaatgtgtcaacacaaagcttgagcaaccacagagcattttaattgagcacaaaggaacgataattggtaagcaaaacgacacctgcacatctaaagcaggctgttggctagagtcagtcaagagcttcttttatgggctaaaaaacatgcttagtggcatttttggcaatgttttcatagggattttcttattccttgctccttttatccttttaatacttttctttatgtttggatggagaatcctgttctgctttaaatgttgcagaagaactagaggcttatttaagtacagacacctcaaggacgatgaagaaaccggttacaggaaaatcattgagaggctgaacaacaaaaaagggaaaaacaaactgcttgatggtgaaagattagctgataggaagattgctgagctgttctccacaaagacacacattggctaa

SEQ ID NO: 3668 - RNA, 5052 nt, synthetic construct
  misc_feature 1..5052: note = derived and/or modified CDS sequence (wt) from CCHFV(4574-ST-2008)__KR814870.1__GP
  source 1..5052: mol_type = other RNA
atgcatacactattagtgtgcttcattctttacctacagctgttgggtccaggaggagcccatggacagccaaacgcaactgaacacaacagaacaaacaccaccacagcacccagcacaagccaaagccccaagccacccgtgagcacagccccaccacacgcactggaatcacccaccatcaaatccaccacaccaacaagcgaaacagaaggctcaggggaaacgacctcacccccaaacaccacccagggcccgtctctaccagagaccacaccaaaacgccccgcaacaactgccacaagtacgccaagcacagacaacacaaattccaccacacatgtgaccgacaacaaccctacatcaacaatcagcacaagtccatccagcagccccagcacgccatccacaccacgaggcatacatcatcctgcaaggaatctattgtcagtctcgagccctaagacagcaacaacaccaacaccaacgagccctggggagataagctcagaaaccagcagtctgcactcagccatgagcagaacatcaaccctctacacagcaacccaggcctccactgaaaatgccaaccacagcgcacctagacagtctgagtccccagcacagccgacaaccacaagcctaatgacctccccagcacaatcaatccttgtaatgagtgctgctcctacagctattcagaacatacatcccagcccaacgaataggtctaagaggaaccttgagatggaaataattttaactctgtctcaaggtctaaagaaatactacggtaagatactgaagcttctgcacctcaccttggaagaggacactgaaggcctgttagaatggtgtaagagaaaccttgggtcaaactgtgaggatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagatcatctacttcagggcttcagctgatcaatgttacccaacacccagctagaatagcagaaacacctggacccaagacaacgagtctgaaaaccatcaactgtataaacctaagagcatcagtcttcaaagaacacagagaaattgagatcaatgtgcttcttcctcagattgcagtcaacctctcaaattgccatgttgtaatcaattcacatgtctgtgattattctttagacactgatgggccagtgaggcttcctcacatttaccatgaaggaactttcataccaggaacttacaaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggtatcaacaggctctaggaaactactgtccgaagagtcaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagaaggaaggggccacgtaaaattatctagaggctcagaggttgttttggatgcttgcgactcaagctgcgaagtaatgatacctaaaggcactggagatatcttggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtttattttgcaaggctcttttttattcattgataatcattgggacactagggaaaaagatcaagcaatatagggaattgagacctcaaacctgtaccatatgtgagacagctcctgtcaatgcaatagatgctgaaatgcatgaccttaactgcagttacaatatatgtccttattgtgcatcaagattgacctccgatgggctagctaggcatgtgccacaatgccccaagcggaaggaaaaagttgaggagactgagctgtacttgaacctggaaagaataccttggattgtcagaaagctattgcaagtgtcagagtccactggtgtggcattgaagcgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctccattggcagtataaatggctttgaaattgaatcgcataaatgctactgtagcctactttgctgcccctactgtaggcactgctctgctgacagagaaatccaccagttacacttgagtatctgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattaacaatctgtgttgttagcacctctgcagtagagatggaaaaccttccatcaggcacttgggagaaagaggaagacctgacaaatttctgtcatcaggaatgccaggtgaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaagtggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtacaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccaacctacggtgcaggtgagatcactgtgctggttgaggttgctgacatggagttgcataccaagaaagttgagatatcaggcctgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggcaactttttcataggcattttgttattccttgccccttttgtcctgttggtgcttttctttatgtttggatggaaaatcttgttttgcttcaaatgttgcaggagggccagaggcttgcttaagtatagacacctaaaagacgatgaggaaacaggctacagaaagattattgaaaggctgaacaacaaaaaaggaaaaaacagactgcttgatggtgaaaggttggctgataggaaaattgctgagctgttctccacaaaaacacacattggttaa

SEQ ID NO: 3669 - RNA, 5052 nt, synthetic construct
  misc_feature 1..5052: note = derived and/or modified CDS sequence (wt) from CCHFV(75-ST-2010)__KR814864.1__GP
  source 1..5052: mol_type = other RNA
atgcatacactattagtgtgcttcattctttacctacagctgttgggtccaggaggagcccatggacagccaaacgcaactgaacacaacagaacaaacaccaccacagcacccagcacaagccaaagccccaagccacccgtgagcacagccccaccacacgcactggaatcacccaccatcaaatccaccacaccaacaagcgaaacagaaggctcaggggaaacgaccccacccccaaacaccacccagggcccgtctctaccagagaccacaccagaacgccccgcaacaactgccacaagtacgccaagcacagacaacacaaattccaccacacatgtgaccgacaacaaccctacatcaacaatcagcacaagtccatccagcagccccagcacgccatccacaccacgaggcatacatcatcctgcaaggaatctattgtcagtctcgagccctaagacagcaacaacaccaacaccaacgagccctggggagataagctcagaaaccagcagtctgcactcagccatgagcagaacatcaaccctctacacagcaacccaggcctccactgaaaatgccaaccacagcgcacctagacagtctgagtccccagcacagccgacaaccacaagcctaatgacctccccagcacaatcaatccttgtaatgagtgctgctcctacagctattcagaacatacatcccagcccaacgaataggtctaagaggaaccttgagatggaaataattttaactctgtctcaaggtctaaagaaatactacggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagatcatctacttcagggcttcagctgatcaatgttacccaacacccagctagaatagcagaaacacctggacccaagacaacgagtctgaaaaccatcaactgtataaacctaagagcatcagtcttcaaagaacacagagaaattgagatcaatgtgcttcttcctcagattgcagtcaacctctcaaattgccatgttgtaatcaattcacatgtctgtgattattctttagacactgatgggccagtgaggcttcctcacatttaccatgaaggaactttcataccaggaacttacaaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggtatcaacaggctctaggaaactactgtccgaagagtcaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagaaggaaggggccacgtaaaattatctagaggctcagaggttgttttggatgcttgcgactcaagctgcgaagtaatgatacctaaaggcactggagatatcttggtggactgttcaggtggacagcaacatttcttaaaagacaacttaattgacctagggtgcccccatatcccgctattgggtaaaatggccatttacatctgcagaatgtcaaatcaccctagaacaactatggcttttctcttctggttcagctttggctatgtgatcacctgtttattttgcaaggctcttttttattcattgataatcattgggacactagggaaaaagatcaagcaatatagggaattgagacctcaaacctgtaccatatgtgagacagctcctgtcaatgcaatagatgctgaaatgcatgaccttaactgcagttacaatatatgtccttattgtgcatcaagattgacctccgatgggctagctaggcatgtgccacaatgccccaagcggaaggaaaaagttgaggagactgagctgtacttgaacctggaaagaataccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctccattggcagtataaatggctttgaaattgaatcgcataaatgctactgtagcctactttgctgcccctactgtaggcactgctctgctgacagagaaatccaccagttacacttgagtatctgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattaacaatctgtgttgttagcacctctgcagtagagatggaaaaccttccatcaggcacttgggagaaagaggaagacctgacaaatttctgtcatcaggaatgccaggtgaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaagtggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtacaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccaacctacggtgcaggtgagatcactgtgctggttgaggttgctgacatggagttgcataccaagaaagttgagatatcaggcctgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggcaactttttcataggcattttgttattccttgccccttttgtcctgttggtgcttttctttatgtttggatggaaaatcttgttttgcttcaaatgttgcaggagggccagaggcttgcttaagtatagacacctaaaagacgatgaggaaacaggctacagaaagattattgaaaggctgaacaacaaaaaaggaaaaaacagactgcttgatggtgaaaggttggctgataggaaaattgctgagctgttctccacaaaaacacacattggttaa

SEQ ID NO: 3670 - RNA, 5052 nt, synthetic construct
  misc_feature 1..5052: note = derived and/or modified CDS sequence (wt) from CCHFV(37-R-2013)__KR814858.1__GP
  source 1..5052: mol_type = other RNA
atgcatacgctattagtgtgcttcattctttacctacagctgttgggtctaggaggagctcatagacagtcaaacgcaactgaacacaacggaacaaacaccaccacagcacccagcacaagccaaagccccaagccacctgtgagcacagccccaccacacgcaccagaaacatccaccatcaaacccaccacaccagcaagcgaaacagaaggctcaggggaaacgaccccacccccaaacaccacccagggcccgtctccaccagaggccacaccagaacgccccgcaacaactgtcacaagtacgccaagcacagacaacacgaactccaccacacacgcgaccgacaacaaccctacatcaacaatcagcacaagtccatccagcagccccagcacgccatccacaccacaaggcatacatcatcctgcaaggaatctattgtcagtctcgagccctaagacagcaacaacaccaacaccaacgagccctggggatataagctcagaaaccagcagtctgcactcagccatgagcagaacaccaaccctccacacagcaacccaggcctccactgaaaatgccaaccacagcgcacctagacagtctgagtcctcagcacagcagacaaccacaagcccaatgacttccccagcacaaccaatccttgtaatgagtgctgctcctacagctattcagaacatacatcccagcccaacgaataggtctaagaggaaccttgagatggaaataattttaactctgtctcaaggtctaaagaaatactatggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagattaactacttcagggcttcagctgatcaatgtcacccaacacccagctagaatagcagaaacacctggacccaagacaacaagtctgaaaaccatcaactgtataaacctaagagcatcagtcttcaaagaacacagagaaattgagatcaatgtgctccttcctcagattgcagtcaacctctcaaattgccatgttgtaatcaattcacatgtctgtgattattctttagacactgatgggccagtgaggcttcctcacatttaccatgaagggactttcataccaggaacttataaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggcatcaacaggctctaggaaactactgtccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgacacaagctgcgaagtaatgatacctaaaggcactggagatatcctggtggactgttcaggtggacagcaacatttcttaaaagacaatttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtgtctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcatcagttacacttgagtatctgcaaaaaaagaaaaatgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagatgatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacttgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgttacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggttaa

SEQ ID NO: 3671 - RNA, 5052 nt, synthetic construct
  misc_feature 1..5052: note = derived and/or modified CDS sequence (wt) from CCHFV(Kashmanov)__DQ211631.1__GP
  source 1..5052: mol_type = other RNA
atgcatacactattagtgtgcttcattctttacctacagctgttgggtctaggaggagctcatggacagtcaaacgcaactgaacacaacggaacaaacaccaccacagcacccagcacaagtcaaagccccaagccacttgtgagcacagccccaccacacgcactggaatcatccaccatcaaacccaccacaccagcaagcgaaacagaaggctcaggggaaacgaccccacccccaaacaccacccagggcccgtctccaccagagaccacaccagaacgccccgcaacaactgccacaagtacgccaagcacagacaacacgaattccaccacacatgtgaccgacaacaaccctacatcaacaatcagcacaagtccatccagcagccccagcacgccatccacaccacaaggcatacatcatcctgcaaggaatctattgtcagtctcgagccctaagacagcaacaacaccaacaccaacgagccctggggagataagctcagaagccagcagtctgcactcagccatgagcagaacatcaaccctctacacagcaacccaggtctccactgaaaatgccaaccacagcgcacctagacagtctgagtcctcagcacagccgacaaccacaagcccaatgacttccccagcacaatcaatccttgtaatgagtgctgctcctatagctattcagaacatacatcccagcccaacgaataggtctaagaggaaccttgagatggaaataattttaactctgtctcaaggtctaaagaaatactacggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccgggccaccaacagtggaacccttcaaatcttacttcgctaagggcttcctttcaatagattcaggttacttctctgccaaatgttatccaagatcatctacttcagggcttcagctgatcaatgttacccaacacccagctagaatagcagaaacacctggacccaagacaacaagtctgaaaaccatcaactgtataaacctaagagcatcagtcttcaaagaacacagagaaattgagatcaatgtgcttcttcctcagattgcagtcaacctctcaaattgccatgttgtaatcaattcacatgtctgtgattattctttagacactgatgggccagtgaggcttcctcacatttaccatgaagggactttcataccaggaacttataaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggcatcaacaggctctaggaaactactgtccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtactatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgcactattggcagtataaatggctttgaaattgaatcgcataaatgctactgtagcctattttgctgcccctactgtaggcactgctctgctgacagagaaattcaccagttacacttgagtatctgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaattcgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggataggataaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggttaa

SEQ ID NO: 3672 - RNA, 5052 nt, synthetic construct
  misc_feature 1..5052: note = derived and/or modified CDS sequence (wt) from CCHFV(Haskovo-V46/13)__KR092379.1__GP
  source 1..5052: mol_type = other RNA
atgcatacactattagtgtgcttcattctttacctacagctgttgggtctaggaggagctcatggacagtcaaacacaactgaacacaatggaacaaacaacaccacagcacccggcacaagccaaagccccaagccacacatgagcacaaccccaccacacgcaccggaatcatccaccatcaaacccaccacgccaacaagcgaaacagaaggctcaggggaaacgaccccaccctcaaataccacccagggcccgtccccaccagagaccacatcggaacgccctgcaacaaccgccataagcacgtcaagcacagacaacatgaaccccacctcacagatgactgacaacacccccacatcaacagtcagcataagcccatccagcagccccagcacgccatccacaccacaaggcatgcatcatcctgcaaggagtctattgtcagtctcgagccctaagacagcaacaacaccaacaccaacgagccctgtagaggtgggctcggaaaccagcagtcagcactcagccatgagcagtacaccaaccccccacacagcaactcaggtctccactgagaacaccaaccacagcacacctagacaatctgagccctcagcacagcagacaaccccaagcccaatgccttccccagcgcaatcgacccttctaatgagtgctgcccctacagctgttcagaacacacatcccagcccaacgaacaggtctaagaggaaccttgagatggaaataattttaactctgtcacaaggtctaaagaaatactacggtaagatactgaagcttctgcatctcaccttagaagaggacaccgaaggcctgttggaatggtgtaagagaaaccttgggtcaaactgtgatgatgacttctttcaaaagagaatagaagaattcttcatgactggtgagggctactttaatgaagtcttacaatttaaaacactaagcacactaagccccatggagccgtctcatgctgagctaccaacagcagaacccttcaaatcttacttcgctaagggcttcctttcaatagattcgggctacttctctgccaaatgttatccaagatcatctacttcagggcttcagctgatcaatgttacccaacacccagctaggatagcagaaacacctggacccaagacaacgagtctgaaagccatcaactgtataaacctaagagcatcagtcttcaaagaacacagagaaattgagatcaatgtgcttcttcctcagattgcagtcaacctctcaaactgccatgttgtgatcaattcacatgtctgtgattactctttagacactgatgggccagtgaggcttcctcacatttatcatgaagggaccttcataccaggaacttataaaatagtgatagacaaaaaaaataagctaaatgaccgatgtacactggtcaccaactgtgtgataaagggaagagaggttcgcaagggccaatcggtgctgaggcagtacaaaacagaaatcaagataggcaaggcatcaacaggctctaggaaactactgtccgaagagctaggtgatgactgtatatcaagaactcagctattgaggacagaaacagcagagatacatgatgacaactatggtggtccaggtgataaaataactatctgcaatggttcaaccattgtagatcagagactgggcagtgaactaggatgttataccatcaacagggggaagtcattcaagctatgcgaaaacagcgctacagggaaaacctgtgagatagacagcactccggttaagtgcaggcaaggtttttgtttaaaaatcacccaagagggaaggggccacgtaaaattatctagaggctcagaggttgtcctggatgcttgcgactcaagctgtgaagtaatgatacctaaaggcactggagatatcctagtggactgttcaggtgggcagcaacatttcttaaaagacaacttaattgacctagggtgcccccatatcccgctattgggtaagatggctatttacatttgcagaatgtctaatcatcctagaacaaccatggcttttctcttctggtttagctttggctatgtgatcacttgtatattttgcaaggctcttttttattcattgataattattgggacactagggaaaaaaatcaagcaatatagggaactgaaacctcaaacctgcaccatatgtgagacaactcctgtcaatgcaatagatgctgaaatgcatgacctcaactgtagttacaatatatgcccttattgtgcatcaagattgacctccgatgggctagccaggcatgtaacacaatgccccaagcggaaagagaaagttgaggagactgaactgtacctgaacctggaaagaattccttggattgtcagaaagctattgcaggtgtcagagtccaccggtgtggcattgaaacgaagcagctggctgattgtactgcttgtgttactcccagtttcattgtcgccggttcaatcagcacctgttggtcatggaaagacaatcgaaacatatcagaccagagaaggattcacaagcatctgtctctttatgttaggaagcattctatttatagtttcttgcttggtgaaagggctggttgacagtgttggtgacagcttcttccccggcctgtctgtctgtaagacatgctctattggcagtataaatggctttgaaattgaatcgcataaatgctactgtagcctattttgctgcccctactgtaggcactgctctgctgacagagaaattcaccagctacacttgagtatctgcaaaaaaaggaaaacggggagcaatgtcatgctggctgtctgcaaacgcatgtgctttagggcaaccatagaagcaagcagaagagccttgctcatccgaagcattatcaataccacttttgcaatgtgcattctaacattgacaatctgtgttgttagcacctctgcagtagagatggaaaaccttccagcaggtacttgggagagagaggaagacctgacaaatttctgtcatcaggaatgccaggtaactgagacggagtgcctctgtccatacgaagctcttgtgctcagaaagccccttttcttagacagtatagttaaaggtatgaaaaatttgctaaactcaacaagcttggaaacaagcttatcaattgaggcaccatggggagcaataaatgtccagtcaacctttaaaccaacagtatcgactgcaaacatagcactcagttggagctcagtggagcacagaggcaacaagatcttagtcacaggcaggtctgaatcaatcatgaaactagaggaaaggacaggagtcagctgggatctaggcgtagaagatgcctcagaatccaaattacttaccgtttctatcatggatttatcacaaatgtattcccctgtttttgagtacttgtcaggggacagacaggttgaagaatggccaaaagcaacttgtacaggtgattgcccagaaaggtgtggctgcacatcatcaacctgcttacataaagaatggcctcactcaagaaactggagatgcaatcccacttggtgctggggagtaggaaccggctgcacctgttgcggggtggatgtaaaagacctttttacggatcacatgttcgtcaaatggaaagttgaatacataaaaactgaagccatagtatgtgttgagctcaccagccaagaaagacagtgcagtctgattgaggcaggtactagattcaacttgggccctgtgactattaccctgtctgagccaagaaacattcagcagaagcttccccctgaaattatcacgttgcatcccaaaattgaagaaggcttctttgacttgatgcatgtacaaaaagtgttgtctgcaagtacagtgtgtaaactgcagagttgcacacatggtataccaggagatctacaagtttaccacattggcaacttgttgaaaggggatagagtaaacgggcatctaattcacaaaattgaaccacatttcaacacctcttggatgtcctgggatggttgtgatttagattactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattggacttaaaagcaaggccgacctacggtgcaggtgagatcactgtgctggttgaggttgctgacatggagttgcataccaagaaagttgaaatatcaggcttgaaatttgcaagtttgacttgcacgggttgctatgcttgtagctctggcatctcctgcaaagttaggattcatgtagatgaaccagatgagcttacagtacatgtaaagagcagtgatcctgatgtggttgcagctggcacaagtcttatggcgaggaagcttgaatttggaacagacagcacattcaaggccttttcagctatgcccaaaacctctttatgtttttacattgtggagagagaatactgcaagagctgcagtgaagatgatacacaaaaatgtgttgacacaaaacttgagcagccacagagcatactaattgagcacaaaggaacaataattggaaagcagaatgatacttgcacagccagggcaagctgttggctagagtcagtcaagagttttttttatggattgaagaatatgcttggcagtgtttttggtaattttttaataggcattttgttattccttgccccttttgtcctgttggtgcttttctttatgtttgggtggaaaatcttgttttgctttaaatgttgcaggaggaccagaggcttattcaaatatagacacctcaaagacgatgaggaaacaggctacagaaggattattgaaagactgaacagcaaaaaagggaaaaacagactgcttgatggtgaaaggctggctgataggaaaattgctgagctgttctccacaaaaacacacattggctaa

SEQ ID NO: 3673 - RNA, 5052 nt, synthetic construct
  misc_feature 1..5052: note = derived and/or modified CDS sequence (wt) from CCHFV(Min)__KX013481.1__GP
  source 1..5052: mol_type = other RNA
atgcatacactattagtgtgcttcattctttacctacagctgttgggtctaggaggagctcatggacagtcaaacgcaactgaacacaacggaacaaacaccaccacagcacccagcacaagtcaaagccccaagccacttgtgagcacagccccaccacacgcactggaatcatccaccatcaaacccaccacaccagcaagcgaaacagaaggctcaggggaaacgaccccacccccaaacaccacccagggcccgtctccaccagagaccacaccagaacgccccgcaacaactgccacaagtacgccaagcacagacaacacgaattccaccacacatgtgaccgacaacaaccctacatcaacaatcagcacaagtccatccagcagccccagcacgccatccacaccacaaggcatacatcatcctgcaaggaatctattgtcagtctcgagccttaagacagcaacaacaccaacaccaacgagccctggggagataagctcagaaaccagcagtctgcactcagccatgagcagaacatcaaccctctacacagcaacccaggtctccactgaaaatgccaaccacagcgcacctagacagtctgagtcctcagcacagccgacaaccacaagtccaatgacttccccagcacaatcaatccttgtaatgagtgctgctcctatagctattcagaacatacatcccagcccaacgaataggtctaagaggaaccttgagatggaaataattttaactctgtctcaaggtctaaagaaatactacggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagatcatctacttcagggcttcagctgatcaatgttacccaacacccagctagaatagcagaaacacctggacccaagacaacgagtctgaaaaccatcaactgtataaacctaagagcatcagtcttcaaagaacacagagaaattgagatcaatgtgcttcttcctcagattgcagtcaacctctcaaattgccatgttgtaatcaattcacatgtctgtgattattctttagacactgatgggccagtgaggcttcctcacatttaccatgaagggactttcataccaggaacttataaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggcatcaacaggctctaggaaactactgtccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcgttcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtactatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgcactattggcagtataaatggctttgaaattgaatcgcataaatgctactgtagcctattttgctgcccctactgtaggcactgctctgctgacagagaaattcaccagttacacttgagtatctgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcacgaagaatttgctaaactcaacaagcttagaaacaagcttatcaattgaggcaccatggggagcaataaatgtccagtcaacctttaaaccaacagtgtcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcctacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggataggataaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggttaa

SEQ ID NO: 3674 - RNA, 5052 nt, synthetic construct
  misc_feature 1..5052: note = derived and/or modified CDS sequence (wt) from CCHFV(Kosovo/9553/2001)__AY675511.1__GP
  source 1..5052: mol_type = other RNA
atgcatacactattagtgtgcttcattctttacctacagctgttgggtctaggaggagctcatggacagtcaaacgcaactgaacacaatggaacaaacaccaccacagcacccggcacaagtcaaagccccaagccacccgcgagcacaaccccatcacacgcaccggaatcatccaccatcaaactcaccacaccaacaagcgaaacagaaggctcaggggaaacgaccccacccacaagcaccacccagggctcgcccccactagagaccacaccagaacgctctacaacaaccgccacaagcacatcaggcacagacaacatgaactccaccacacagatgaccgacaacacccccacactaacagccagcacaagtccatccagcagccccagcacgccatccacatcacaaggcctgcattatccggtaaggagtctattgtcagtctcgagccctaagacagtaacaacaccaacaccaatgagccctggagagatgagctcggaaaccagcagtcagcactcagccatgagcagaacaccaaccccccacacagcaacccaggtctccactgagaacgccaaccgcagcacatccagacagtctgagtcctcagcacagccggcaacccaaagcccagtgacttccccagcgcaatcaatccttttgatgagtgctactcccacaaccattcagaacatacatcccagcccaacaaacaggtccaagaggaaccttgagatggaaataattttaactctgtctcaaggtctgaagaaatactatggtaaaatactgaagcttctgcaccttaccctggaagaggacactgaaggcttgttggaatggtgtaagagaaaccttgggtcgaactgtgatgatgacttctttcaaaagaggatagaagaattcttcataactggtgagggctacttcaatgaagtcctacagtttaaaacactaagcacaccaagccccacggagccgtctcatgccaggctaccaacagcggaacccttcaaatcttacttcgctaagggcttcctctcaatagattcgggttacttttctgccaaatgttatccaagatcatccacttcagggcttcagctgatcaatgttactcaacaccctgctaggatagcagagacacctgggcccaaaatcacgagtctgaaaaccatcaactgcatcaatctaagagcatctgtcttcaaagaacacagagaagttgaaatcaatgtgcttcttcctcaaattgcagtcaacctctcaaactgccatgttgtgatcaattcacatgtctgtgattactctttagacactgatgggccagtgaggcttcctcgcatttaccatgaagggactttcatgccaggaacttataaaatagtgatagacaggaaaaataagctaaatgaccgatgtacgctagtcaccaactgtgtgataaaggggagagaagttcgtaagggccaatcagtgctgaggcagtacaaaacagaaattaaaataggcaaggcaccaacaggctctaggaaactactgtccgaagagccaggtgatgactgcatatcaaggactcagctattgaggacagaaacagcagagatccatgacgataactatggtggtccaggtgacaaaataactatctgcaatggttcgaccattgtagatcagagactgggcagtgaactagggtgttataccatcaacagggtgaagtcattcaagctatgcgaaaacagcgccacagggaaaacctgtgagatagacagcactccagttaagtgcaggcaaggtttttgtttaaaaatcacccaagagggaaggggccacgtaaaattatctagaggctcagaggttgtcttggacgcttgcgactcaagctgtgaagtaatgatacccaaaggcactggagatatcctagtagactgctctggtggacagcagcatttcttaaaagacaacttgattgacctagggtgccctcatatcccactattgggtaagatggccatttacattgccagaatgtcaaatcatcctaaaacaaccatggcttttctcttctggttcagtttgggctatgtgatcacctgtatactttgcaaggctcttttttattcattgataattattgggacactagggaaaaaaatcaagcaatatagggaactgaaacctcaaacttgcaccatatgtgagacagctcctgtcaatgcaatagatgctgaaatgcatgacctcaactgtagttacaatatatgcccctattgtgcatcaagattgacctctgatgggctagctaggcatgtaaagcagtgccctaagcgaaaggagaaagtcgaggagactgagctgtacctgaacctggaaagaattccttgggtcgtcagaaagctattgcaagtgtcagagtccactggtgtggcattgaaacgaagcagttggctgattgtgctgcttgtgttactcacagtttcattgtcaccggttcaatcagcacccgttggtcatggtaagacaatcgaaacatatcagaccagagaaggattcacaagtatttgtctctttatgttaggaagcatcctattcatagtctcctgcttggtgaaagggctggttgacagtgtcagtgacagcttcttccctggcctgtctgtctgtaaaacatgctccattggcagtataaatggctttgaaattgaatcgcataaatgctactgtagcttgttctgctgcccctattgtagacactgctctgctgacagagaaattcaccaattgcacttgagtatctgcaaaaaaagaaaaacagggagcaatgtcatgctagctgtctgcaagcgcatgtgctttagagcaaccatagaagcaagcagaagagccctgctcatccgaagtattatcaataccacttttgtaatatgcattctaacattaacaatctgtgttgctagtacctctgcagtagagatggaaacccttccagcagccacctgggagagagaggaagacctgacaaatttctgtcatcaggaatgccaggtacccgagacggaatgcctttgcccatacgaagctcttgtgctcaggaaacctcttttcttagacagtatagtcaaaggtatgaaaaatttgctaaactcaacaagcttggaaacaagcttatcaattgaggcaccatggggagcaataaatgtccagtcaacctttaaaccaacagtatcgactgcgaacatagcactcagttggagctcagtggagcacagaggcaacaagatcttagtcacaggcaggtctgaatcaattatgaaactagaggaaaggacaggagtcagctgggatctaggggtagaagatgcctctgaatccaaattacttaccgtctctatcatggatttgtcacagatgtattccccagtttttgagtacttgtctggagacagacaggttgaagaatggcccaaagcaacttgtacaggtgactgcccagaaaggtgtggctgcacatcatcaacctgcttgcataaagaatggcctcattcaagaaactggagatgtaatcccacttggtgctggggagtgggaaccggctgcacctgctgcggggtggatgtaaaagacctttttacagatcacatgtttgtcaaatggaaggttgaatatataaaaactgaagccatagtgtgtgttgagctcaccagccaagaaagacagtgcagtctgattgaggcaggtactagattcaacttgggccctgtgactattaccctgtctgagccaagaaacattcagcagaagcttccccctgagatcattacgttgcatcccaaaattgaggaaggcttctttgacttgatgcatgtacaaaaagtgttgtccgcaagtacagtgtgtaaactgcagagttgcacacatggtataccaggagatctacaagtttaccacattggcaacttgttgaaaggggatagagtaaacgggcatctaattcacaaaattgaaccacatttcaacacctcttggatgtcctgggatggttgtgacttagactactactgcaacatgggggactggccttcttgtacatacacaggagtgacccagcataatcatgctgcatttgtaaacttgcttaacattgaaactgattacacgaaaaccttccacttccactctaaaagagtcacagcacatggtgacacaccacaattggacttaaaagcaaggccgacctacggtgcaggagagatcactgtgctggttgaggttgctgacatggagttgcataccaagaaagttgagatatcgggcttgaaatttgcaagtctggcttgcacaggttgctatgcctgtagctctggcatctcctgtaaagtcaggattcatgtagatgaaccagatgagctcacagtgcatgtaaagagcagtgacccagatgttgttgcagctagcacaagcctcatggcaaggaagcttgaatttgggacagacagcacattcaaggccttttcagctatgcccaaaacctctttatgtttttacattgtggagaaagaatactgcaagagctgcagtgaagatgatacaaaaaaatgtgttgacacaaaacttgagcagccacagagcatactaattgagcacagagggacgataattggaaagccgaatgatacttgcccagccaagacaagctgttggctagagtccgtcaagagctttttttatggattgaagaatatgcttggcagtgtctttggtaattttttcataggcattttgttattccttgccccttttttcctgtggatgctttcctttatgtttggatggaaaatcttgttctgctttaaatgttgcaggaggaccagaggcctgtttaagtatagacacctcaaagacgatgaggaaacaggctacagaaggattattgaaaggctgaacaacaaaaaagggaaaaatagactgcttgatggtgaaaggttggctgataggaaaattgccgagctgttttctacaaaaacacacattggctaa

SEQ ID NO: 3675 - RNA, 5052 nt, synthetic construct
  misc_feature 1..5052: note = derived and/or modified CDS sequence (wt) from CCHFV(4495-ST-2008)__KR814869.1__GP
  source 1..5052: mol_type = other RNA
atgcatacactattagtgtgcttcattctttacctacagctgctgggtccaggaggagcccatggacagccaaacgcaactgaacacaacagaacaaacaccaccacagcacccagcacaagccaaagccccaagccacccgtgagcacagccccaccacacgcactggaatcacccaccatcaaatccaccacaccaacaagcgaaacagaaggctcaggggaaacgaccccacccccaaacaccacccagggcccgtctccaccagagaccacaccagaacgccccgcaacaactgccacaagtacgccaagcacagacaacacgaattccaccacacatgtgaccgacaacaaccctacatcaacaatcagcacaagtccatccagcagccccagcacgccatccacaccacgaggcatacatcatcctgcaaggaatctattgtcagtctcgagccctaagacagcaacaacaccaacaccaacgagccctggggagataagctcagaaaccagcagtctgcactcagccatgagcagaacatcaaccctctacacagcaacccaggcctccactgaaaatgccaaccacagcacacctagacagtctgagtccccagcacagccgacaaccacaagcctaatgacctccccagcacaatcaatccttgtaatgagtgctgctcctacagctattcagaacatacatcccagcccaacgaataggtctaagaggaaccttgagatggaaataattttaactctgtctcaaggtctaaagaaatactacggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagatcatctacttcagggcttcagctgatcaatgttacccaacacccagctagaatagcagaaacacctggacccaagacaacgagtctgaaaaccatcaactgtataaacctaagagcatcagtcttcaaagaacacagagaaattgagatcaatgtgcttcttcctcagattgcagtcaacctctcaaattgccatgttgtaatcaattcacatgtctgtgattattctttagacactgatgggccagtgaggcttcctcacatttaccatgaaggaactttcataccaggaacttacaaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggtatcaacaggctctaggaaactactgtccgaagagtcaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagaaggaaggggccacgtaaaattatctagaggctcagaggttgttttggatgcttgcgactcaagctgcgaagtaatgatacctaaaggcactggagatatcttggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtaatcacctgtttattttgcaaggctcttttttattcattgataatcattgggacactagggaaaaagatcaagcaatatagggaattgagacctcaaacttgtaccatatgtgagacagctcctgtcaatgcaatagatgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctactttgctgcccctactgtaggcactgctctgctgacagagaaatccaccagttacacttgagtatctgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattaacaatctgtgttgttagcacctctgcagtagagatggaaaaccttccatcaggcacttgggagaaagaggaagacctgacaaatttctgtcatcaggaatgccaggtgaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggaatcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaagtggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtacaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccaacctacggtgcaggtgagatcactgtgctggttgaggttgctgacatggagttgcataccaagaaagttgagatatcaggcctgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagggaatactgcaagagctgcagtgaagaggacacacaaagatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggcaactttttcataggcattttgttattccttgccccttttgtcctgttggtgcttttctttatgtttggatggaaaatcttgttttgcttcaaatgttgcaggagggccagaggcttgcttaagtatagacacctaaaagacgatgaggaaacaggctacagaaagattattgaaaggctgaacaacaaaaaaggaaaaaacagactgcttgatggtgaaaggttggctgataggaaaattgctgagctgttctccacaaaaacacacattggttaa

SEQ ID NO: 3676 - RNA, 5052 nt, synthetic construct
  misc_feature 1..5052: note = derived and/or modified CDS sequence (wt) from CCHFV(Mamon)__KX013478.1__GP
  source 1..5052: mol_type = other RNA
atgcatacactattagtgtgcttcattctttacctacagctgttgggtctaggaggagctcatggacagtcaaacacaactgaacacaacggaacaaacaccaccacagcacccagcacaagtcaaagccccaagccacttgtgagcacagccccaccacacgcactggaatcatccaccatcaaacccaccacaccagcaagcgaaacagaaggctcaggggaaacgaccccacccccaaacatcacccagggcccgtctccaccagagaccacaccagaacgccccgcaacaactgccacaagtacgccaagcacagacaacacgaattccaccacacatgtgaccgacaacaaccctacatcaacaatcagcacaagtccatccagcagccccagcacgccatccacaccacaaggcatacatcatcctgcaaggaatttattgtcagtctcgagccctaagacagcaacaacaccaacaccaacgagccctggggagataagctcaaaaaccagcagtctgcactcagccatgagcagaacatcaaccctctacacagcaacccaggtctccactgaaaatgccaaccacagcgcacctagacagtctgagtcctcagcacagccgacaaccacaagcccaatgacttccccagcacaatcaatccttgtaatgagtgctgctcctacagctattcagaacatacatcccagcccaacgaatagatctaagaggaaccttgagatggaaataattttaactctgtctcaaggtctaaagaaatactatggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagatcatctacttcagggcttcagctgatcaatgtgacccaacacccagctagaatagcagaaacacctggacccaagacaacgagtctgaaaaccatcaactgtataaacctaagagcatcagtcttcaaagaacacagagaaattgagatcaatgtgcttcttcctcagattgcagtcaacctctcaaattgccatgttgtaatcaattcacatgtctgtgattattctttagacactgatgggccagtgaggcttcctcacatttaccatgaagggactttcataccaggaacttataaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggcatcaacaggctctaggaaactactgtccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgtttcggatgcttgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactgtggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattaaaacgaagcagctggctgattgtactgcttgtgttactcacagtttcattgtcaccggttcaatcagcacctgttggtcacggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcaccagttacacttgagtatctgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtgtgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggtgatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctcgttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaagacaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggttaa

SEQ ID NO: 3677 - RNA, 5052 nt, synthetic construct
  misc_feature 1..5052: note = derived and/or modified CDS sequence (wt) from CCHFV(81-R-2014)__KR814865.1__GP
  source 1..5052: mol_type = other RNA
atgcatacactattagtgtgcttcattctttacctacagctgttgggtctaggaggagctcatggacagtcaaacgcaactgaacacaatggaacaaacaccaccacagtacccagcacaagtcaaagccccaagccacttgtgagcacaaccccaccacacgcactggaatcatcaaccatcaaacccaccacaccaacaagcgaaacagaaggctcaggggaaacggccccactcccaaacaccacccagggcccgcctccaccagagaccacaccagaacgccccgcaacaactgtcacaagtacgccaagtacagacaacacgaattccaccatacatgtgaccgacaacaaccccacatcaacaatcagcacaagtccatccagcagccccagcacgccatccacaccacaaggcatacatcatcctgcaaggagtctattgtcagtctcgagccctaagacagcaacaacaccaacaccgacgagccctggggagataaactcagaaaccagcagtctgcactcagccatgagcagaacaccaaccctccacacagcaacccaggtctccactgaaaatgccaaccacagcgcacctagacagtctgagtcctcagcacagccaacaaccacaagcctaatgacttccccagcacagtcaatccttctaatgagtgctgctcctacagctattcagaacacacatcccagcccaacaaataggtctaagaggaaccttgagatggaaataattttaactctgtctcaaggtctaaagaaatactacggtaagatactgaagctactacacctcaccttggaagaggacactgaaggcctgttagaatggtgtaagagaaaccttgggtcaaactgtgatgatgacttctttcaaaagagaataggagaattcttcatgactggtgagggctacttcaatgaagtcttacaatttaaaacactaagcacactaagccccacggagccgtctcatgccaggctaccaacagtggaacccttcaaatcttacttcgctaagggcttcctttcaatagattcaggttacttctctgccaaatgttatccaagatcatctacttcagggctccagctgatcaatgttacccaacacccagctaggatagcagaaacacccggacccaagacaacgagtctgaaaaccatcaactgtataaacctaagagcatcagtcttcaaagaacacagagaaattgagatcaatgtgcttcttcctcagattgcagtcaacctctcaaattgccatgttgtgatcaattcacatgtctgtgattactctttagacactgatgggccagtgaggcttcctcacatttaccatgaagggactttcataccaggaacttataaaatagtgatagacaagaaaaataagctaaatgaccgatgtacactagtcaccaactgtgtgataaaaggaagagaggttcgtaagggccaatcagtgctgaggcagtacaaaacagaaatcaagataggcaaggcatcaacaggctctaggaaactactgtccgaagagccaggtgatgactgcatatcaagaactcagctattgaggacagaaacagcagagatccatgatgacaactatggtggtccaggtgataaaataactatctgcaacggttcaaccattgtagatcagagactgggcagtgaactagggtgttataccatcaacagagtgaagtcattcaagctatgcgaaaacagcgccacagggaaaacctgtgagatagacagcactccggttaagtgcaggcaaggcttttgtttaaaaatcacccaagagggaaggggccacgtaaaattatctagaggctcagaggttgtcttggatgcctgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaactgaaacctcaaacttgtaccatatgtgagacagctcctgtcaatgcaatagatgctgaaatgcatgaccttaactgcagttacaatatatgcccttattgtgcatcaagattgacctccgatgggctagctaggcatgtgccacagtgccccaagcgaaaggaaaaagttgaggagactgagctgtacttgaacctggaaagaattccttggatcgtcagaaagctattgcaagtgtcagaatccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctatttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcaccagttacacttgagcatctgcaaaaaaagaaaaacgggtagcaatgtcatgctggctgtctgcaaacgcatgtgctttagagcaaccatagaggcaagcagaagagccctgctcatccgaagcattatcaataccacttttgtaatatgcattctaacattgacaatctgtgttgttagcacctctgcagtagagatggaaaaccttccagcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaaaaatttgctaaactcaacaagcttagaaacaagcttatcaatcgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaggatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaagtggaaggttgaatatataaaaactgaagccatagtatgtgttgagctcaccagccaagaaagacagtgcagtctgattgaggcaggtaccagattcaacttgggccctgtgactattaccctgtctgagccaagaaacatacagcagaagcttccccctgagattatcacgttgcatcccaaagttgaagagggcttctttgacttgatgcatgtgcaaaaagtgttgtctgcaagtacagtgtgtaaactgcagagttgcacacacggcataccaggagatctacaagtttaccacattggcaacttgctgaaaggagataggataaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcacaccaaaaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagccagcacaagtctcatggcgaggaagcttgagtttgggacagacagtaccttcaaggccttttcagctatgcccaaaacctctttatgtttttacattgtggagagagaatactgtaagagctgcagtgaagaggacacacaaaaatgtgttgacacaagacttgagcagccgcagagcatactaattgagcacaaaggaacgataattgggaagcagaatgatacttgcacagccaaggcaagctgttggttagagtcagtcaagagttttttttatggattgaagaatatgcttggtagtgtctttggtaattttttcataggcattctgttattccttgccccttttgtcctgttggtgcttttctttatgtttgggtggaaaatcttgttttgctttaaatgttgcaggaggaccagaggcttacttaagtatagacacctcaaagacgatgaggaaacaggctacagaaggattattgaaagactgaacaacaaaaaagggaaaaacagactgcttgatggtgaaaggttggctgataggaaaattgctgagctgttctccacaaaaacacacattggttaa

SEQ ID NO: 3678 - RNA, 5052 nt, synthetic construct
  misc_feature 1..5052: note = derived and/or modified CDS sequence (wt) from CCHFV(5180-R-2011)__KR814874.1__GP
  source 1..5052: mol_type = other RNA
atgcatacgctattagtgtgcttcattctttacctacagctgttgggtctaggaggagctcatagacagtcaaacgcaactgaacacaacggaacaaacaccaccacagcacccagcacaagccaaagccccaagccacctgtgagcacagccccaccatacgcaccggaatcatccaccatcaaacccaccacaccagcaagcgaaacagaaggctcaggggaaacgaccccacccccaaacaccacccagggcccgtctccaccagaggccacaccagaacgccccgcaacaactgccacaagtacgccaagcacagacaacacgaactccaccacacacgcgaccgacaacaaccctacatcaacaatcagcacaagtccatccagcagccccagcacgccatccacaccacaaggcatacatcatcctgcaaggaatctattgtcagtctcgagccctaagacagcaacaacaccaacaccaacgagccctggggatataagctcagaaaccagcagtctgcactcagccatgagcagaacaccaaccctccacacagcaacccaggcctccactgaaaatgccaaccacagcgcacctagacagtctgagtcctcagcacagcagacaaccacaagcccaatgacttccccagcacaaccaatccttgtaatgagtgctgctcctacagctattcagaacatacatcccagcccaacgaataggtctaagaggaaccttgagatggaaataattttaactctgtctcaaggtctaaagaaatactatggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagattatctacttcagggcttcagctgatcaatgtcacccaacacccagctagaatagcagaaacacctggacccaagacaacaagtctgaaaaccatcaactgtataaacctaagagcatcagtcttcaaagaacacagagaaattgagatcaatgtgctccttcctcagattgcagtcaacctctcaaattgccatgttgtaatcaattcacatgtctgtgattattctttagacactgatgggccagtaaggcttcctcacatttaccatgaagggactttcataccaggaacttataaaatagtgatagacaaaaaaaataagctaaatgaccgatgtacactggtcaccaactgtgtgataaaaggaagagagattcgtaagggccaatcagtgctgaggcagtacaaaacagaaatcaagataggcaaggcatcaacaggctctaggaaactactgtccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgacacaagctgcgaagtaatgatacctaaaggcactggagatatcctggtggactgttcaggtggacagcaacatttcttaaaagacaatttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtgtctgtctctttatgttaggaagcatcctgtttttagtctcttgcttggtgaaggggctagttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcatcagttacacttgagtatctgcaaaaaaagaaaaatgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctccatcatggatttgtcacaaatgtattcccctgtttttgagtacttgtcaggagacagacaggttgaagaatggcccaaagcaacttgcacaggtgactgcccagaaaggtgtggttgcacatcatcaacttgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgttcggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggttaa

SEQ ID NO: 3679 - RNA, 5052 nt, synthetic construct
  misc_feature 1..5052: note = derived and/or modified CDS sequence (wt) from CCHFV(24-R-2012)__KR814856.1__GP
  source 1..5052: mol_type = other RNA
atgcatacgctattagtgtgcttcattctttacctacagctgttgggtctaggaggagctcatagacagtcaaacgcaactgaacacaacggaacaaacaccaccacagcacccagcacaagccaaagccccaagccacctgtgagcacagccccaccacacgcaccggaatcatccaccatcaaacccaccacaccagcaagcgaaacagaaggctcaggggaaacgaccccacccccaaacaccacccagggcccgtctccaccagaggccacaccagaacgcaccgcaacaactgccacaagtacgccaagcacagacaacacgaactccaccacacacgcgaccgacaacaaccctacatcaacaatcagcacaagtccatccagcagccccagcacgccatccacaccacaaggcatacatcatcctgcaaggaatctattgtcagtctcgagccctaagacagcaacaacaccaacaccaacgagccctggggatataagctcagaaaccagcagtctgcactcagccatgagcagaacaccaaccctccacacagcaacccaggcctccactgaaaatgccaaccacagcgcacctagacagtctgagtcctcagcacagcagacaaccacaagcccaatgacttccccagcacaaccaatccttgtaatgagtgctgctcctacagctattcagaacatacatcccagcccaacgaataggtctaagaggaaccttgagatggaaataattttaactctgtctcaaggtctaaagaaatactatggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagattatctacttcagggcttcagctgatcaatgtcacccaacacccagctagaatagcagaaacacctggacccaagacaacaagtctgaaaaccatcaactgtataaacctaagagcatcagtcttcaaagaacacagagaaattgagatcaatgtgctccttcctcagattgcagtcaacctctcaaattgccatgttgtaatcaattcacatgtctgtgattattctttagacactgatgggccagtgaggcttcctcacatttaccatgaagggactttcataccaggaacttataaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggcatcaacaggctctaggaaactactgtccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgacacaagctgcgaagtaatgatacctaaaggcactggagatatcctggtggactgttcaggtggacagcaacatttcttaaaagacaatttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtgtctgtctctttatgttaggaagcatcctgtttttagtctcttgcttggtgaaggggctggttgacagtgtcagtgacagcttcttccctggcctgtctgtctgtaagacatgctctattggcagtataaatggctttgaaattgaatcgcataaatgctactgtagcctattttgctgcccctactgtaggcactgctctgctgacagagaaattcatcagttacacttgagtatctgcaaaaaaagaaaaatgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacttgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggttaa

SEQ ID NO: 3680 - RNA, 5052 nt, synthetic construct
  misc_feature 1..5052: note = derived and/or modified CDS sequence (wt) from CCHFV(46-ST-2012)__KR814860.1__GP
  source 1..5052: mol_type = other RNA
atgcatacactattagtgtgcttcattctttacctacagctgttgggtctaggaggagctcatggacagtcaaacgcaactgaacacaatggaacaaacaccaccacagtacccagcacaagtcaaagccccaagccacttgtgagcacaaccccaccacatgcactggaatcatcaaccatcaaacccaccacaccaacaagcgaaacagaaggctcaggggaaacggccccactcccaaacaccacccagggcccgcctccaccagagaccacaccagaacgccccgcaacaactgtcacaagtacgccaagtacagacaacacgagttccaccatacatgtgaccgacaacaaccccacatcaacaatcagcacaagtccatccagcagccccagcacgccatccacaccacaaggcatacatcatcctgcaaggagtctattgtcagtctcgagccctaagacagcaacaacaccaacaccgacgagccctggggagataaactcagaaaccagcagtctgcactcagccatgagcagaacaccaaccctccacacagcaacccaggtctccactgaaaatgccaaccacagcgcacctagacagtctgagtcctcagcacagccaacaaccacaagcctaatgacttccccagcacaatcaatccttctaatgagtgctgctcctacagctattcagaacatacatcccagcccaacaaataggtctaagaggaaccttgagatggaaataattttaactctgtctcagggtctaaagaaatactacggtaagatactgaagctactacacctcaccttggaagaggacactgaaggcctgttagaatggtgtaagagaaaccttgggtcaaactgtgatgatgacttctttcaaaagagaatagaagaattcttcatgactggtgagggctacttcaatgaagtcttacaatttaaaacactaagcacactaagccccacggagccgtctcatgccaggctaccaacagtggaacccttcaaatcttacttcgctaagggcttcctttcagtagattcaggttacttctctgccaaatgttatccaagatcatctacttcagggctccagctgatcaatgttacccaacacccagctaggatagcagaaacacccggacccaagacaacgagtctgaaaaccatcaactgtataaacctaagagcatctgtcttcaaagaacacagagaaattgagatcaatgtgcttcttcctcagattgcagtcaacctctcaaattgccatgttgtgatcaattcacatgtctgtgattactctttagacactgatgggccagtgaggcttcctcacatttaccatgaagggactttcataccaggaacttataaaatagtgatagacaagaaaaataagctaaatgaccgatgtacactagtcaccaactgtgtgataaaaggaagagaggttcgtaagggccaatcagtgctgaggcagtacaaaacagaaatcaagataggcaaggcatcaacaggctctaggaaactactgtccgaagagccaggtgatgactgcatatcaagaactcagctattgaggacagaaacagcggagatccatgatgacaactatggtggtccaggtgataaaataactatctgcaacggttcaaccattgtagatcagagactgggcagtgaactagggtgttataccatcaacagagtgaagtcattcaagctatgcgaaaacagcgccacagggaaaacctgtgagatagacagcactccggttaagtgcaggcaaggcttttgtttaaaaatcacccaagagggaaggggccacgtaaaattatctagaggctcagaggttgtcttggatgcctgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaactgaaacctcaaacttgtaccatatgtgagacagctcctgtcaatgcaatagatgctgaaatgcatgaccttaactgcagttacaatatatgcccttattgtgcatcaagattgacctccgatgggctagctaggcatgtgccacagtgccccaagcgaaaggaaaaagttgaggagactgagctgtacttgaacctggaaagaattccttggatcgtcagaaagctattgcaagtgtcagaatccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctatttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcaccagttacacttgagcatctgcaaaaaaagaaaaacgggtagcaatgtcatgctggctgtctgcaaacgcatgtgctttagagcaaccatagaggcaagcagaagagccctgctcatccgaagcattatcaatgccacttttgtaatatgcattctaacattgacaatctgtgttgttagcacctctgcagtagagatggaaagccttccagcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaaaaatttgctaaactcaacaagcttagaaacaagcttatcaatcgaggcaccatggggagcaataaatgtccagtcaacctttaaaccaacagtatcgactgcaaacatagcactcagttggagctcagtggagcacagaggcaacaagatcttagtcacaggcaggtctgaatcaattatgaaactggaggaaaggacaggagtcagctgggatctaggcgtagaggatgcctctgaatccaaattacttaccgtctctatcatggatctgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaagtggaaggttgaatatataaaaactgaagccatagtatgtgttgagctcaccagccaagaaagacagtgcagtctgattgaggcaggtaccagattcaacttgggccctgtgactattaccctgtctgagccaagaaacatacagcagaagcttccccctgagattatcacattgcatcccaaagttgaagagggcttctttgacttgatgcatgtgcaaaaagtgttgtctgcaagtacagtgtgtaaactgcagagttgcacacacggtataccaggagatctacaagtttaccacattggcaacttactgaaaggagataggataaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcacaccaaaaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagccagcacaagtctcatggcgaggaagcttgagtttgggacagacagtaccttcaaggccttttcagctatgcccaaaacctctttatgtttttacattgtggagagagaatactgtaagagctgcagtgaagaggacacacaaaaatgtgttgacacaagacttgagcagccgcagagcatactaattgagcacaaaggaacgataattggaaagcagaatgatacttgcacagccaaggcaagctgttggttagagtcagtcaagagttttttttatggattgaagaatatgcttggtagtgtctttggtaattttttcataggcattctgttattccttgccccttttgtcctgttggtgcttttctttatgtttgggtggaaaatcttgttttgctttaaatgttgcaggaggaccagaggcttacttaagtatagacacctcaaagacgatgaggaaacaggctacagaaggattattgaaagactgaacaacaaaaaagggaaaaacagactgcttgatggtgaaaggttggctgataggaagattgctgagctgttctccacaaaaacacacattggttaa

SEQ ID NO: 3681 - RNA, 5052 nt, synthetic construct
  misc_feature 1..5052: note = derived and/or modified CDS sequence (wt) from CCHFV(ROS/HUVLV-100)__DQ206448.1__GP
  source 1..5052: mol_type = other RNA
atgcatacactattagtgtgcttcattctttacctacagctgttgggtctaggaggagctcatagacagtcaaacgcaactgaacacaacggaacaaacaccaccacagcacccagcacaagtcaaagccccaagcctcttgtgagcacagccccaccacacgcactggaatcatccaccatcaaacccaccacaccagtaagcgaaacagaaggctcaggggaaacgaccccacccccaaacaccacccagggcccgtctccaccagaggccacaccagaacgccccacaacaactgccacaagtacgccaagcacagacaacacgaattccaccacacatgtgaccgacaacaaccctacatcaacaatcagcacaagtccatccagcagccccagcacgccatccacaccacaaggcatacatcatcctgcaaggaatctattgtcagtctcgagccctaagacagcaacaacaccaacaccaacgagccctggggagataagctcagaaaccagcagtctgcactcagccatgagcagaacatcaaccctctacacagcaacccaggtctccactgaaaatgccaaccacagcgcacctagacagtctgagtcctcagcacagcagacaaccacaagtccaatgacttccccagcacaatcaatccttgtaatgagtgctgctcctacagctattcagaacatacatcccagcccaacgaataggtctaagaggaaccttgagatggaaataattttaactctgtctcaaggtctaaagaaatactatggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagattatctacttcagggcttcagctgatcaatgtcacccaacacccagctagaatagcagaaacacctggacccaagacaacgagtctgaaaaccatcaactgtataaacctaagagcatcagtcttcaaagaacacagagaaattgagatcaatgtgcttcttcctcagattgcagtcaacctctcaaattgccatgttgtaatcaattcacatgtctgtgattattctttagacactgatgggccagtgaggcttcctcacatttaccatgaagggactttcataccaggaacttataaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggcatcaacaggctctaggaaactactgtccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagcccctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcatcagttacacttgagtatctgcaaaaaaagaaaaacgggtagcaatgtcatgctggctgtctgcaaacgcatgtgctttagggcaaccatagaagcaagcagaagagccttgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcctatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacattgcatcccaaagttgaagagggcttctttgacttgatgcatgtgcaaaaagtgctgtctgcaagtacagtgtgtaaactgcagagttgcacacatggtataccaggagatctacaagtttaccatattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaattttttcataggcattttgttattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaagggaaaaaacagactgcttgatggtgaaaggttggctgataggaaaattgctgagctgttctccacaaaaacacacattggttga

SEQ ID NO: 3682 - RNA, 5052 nt, synthetic construct
  misc_feature 1..5052: note = derived and/or modified CDS sequence (wt) from CCHFV(Saf)__KX013487.1__GP
  source 1..5052: mol_type = other RNA
atgcatacactattagtgtgcttcattctttacctacagctgttgggtctaggaggagctcatggacagtcaaacgcaactgaacacaacggaacaaacaccaccacagcacccagcacaagtcaaagccccaagccacttgtgagcacagccccaccacacgcactggaatcatccaccatcaaacccaccacaccagcaagcgaaacagaaggctcaggggaaacgaccccacccccaaacaccacccagggcccgtctccaccagagaccacaccagaacgccccgcaacaactgccacaagtacgccaagcacagacaacacgaattccaccacacatgtgaccgacaacaaccctacatcaacaatcagcacaagtccatccagcagccccagcacgccatccacaccacaaggcatacatcatcctgcaaggaatctattgtcagtctcgagccctaagacagcaacaacaccaacaccaacgagccctggggagataagctcagaaaccagcagtctgcactcagccatgagcagaacatcaaccctctacacagcaacccaggtctccactgaaaatgccaaccacagcgcacctagacagtctgagtcctcagcacagccgacaaccacaagcccaatgacttccccagcacaatcaatccttgtaatgagtgctgcccctacagctattcagaacatacatcccagcccaacgaataggtctaagaggaaccttgagatggaaataattttaactctgtctcaaggtctaaagaaatactacggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagatcatctacttcagggcttcagctgatcaatgttacccaacacccagctagaatagcagaaacacctggacccaagacaacgagtctgaaaaccatcaactgtataaacctaagagcatcagtcttcaaagaacacagagaaattgagatcaatgtgcttcttcctcagattgcagtcaacctctcaaattgccatgttgtaatcaattcacatgtctgtgattattctttagacactgatgggccagtgaggcttcctcacattcaccatgaagggactttcataccaggaacttataaaatagtgatagacaaagaaaataagctaaatgaccgatgtacactggtcaccaactgtgtgataaaaggaagagaggttcgtaagggccaatcagtgctgaggcagtacaaaacagaaatcaagataggcaaggcatcaacaggctctaggaaactactgtccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacattacttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacggctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcaccagttacacttgagtatctgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttctcagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgagactgattacatgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgtaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggttaa

SEQ ID NO: 3683 - RNA, 5052 nt, synthetic construct
  misc_feature 1..5052: note = derived and/or modified CDS sequence (wt) from CCHFV(52-R-2014)__KR814862.1__GP
  source 1..5052: mol_type = other RNA
atgcatacgctattagtgtgcttcattctttacctacagctgttgggtctaggaggagctcatagacagtcaaacgcaactgaacacaacggaacaaacaccaccacagcacccagcacaagccaaagccccaagccacctgtgagcacagccccaccacacgcaccagaatcatccaccatcaaacccaccacaccagcaagcgaaacagaaggctcaggggaaacgaccccacccccaaacaccacccagggcccgtctccaccagaggccacaccagaacgccccgcaacaactgccacaagtacgccaagcacagacaacacgaactccaccacacacgcgaccgacaacaaccctacatcaacaatcagcacaagtccatccagcagccccagcacgccatccacaccacaaggcatacatcatcctgcaaggaatctattgtcagtctcgagccctaagacagcaacaacaccaacaccaacgagccctggggatataagctcagaaaccagcagtctgcactcagccatgagcagaacaccaaccctccacacagcaacccaggcctccactgaaaatgccaaccacagcgcacctagacagtctgagtcctcagcacagcagacaaccacaagcccaatgacttccccagcacaaccaatccttgtaatgagtgctgctcctacagctattcagaacatacatcccagcccaacgaataggtctaagaggaaccttgagatggaaataattttaactctgtctcaaggtctaaagaaatactatggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagattatctacttcagggcttcagctgatcaatgtcacccaacacccagctagaatagcagaaacacctggacccaagacaacaagtctgaaaaccatcaactgtataaacctaagagcatcagtcttcaaagaacacagagaaattgagatcaatgtgctccttcctcagattgcagtcaacctctcaaattgccatgttgtaatcaattcacatgtctgtgattattctttagacactgatgggccagtgaggcttcctcacatttaccatgaagggactttcataccaggaacttataaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggcatcaacaggctctaggaaactactgtccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttatactatcaacagggtgaagtcattcaagctatgcgaaaacagcgccacagggaaaacctgtgagatagacagcactccggttaagtgcaggcaaggtttttgtttaaaaatcacccaagagggaagaggccacgtaaaattatctagaggctcagaggttgttttggatgcttgcgacacaagctgcgaagtaatgatacctaaaggcactggagatatcctggtggactgttcaggtggacagcaacatttcttaaaagacaatttaattgacctagggtgcccccatgtcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtgtctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcatcagttacacttgagtatctgcaaaaaaagaaaaatgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagatgatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacttgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaggctgttggctagagtcagtcaagagttttttttatggattgaaaaatatgcttggtagtgtatttggtaactttttcataggcattttgctattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgaactgttctccacaaaaacacacattggttaa

SEQ ID NO: 3684 - RNA, 5052 nt, synthetic construct
  misc_feature 1..5052: note = derived and/or modified CDS sequence (wt) from CCHFV(Turkey-Kelkit06)__GQ337054.1__GP
  source 1..5052: mol_type = other RNA
atgcatacaccattagtgtgcttcattctttacctacagctgttgtgtctaggaggagctcatgggcagttaaacgcaactgaacacaatggaacaaacaacaccacagcacctggcgcaagccaaagccccaagccacccatgagcacaaccccaccacacgcaccggaatcatccaccatcaaacccaccacaccaataagcgaagcagaaggctcaggggaaacgacctcacccccaaacaccacccagggcctgtcctcgccagagaccacatcagaacgccctgcaacaacctccatcagcacgtcaagcacagacagcacgaaccccaccacacagatgaccgacaacacccccacaccaacagtcagcacaagcccatccagcagccccagcacgccatccacaccacaaggcatacatcatcctgcaaggagtctgttgtcagtctcgagccccaagacagtaacaacaccaacaccaacgagccctggagagatgagctcggaaaccagcagtcagcactcagccatgagcagaataccaaccccccacacagcaacccgggtctccactgagatcaccaaccaccgcacacctagacaatctgaatcctcagcacagcagacaaccccaagcccaatgacttccccagcgcaatcgatccttctaatgagtgctgctcctacagctgttcaagacatacatcccagcccaacaaacaggtctaagaggaaccttgagacggaaataattttaactctatctcaaggtctaaagaaatactacggtaagatactgaagcttctgcacctcaccttagaacaggacaccgaaggcctgctagaatggtgtaagggaaaccttgggtcaaactgtgatgatgacttctttcaaaagagaatagaagaattcttcatgactggtgagtgctacttcaatgaagtcttacaatttaaaacactaagcacactaagccccacggagccgtctcatgccaggctaccaacagcagaacccttcaaatcttactttgctaagggcttcctttcaatagattcaggttacttctctgccaaatgttatccaagatcatctgcttcagggcttcagctgatcaatgttacccaacacccagctaggatagcagaaacacctggacccaagacaacaagtctgaaaaccatcaactgtataaacctaagagcatcagtcttcaaagaacacagagaagttgagatcaatgtgcttcttcctcagattgcagtcaacctctcaaactgccatgttgtgatcaattcacatgtctgtgattactctttagacactgatgggccagtgaggcttcctcgcatttatcatgaagggactttcataccaggaacttataaaatagtgatagacaaaaaaaataagctaaatgaccgttgtacactggtcaccaactgtgtgataaagggaagagaggttcgtaaggggcaatcagtgctgaggcagtacaaaacagaaatcaagataggcaaggcatcaacaggctttaggaaactactgtccgaagagccaggtgatgactgcatatcaagaactcagctattgaggacagaaacagcagagatccatgatgacaactatggtggtccaggtgataaaataactatctgcaacggttcaaccattgtagatcagagactgggcagtgaactagggtgttataccatcaacagggtgaagtcattcaagctatgcaaaaacagcgccacagggaaaacctgtgaggtagacagcactccggttaagtgcaggcaaggtttttgtttaaaaatcacccaagagggaaggggccacgtaaaattatctagaggctcagaggttgtcctggatgcttgcgactcaagctgtgaagtaatgatacctaaaggcactggggatatcctagtggactgttcaggtgggcagcaacatttcttaaaagacaacttaattgacctagggtgcccccatatcccgctattgggtaggatggctatttacatttgcagaatgtcaaatcatcctagaacaaccatggcttttctcttctggttcagctttggctatgttatcacttgtatattttgcaaggctcttttttattcattgataattattggaacactaggaaaaaagatcaagcaatatagggaactgaaacctcaaacctgcaccatatgtgagacagctcctgtcaatgcaatagatgctgaaatgcatgacctcaactgtagttacaatatatgcccttattgtgcatcaagattgacctccgatgggctagccaggcatgtaacgcaatgccccaagcggaaagagaaagttgaggagactgaactgtacctgaacctggaaagaattccttggattgtcagaaagctattgcaggtgtcagagtccactggtgtggcattgaaacgaagcagctggctgattgtactgcttgtgttactgacagtttcgttgtcgccggttcagtcagcacctgttggtcatggaaagacaatcgaaatatatcagaccagggaaggattcgcaagcatctgtctctttatgttaggaagcattctatttatagtctcttgcttggtgaaagggctagttgacagtgtcagtgaaagcttcttccccggcctatctgtctgtaagacatgctctattggcagtgtaaatggctttgaaattgaatcgcacaaatgctactgtagcctattttgctgcccctactgtaggcactgctctgctgacagagaaattcaccagttacacttgagtatctgcaaaaaaaggaaaacggggagcaatgtcatgctggccgtctgcaaacgcatgtgctttagggcaaccatagaagcaagcagaagagccctgctcatccgaagcattatcaataccacttttgtaatatgcattctaacattgacaatctgtgttgttagcacctctgcagtggagatggaaaaccttccagcaggaacttgggagagggaggaagatctgacaaatttctgtcatcaggaatgccaggtgactgagacagaatgcctctgtccatacgaagctcttgtgctcagaaaacctcttttcttggacagtatagttaaaggtatgaaaaatttgctaaactcaacaagcttggaaacaagcttatcaattgaggcaccatggggagcaataaatgtccaatcaacctttaaaccaactgtatcgactgcaaacatagcactcagttggagctcagtggtgcacagaggcaacaagatcttggtcacaggcaggtctgaatcaattatgaaactggaggaaaggacaggagtcagctgggatctaggcgtagaagatgcctctgaatccaaattacttaccgtttctatcatggatttgtcacaaatgtattctcctgtttttgagtacttgtcaggagacagacaggttgaagaatggcccaaagcaacttgtacaggtgattgcccggaaaggtgtggttgcacatcatcaacctgcttacataaagaatggtctcactcaagaaactggagatgtaatcccacttggtgctggggagtaggaaccggctgcacctgctgcggggtggatgtaaaagatctttttaccgatcacatgtttgtcaaatggaaagttgaatacataaaaactgaagctatagtatgtgttgcgctcaccagccaagaaagacagtgcagtctgattgaggcaggtactagattcaacttgggccctgtgactattaccctgtctgagccaagaaacattcagcagaagcttcctcctgagattatcacgttgcatcccaaaattgaagaaggcttctttgacttgatgcatgtacaaaaagtgttgtctgcaagtacagtgtgtaaactgcagagttgcacacatggtataccaggagatctacaagtttaccacattggcaacttgttgaaaggggatagagtaaacgggcatctaattcacaaaattgaatcacatttcaacacctcttggatgtcctgggatggttgtgacttagactactactgcaacatgggggattggccatcttgcacatacacaggagtgacccagcataaccatgctgcatttgtaaacttgcttaacattgaaactgattacacgaaaaccttccacttccactctaaaagagtcacagcacatggtgacacaccacaattggacttaaaagcaaggccgacctacggtgcaggtgggatcactgtgctggttgaggttgctgacatggagttgcataccaagaaagttgaaatatcaggcttgaaatttgcaagtctggcttgcacgggttgctatgcttgtagctctggcatctcctgtaaagttaggattcatgtagatgaaccagatgagctcacagtacatgtaaagagcagtgatccagatgtggttgcagctagcacaagtctcatggcgaggaagcttgaatttgggacagacagcacattcaaggccttttcagctatgcccaaaacctctctatgtttttacattgtggagagagaatactgcaagagctgcagtgaagatgatacacaaaaatgtgttgacacaagacttgagcagccacagagcatactaattgagcacaaaggaacgataattggaaagcagaatgatacttgcacagccaaggcaagctgttggctagagtcagtcaagagttttttttatggattgaagaatatgcttggcagtgtttttggtaatcttttcataggcattttgttattccttgccccttttgtcctgttggtgcttttctttatgtttgggtggaaaatcttgttttgctttaaatgttgcaggaggaccagaggcttatttaagtatagacacctcaaagacgatgaggaaacaggctacagaaggattattgaaagactgaacagcaaaaaagggaaaaacaggctgcttgatggtgatagactggctgataggaaaattgctgagctgttctccacaaaaacacacattggctaa

SEQ ID NO: 3685 - RNA, 5052 nt, synthetic construct
  misc_feature 1..5052: note = derived and/or modified CDS sequence (wt) from CCHFV(V42/81)__GU477490.1__GP
  source 1..5052: mol_type = other RNA
atgcatacactattagtgtgcttcattctttacctacaactgttgggtctaggaggagctcatgtacagccaaacgcaactgaacacaatagaacaaacaccaccacagcacccggcacaagccatagcctcaagccacttgtgagcacaaccccaccacaagcaccggaatcatccaccattaaacccactacaccaacaagcgaaacagaaggctcaggggaagcgaccccactttcaaacaccatccaggccccgtcctcaccagagaccacatcagaacgccccgcaacagctgtcataagcacgtcaggcacagacagcacgaactccaccacacagacgaccgataataaccccacaacaacagtcggcacaagtccatccagcagccccagtacgccatccacaccacaaggcatacaccatcatgcaaggagtctattgtcagtcacgagccctgagacagtaacaacaccaaaaccaacgagccctagggagatgagctcggaaaccagcaatcaacactcagccatgagcaggacaccaacccaccacacagtaacccaggtctccactgagaacaccagccacagcacacccagacagcctgagtcctcagcacagccgacatcctcaagcccaatgacttccccagcgcaatcaacccttctaatgagtgctgctcctacagctgtccagagcatacatcccagcccaacgaacaggtctaagaggaaccttgagacggaaataattttaactctatcccagggtctaaagaaatactacggcaaaatactaaaacttctgcaccttaccttggaagaggacactgaaggcctgttagaatggtgtaagagaaaccttgggtcaaactgtgatgatgacttctttcaaaagagaatagaagaattcttcatgactggtgagggctacttcaatgaagtcttacaatttaaaacaccaagcacagtaagccccacggagccatctcatgccagactaccaacagcagaacccttcaaatcttacttcgctaagggtttcctttcaatagattcgggttacttctctgccaaatgttactcgagatcatctacttcagggcttcagctgatcaatgttacccaacacccagctaggatagcagaaacacctggacccaaaacaacgagtctgaaaaccatcaactgtataaacctgagagcatcagtcttcaaagaaaacagagaaattgagatcagtgtgcttcttcctcagatagcagtcaacctctcaaactgccatgttgtgattaattcacatgtctgtgattactctttagacactgatgggccagtgaggcttcctcgcattaaccatgaagggactttcataccaggaacttataaaatagtgatagacaaaaaaaataagctaaatgaccgatgtacactggtcactaactgtgtgataaagggaagagaggttcgtaagggccaatcagtgctgaggcagtacaaaacagaaattaagataggcaaggcatcaacaggctctaggaaactactgtccaaagagccaggtgatgactgtatatcaagaactcagctaatgaggacagaaacagcagagatccatgatgacaactatggtggtccaggtgataaaataactatctgcaatggttcaaccattgtggatcagagactgggcagtgaactagggtgttataccatcaacagggtgaagtcattcaagctatgtgaaaacagcgccacagggaaagcctgtgaagtggacagcactccggttaagtgcaggcagggtttttgtttaaaaatcacccaagagggaaggggccatgtaaagttatctagaggctcagaggttgtcttggatgcttgcgactcaagctgtgaagtaatgatacctaaaggcactggagatatcctagtggactgttcaggtggacagcaacatttcttaaaggacaacttaattgacctagagtgccctcatatcccgctattaggtaagttggccatttacatttgcagaatgtcaaatcatcctagaacaactatggcttttctcttctggttcggctttggctatgtgatcacctgtatactctgcaaggctcttttttattcattgataattattgggacactagggaaaaagatcaagcaatatagggaactgaaacctcaaacttgcaccatatgtgagacagctcctgtcaatgcaatagatgctgaaatgcatgaccttaactgtagttacaatatatgcccttattgtgcatcaagattgacctccgatgggctagctaggcatgtaacgcaatgccccaagcgaaaagagaaagttgaggagactgaactgtacttgaatctggagagaattccttggattgtcaggaagctcctgcaagtgtcggagtccactggcgtggtattgaaacgaagcagttggctgattgtgctgcttgtgttactcacagtttcattgtcaccagttcagtcagcacctgttggtcatggtaagacaattgaaacatatcagaccagagaaggattcacaagcatctgtctctttatgttaggaagcatcctatttatagtctcttgcatagtgaaggggctggttgacagtgtcagtgacagcttcttccccggcctgtctgtctgtaagacatgctctatcagcagtataaatggctttgaaattgaatcgcataaatgctactgtagcttattttgctgcccctactgtaggcactgctctgctgacagagaaattcaccagttacacttgagtatctgcaggaaaagaagaacggggagcaatgtcatgctggctgtctgcaaacgcatgtgctttagggcaaccatagaagtaagcagaagagccctgctcatccgaagcatcatcaataccacttttgtaatatgtattctaacattaacaatctgtgttgttagcacttctgcagtagagatggaaaacctcccagcaggcacttgggagagagaggaagacctaacaaatttctgtcatcaggaatgccaggtaaccgagacggagtgcctctgtccatacgaagctcttgtgctcagaaaacctcttttcttagacagtatagttaaaggtaagaaaaatttgttaaactcaacaagtttggaaacaagcttatcaattgaagcaccatggggagcaataaatatccagtcaacctttaaaccaacagtatcggctgcaaacatagcactcagttggagctcagtggagcacagaggcaacaagatcttagtctcaggcaggtctgaatcaattatgaaactagaggaaagaacaggagtcagctggaatctaggtgtagaagatgcctctgaatccaaattacttaccgtctctatcatggatttgtcacaaatgtattcccctgtttttgagtacttgtcaggagacagacaggttgaagaatggcctaaagcaacttgtacaggtgactgcccagaaaggtgtggttgcacatcatcaacctgcttgcataaagaatggcctcactcaagaaactggagatgcaatcctacttggtgctggggggtaggaaccggctgcacctgctgcggagtggatgtaaaagacctttttatagatcacatgtttgttaaatggaaggttgaatatataaaaactgaagccatagtatgtgttgagctcaccagccaagaaagacagtgcagtctgattgaggcaggtactagattcaacttgggccctgtgactattaccctatccgagccaagaaacattcagcagaagcttccccctgagattatcacgttgcaccccaaaattgaagaaggcttctttgacttgatgcatgtacaaaaagtgttgtctgccagtacagtgtgtaaactgcaaagttgcacacatggtataccaggagatctgcaagtctaccacattggcaacctattgaaaggggatagagtaaacgggcatctaattcacaaaatcgaaccacattttaacacctcttggatgtcctgggatggttgtgacctagactactactgcaacatgggggattggccttcttgcacatacacaggagtgacccagcacaatcatgctgcatttgtaaacttgcttaacattgaaactgattacacgaaaactttccacttccactctaaaagagttacagcacatggtgaaacaccacaattagacttaaaagcaaggccggcatacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgaaccagatgagctcacagtacatgtgaagagcaatgatccagatgtggttgcagctagcacaagtctcatggcaaggaagcttgaatctgggacagacagcacatttaaggccttttcagctatgcccaaaacctctttatgtttttacattgtggagagagaatactgcaagagctgcagtgaagatgatacacagaaatgtgttgaaacaaaacttgaacagccacaaagcatactaattgaacacaaaggaacgataattggaaagcagaatgatacttgcacagccaaggcaagctgttggctggaatcagtcaagagttttttttatggattgaagaacatgcttggcagtgtttttggtaattttttcataggcattttgttattccttgccccctttgtcctgttagtacttttctttatgtttggatggaaaatcttgttttgctttaaatgttgcaggaggaccagaggcttgtttaagtatagacacctcaaagaagatgaggaaacaggctacagaaggattattgagagactgaacagcaaaaaagggaaaaacagactgcttgatggtgaaaggttggctgataggaaaattgctgagctgttctctacaaaaacacacattggctaa

SEQ ID NO: 3686 - RNA, 5052 nt, synthetic construct
  misc_feature 1..5052: note = derived and/or modified CDS sequence (wt) from CCHFV(75-R-2012)__KR814863.1__GP
  source 1..5052: mol_type = other RNA
atgcatacactattagtgtgcttcattctttacctacagctgttgggtctaggaggagctcatagacagtcaaacgcaactggacacaacggaacaaacaccaccacagcacccagcacaagtcaaagccccaagccacttgtgagcacagccccaccacacgcactggaatcatccatcatcaaacacaccacaccagtaagcgaaacagaaggctcaggggaaacgaccccacccccaaacaccacccagggcccgtctccactagagaccacaccagaacgccccgcaacaactgccacaagtacgccaagcacagacaacacgaattccaccacacatgtgaccgacaacaaccctacatcaacaatcagcacaagtccatccagcagccccagcacgccatccacaccacaaggcatacatcatcctgcaaggaatctattgtcagtctcgagccttaagacagcaacaacaccaacaccaacgagcccaggggagataagctcagaaaccagcagtctgcactcagccatgagcagaacatcaaccctctacacagcaacccaggtctccactgaaaatgccaaccacagcgcacctagacagtctgagtcctcagcacagcagacaaccacaagcccaatgacttccccagcacaatcaatccttgtaatgagtgctgctcctacagctattcagaacacacatcccagcccaacgaataggtctaagaggaaccttgagatggaaataattttaactctgtctcaaggtctaaagaaatattatggtaagatactgaagcttctgcacctcaccttggaagaggacactgaaggcctgttagaatggtgtaagagaaaccttggatcaaactgtgatgatgacttctttcagaagagaatagaagaattcttcatgaccggtgagggctacttcaatgaagtcttacaatttaaaacactaagcacacaaagccccacggagccgtctcatgccaggccaccaacagtggagcccttcaaatcttacttcgctaagggcttcctttcaatagattcaggttacttctctgccaaatgttatccaagattatctacttcagggcttcagctgatcaatgtcacccaacacccagctagaatagcagaaacacctggacccaagacaacgagtctgaaaaccatcaactgtataaacctaagagcatcagtcttcaaagaacacagagaaattgagatcaatgtgcttcttcctcagattgcagtcaacctctcaaattgccatgttgtaatcaattcacatgtctgtgattattctttagacactgatgggccagtgaggcttcctcacatttaccatgaagggactttcataccaggaacttataaaatagtgatagacaaaaaaaataagctaaatgaccgatgtacactggtcaccaactgtgtgataaaaggaagagaggttcgtaagggccaatcagtgctgaggcagtacaagacagaaatcaagataggcaaggcatcaacaggctctagaaaactactgtccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcgctccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaacttaattgacctagggtgcccacatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagcccctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctagaaagaattccttggattgtcagaaagctattgcaagtgtcagagtccactggtgtggcattgaagcgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttaacagtgtcagtgacagcttcttccccggcctgtctgtttgtaagacatgctctattggcagtataaatggctttgaaattgaatcgcataaatgctactgtagcctattttgctgcccctactgtaggcactgctctgctgacagagaaattcatcagttacacttgagtatttgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtccgaatcaattatgaaactggaggaaaggacaggagtcagctgggatctaggcgtagaagatgcctctgagtccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggtactggctgcacctgctgcggggtggatgtaaaagacctttttacagatcacatgtttgtcaaatggaaggttgaatatataaaaactgaagccatagtatgtgttgagctcaccagtcaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcaccgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttctttatggattgaaaaatatgcttggtagtgtatttggtaactttttcataggcattttgttattccttgccccttttgtcctgttggtgcttttctttatgtttggatggaaaatcttgttctgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggttaa

SEQ ID NO: 3687 - RNA, 5052 nt, synthetic construct
  misc_feature 1..5052: note = derived and/or modified CDS sequence (wt) from CCHFV(VLG/TI29414)__AY179961.1__GP
  source 1..5052: mol_type = other RNA
atgcatacgctattagtgtgcttcattctttacctacagctgttgggtctaggaggagctcatatacagtcaaacgcaactgaacacaacggaacaaacaccaccacagcacccagcacaagtcaaagccccaagccacttgtgagcacagccccaccacacgcactggaatcatccaccatcaaacccaccacaccagtaagcgaaacagaaggctcagggggaacgaccccacccccaaacaccacccagggcccgtctccaccagaggccacaccagaacgccccgcaacaactgccacaagtacgccaagcacagacaacacgaattccaccacacatgtgaccgacaacaaccctacatcaacaatcagcacaagtccatccagcagccccagcacgccatccacaccacaaggcatacatcatcctgcaaggaatctattgtcagtctcgagccctaagacagcaacaacaccaacaccaacgagccctggggatataagctcagaaaccagcagtctgcactcagccatgagcagaacatcaaccctctacacagcaacccaggtctccactgaaaatgccaaccacagcgcacctagacagtctgagtcctcagcacagcagacaaccacaagcccaatgacttccccagcacaaccaatccttgtaatgagtgctgctcctacagctattcagaacatacatcccagcccaacgaataggtctaagaggaaccttgagatggaaataattttaactctgtctcaaggtctaaagaaatactatggtaagatactgaagcttctgcacctcaccttggaagaggacactgaaggcctgttagaatggtgtaagagaagccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagattatctacttcagggcttcagctgatcaatgtcacccaacacccagctagaatagcagaaacacctggacccaagacaacaagtctgaaaaccatcaactgtataaacctaagagcatcagtcttcaaagaacacagagaaattgagatcaatgtgctccttcctcagattgcagtcaacctctcaaattgccatgttgtaatcaattcacatgtctgtgattattctttagacactgatgggccagtgaggcttcctcacatttaccatgaagggactttcataccaggaacttataaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggcatcaacaggctctaggaaactactgtccgaggagccaggtgatgactgcatatcaagaactcagctattgagggcagaaccagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaatttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagcccctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaagagactgagctgtacttgaacctggaaagaattccttggaatgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcatcagttacacttgagtatctgcaaaaaaagaaaaatgggtagcaatgtcatgctggccgtctgcaagcgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttactaaactcaacaaacttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctgggaagtaggaactggctgcacctgctgcgggtggaatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgctgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggaatgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtgattgcagctagcacaagtctcatggcgaggaagcttgaatttgggacagacagtacattcaaggccttttcagctatgcccaaaacctctttatgtttttacattgcggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacgaaaacacacattggttaa

SEQ ID NO: 3688 - RNA, 5055 nt, synthetic construct
  misc_feature 1..5055: note = derived and/or modified CDS sequence (wt) from CCHFV__KJ648916.1__GP
  source 1..5055: mol_type = other RNA
atgcatatatcattaatgtatgcaatcctttgcctacagctgtgtggtctgggagagactcatggatcacacaatgaaactagacacaataaaacagacaccatgacaacacccggtgataacccgagctctgaaccgccagtgagcacggccttgtctattacacttgacccctccactgtcacacccacaacaccagccagtggattagaaggctcaggggaagtctacacatcccctccgatcaccaccgggagcttgcccctgtcggagacaacaccagaactccctgttacaaccggcacagacaccttaagcgcaggtgatgtcgatcccagcacgcagacagccggaggcacctccgcaccaacagtccgcacaagtctacccaacagccctagcacaccatctacaccacaagacacacaccatcctgtgagaaatctactttcagtcacgagtcctgggccagatgaaacatcaacaccctcgggaacaggcaaagagagctcagcaaccagtagccctcatccagtctccaacagaccaccaacccctcctgcaacagcccagggacccactgaaaatgacagtcacaacgccactgaacaccctgagtccctgacacagtcagcaaccccaggcctaatgacctctccaacacagatagtccacccacaaagtgccacccccataaccgttcaagacacacatcccagtccaacgaacgcctctaaagccaaccttaagatggaaataatcttgactttatctcagggtttaaaaaagtactatgggaaaatattaaggcttctgcaactcaccttagaggaggacactgaaggtctactggaatggtgtaagagaaatcttggtcttgattgtgatgacactttctttcaaaagagaattgaagaattctttataactggtgagggccattttaatgaagttttacaatttagaacgccaggcacgttgagcaccacagagtcaacacctgctgggctgccaacagctgaaccttttaagtcctacttcgccaaaggattcctctcgatagattcaggttactactcagccaaatgttactcaggaacatccaattcagggcttcaattgattaacattacccgacattcaactagaatagttgacacacctgggcctaagatcactaacctaaagaccatcaactgcataaacttgaaggcatcgatcttcaaagaacatagagaggttgaaatcaatgtgcttctcccccaagttgcagttaatctctcaaactgtcacgttgtaatcaaatcacatgtctgtgactactctttagacattgacggtgcggtgaggcttcctcacatttaccatgaaggagttttcatcccaggaacttacaaaatagtgatagataaaaaaaataagttgaatgacagatgcaccttatttaccgactgtgtgataaaaggaagggaggttcgtaaaggacagtcagttttgaggcagtacaagacggaaatcaggattggcaaggcatcaaccggctctagaagattgctttcagaagaacccagtgatgactgtatatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggccattttttacttgttaataattgttggaacactagggaaaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaaaaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtgggagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctggcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatagaagaattgccgaactgttctctacaaaaacacacattggctag

SEQ ID NO: 3689 - RNA, 3495 nt, synthetic construct
  misc_feature 1..3495: note = derived and/or modified CDS sequence (wt) from CCHVF(CCHVF 10200)__U39455.2__Gn-NSm-Gc
  source 1..3495: mol_type = other RNA
tcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaacaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctagcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggc

SEQ ID NO: 3690 - RNA, 3495 nt, synthetic construct
  misc_feature 1..3495: note = derived and/or modified CDS sequence (wt) from CCHVF(CCHVF IbAr10200)__AF467768.2__Gn-NSm-Gc
  source 1..3495: mol_type = other RNA
tcagaagaacccagtgatgactgtatatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggccattttttacttgttaataattgttggaacactagggaaaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaaaaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtgggagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctggcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatagaagaattgccgaactgttctctacaaaaacacacattggc

SEQ ID NO: 3691 - RNA, 3495 nt, synthetic construct
  misc_feature 1..3495: note = derived and/or modified CDS sequence (wt) from CCHVF(CCHVF Turkey-Kelkit06)__GQ337054.1__Gn-NSm-Gc
  source 1..3495: mol_type = other RNA
tccgaagagccaggtgatgactgcatatcaagaactcagctattgaggacagaaacagcagagatccatgatgacaactatggtggtccaggtgataaaataactatctgcaacggttcaaccattgtagatcagagactgggcagtgaactagggtgttataccatcaacagggtgaagtcattcaagctatgcaaaaacagcgccacagggaaaacctgtgaggtagacagcactccggttaagtgcaggcaaggtttttgtttaaaaatcacccaagagggaaggggccacgtaaaattatctagaggctcagaggttgtcctggatgcttgcgactcaagctgtgaagtaatgatacctaaaggcactggggatatcctagtggactgttcaggtgggcagcaacatttcttaaaagacaacttaattgacctagggtgcccccatatcccgctattgggtaggatggctatttacatttgcagaatgtcaaatcatcctagaacaaccatggcttttctcttctggttcagctttggctatgttatcacttgtatattttgcaaggctcttttttattcattgataattattggaacactaggaaaaaagatcaagcaatatagggaactgaaacctcaaacctgcaccatatgtgagacagctcctgtcaatgcaatagatgctgaaatgcatgacctcaactgtagttacaatatatgcccttattgtgcatcaagattgacctccgatgggctagccaggcatgtaacgcaatgccccaagcggaaagagaaagttgaggagactgaactgtacctgaacctggaaagaattccttggattgtcagaaagctattgcaggtgtcagagtccactggtgtggcattgaaacgaagcagctggctgattgtactgcttgtgttactgacagtttcgttgtcgccggttcagtcagcacctgttggtcatggaaagacaatcgaaatatatcagaccagggaaggattcgcaagcatctgtctctttatgttaggaagcattctatttatagtctcttgcttggtgaaagggctagttgacagtgtcagtgaaagcttcttccccggcctatctgtctgtaagacatgctctattggcagtgtaaatggctttgaaattgaatcgcacaaatgctactgtagcctattttgctgcccctactgtaggcactgctctgctgacagagaaattcaccagttacacttgagtatctgcaaaaaaaggaaaacggggagcaatgtcatgctggccgtctgcaaacgcatgtgctttagggcaaccatagaagcaagcagaagagccctgctcatccgaagcattatcaataccacttttgtaatatgcattctaacattgacaatctgtgttgttagcacctctgcagtggagatggaaaaccttccagcaggaacttgggagagggaggaagatctgacaaatttctgtcatcaggaatgccaggtgactgagacagaatgcctctgtccatacgaagctcttgtgctcagaaaacctcttttcttggacagtatagttaaaggtatgaaaaatttgctaaactcaacaagcttggaaacaagcttatcaattgaggcaccatggggagcaataaatgtccaatcaacctttaaaccaactgtatcgactgcaaacatagcactcagttggagctcagtggtgcacagaggcaacaagatcttggtcacaggcaggtctgaatcaattatgaaactggaggaaaggacaggagtcagctgggatctaggcgtagaagatgcctctgaatccaaattacttaccgtttctatcatggatttgtcacaaatgtattctcctgtttttgagtacttgtcaggagacagacaggttgaagaatggcccaaagcaacttgtacaggtgattgcccggaaaggtgtggttgcacatcatcaacctgcttacataaagaatggtctcactcaagaaactggagatgtaatcccacttggtgctggggagtaggaaccggctgcacctgctgcggggtggatgtaaaagatctttttaccgatcacatgtttgtcaaatggaaagttgaatacataaaaactgaagctatagtatgtgttgcgctcaccagccaagaaagacagtgcagtctgattgaggcaggtactagattcaacttgggccctgtgactattaccctgtctgagccaagaaacattcagcagaagcttcctcctgagattatcacgttgcatcccaaaattgaagaaggcttctttgacttgatgcatgtacaaaaagtgttgtctgcaagtacagtgtgtaaactgcagagttgcacacatggtataccaggagatctacaagtttaccacattggcaacttgttgaaaggggatagagtaaacgggcatctaattcacaaaattgaatcacatttcaacacctcttggatgtcctgggatggttgtgacttagactactactgcaacatgggggattggccatcttgcacatacacaggagtgacccagcataaccatgctgcatttgtaaacttgcttaacattgaaactgattacacgaaaaccttccacttccactctaaaagagtcacagcacatggtgacacaccacaattggacttaaaagcaaggccgacctacggtgcaggtgggatcactgtgctggttgaggttgctgacatggagttgcataccaagaaagttgaaatatcaggcttgaaatttgcaagtctggcttgcacgggttgctatgcttgtagctctggcatctcctgtaaagttaggattcatgtagatgaaccagatgagctcacagtacatgtaaagagcagtgatccagatgtggttgcagctagcacaagtctcatggcgaggaagcttgaatttgggacagacagcacattcaaggccttttcagctatgcccaaaacctctctatgtttttacattgtggagagagaatactgcaagagctgcagtgaagatgatacacaaaaatgtgttgacacaagacttgagcagccacagagcatactaattgagcacaaaggaacgataattggaaagcagaatgatacttgcacagccaaggcaagctgttggctagagtcagtcaagagttttttttatggattgaagaatatgcttggcagtgtttttggtaatcttttcataggcattttgttattccttgccccttttgtcctgttggtgcttttctttatgtttgggtggaaaatcttgttttgctttaaatgttgcaggaggaccagaggcttatttaagtatagacacctcaaagacgatgaggaaacaggctacagaaggattattgaaagactgaacagcaaaaaagggaaaaacaggctgcttgatggtgatagactggctgataggaaaattgctgagctgttctccacaaaaacacacattggc

SEQ ID NO: 3692 - RNA, 3498 nt, synthetic construct
  misc_feature 1..3498: note = derived and/or modified CDS sequence (wt) from CCHVF(CCHVF SR3)__AJ538199.1__Gn-NSm-Gc
  source 1..3498: mol_type = other RNA
tccgaagaatctggtgatgactgcatatcaagaactcagctattgaggacagagactgcagaggtccatggcgacaactacggtggtccaggtgataagataaccatctgtaatggttcaactgttgtagatcaaagactgggtagtgaactagggtgttacactatcaatagagtgaggtcattcaagctatgcgaaaacagtgccacagggaagagctgtgaaatagacagtatcccagtcaagtgtaagcagggttattgccttaaaatcactcaggaaggaaggggccatgtgaagttatctagaggctcagaagttgtcttggatgtatgtgattcaagctgtgaagtgatgatacctaagggcactggtgacattctagtagattgttcaggtgggcagcaacattttttaaaagacaacctggttgacctagggtgtcccaaaattccgttactgggcaaaatggctatttatatctgcaggatgtcgaatcaccccaagacaaccatggccttcctcttttggttcagctttggctatgtgataacttgtatactttgcaaggccatttttttcttattaataatttttggaacactagggaaaaggttcaagcagtacagagagttgaaaccccagacctgcaccatatgtgagacaacacctgtaaatgcaatagatgctgaaatgcatgatctcaactgcagttacaatatatgtccctattgtgcgtctagactgacttcagatgggcttgctaggcatgtaacacaatgtcctagacggaaggagaaagtggaggaaaccgaattatacctgaatttagagagaattccctgggttgtaagaaagctattgcaggtgtcagagtccactggtacagtattaaaaaggagcagctggctaattgtattacttgtgctgttcacagtttcattgtcaccagttcaatcagcacccattggtcacgggaaaacaattgaaacataccgggttagggaagaatacacaagtatttgcctctttgtactagggagtatcctgtttatagtctcttttctaatgaaaggactggttgacggtgttggcaacatcttctttcctgggctgtccgtctgtaagacatgctctataggtagcattaatggctttgaaattgagtctcataagtgctactgtagcttgttttgttgcccttactgtaggcactgctctgctgatggagaaatccatcagctgcacttgagcatctgcaaaaaaaggaagacaggaagtaatgttatgctggctgtttgcaaacgcatgtgtttcagggcaactatggaagtaagcaacaaagccctatttatccgtagcatcatcaacaccacttttgttatgtgcatactgaagggcgaattcgcggccgttaaatcaattcaccctatagagatggaaagcctaccagctgggacctgggaaagagaagaagacctaacaaatttctgccatcaggaatgccaggttacagagactgagtgcctctgcccttatgaagctctagtgctcagaaggcccctatttctagatagtatagtcaaaggtatgaaaaatctgctaaactcaacaagtctagaaacaagcttatcaattgaggcaccgtggggagcaatcaatgttcagtcaacctacaaaccaactgtctcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagttatggacttgtctcagatgtactctcctgtcttcgagtacttatcaggtgacagacaagtggaagagtggcctaaagcaacctgcacaggtgactgcccagaaagatgtggctgcacatcatcaacctgcttacacaaagagtggccccactcaaggaattggagatgtaatcctacttggtgctggggtgtagggactggctgcacctgttgtggtttagatgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagaaccaaggaacattcaacaaaagctccctcctgaaataatcacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacctgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacaactagatctgaaggcaaggccaacctatggtgcaggtgagatcaccgtgctggtggaagttgctgacatggagttacacacaaagaagattgaaatatcaggcttaaaatttgcaggcctaacttgcacaggttgttatgcttgtagttctggcatctcttgtaaagttagaattcatgtagatgaaccagatgaacttacagtacatgttaaaagtgatgacccagatgtagttgcagctagctcaagtctcatggcgaggaagcttgaatttggaacagacagtacatttaaagctttctcagccatgcctaaaacctccctatgtttctacattgtggaaagggaatactgtaaaagctgcaataaagaagatacacaaaaatgtgttaacacgaaactcgaacaaccacagagcattttgatcgaacataagggaactataattggaaagcaaaacaatacttgcacggctaaagcgagttgctggttagagtcagttaagagtttcttttatggtctgaagaatatgctcggtggcatatttggcaatgtttttataggcattttcacatttcttaccccctttatcttgttaatacttttctttatgtttgggtggaggatcctgttttgcttcaagtgttgcagaaggaccagaggcctattcaagtacagacacctcaaagacgatgaagaaactggttacagaaagatcattgaaagactgaacaacaaaaaaggaaaaaacaggctgcttgatggtgaaagacttgctgacagaaagattgctgaactgttctccacaaaaacacacattggc

SEQ ID NO: 3693 - RNA, 3498 nt, synthetic construct
  misc_feature 1..3498: note = derived and/or modified CDS sequence (wt) from CCHVF(CCHVF UCCR4413)__KY484038.1__Gn-NSm-Gc
  source 1..3498: mol_type = other RNA
tcagaaagcagcgctagtggttgcatttcaaggacccagatgatcaagtcagaaacagcagagatccacgacgacatctacggaggacctggtgagaagcttaccatctgtaatggtaccactgttgtagatcaaagactgggcagtgaactaggttgctacacaatcaacagaattaagacctataaattgtgtgaaaacagtgtcaaagaaaaaacttgtgagattgacagtgtaccagtcaagtgtagacaggggctttgtttgaagataactcaagaaggaagaggccatgttaagctttccagaggctcagagattgtcctggacatttgtgactctagttgtgaattgatgatacctaaaggcactggggacatattggtagattgttctggaggacagcaacattttttacaggataacctggttgacttaggttgccctaacatccccctacttgggaaagtggctatctacatatgcagaatgtcaaatcaccccaagactaccatggcatttctcttctggttcagttttggttatgtgatcacatgcatattgtgcaaaatactcttttacctactcataatcactggcacactagggaaaaaactaaagcagtatagagagctcaagccacaaacatgtaccatatgtgaatcaacacctgtgaatgcaatagatgctgagatgcatgacctcaactgtagttacaacatatgcccttattgtgcatctagactgacttcagatgggctcataaggcatgtgaatctgtgccccaagaggaaggagaaagttgaagagacagaactgtatttgaacttagaaagaataccttggtttgtgagaaagcttttacaggtgtctgaatctacaggagtagctctcaaaagaagcagttggctattgatacttgttatattgctcacagtttctatgtcaccagttcagtcggcaccaattaatcaacaaagagcagttgaagcctaccaggctagggagggctacacaggcatctgcctctttatattagggagtgtcctatttatgacctcttggctaacaaaaggattgattgacagtattggcgacagtttcttccctgggctctttgtgtgcaaaacatgctccataggcagcatcaatggctttgaaatagaatcccataggtgttactgcagcttgctctgctgtccatactgtagaacctgctctgctgacaaagacagccatcagctgcatctaagtatttgtaaaaagaaaaaagcaggaagtaatgtcatgctagcagtgtgtaagcgtatgtgcttcaaggcaacaattgaagcaagcaatagggtgctactgattagaagtatcataaacactacattcattatatgcatgctaattttagtagtgtgtgtcataagcacttctgcagtcgaaatggaagatctaccggcaggcacttgggagagagaagaagacctcaccaacttctgccaccaagaatgccaagtaacagagactgagtgtttgtgcccttatgaagcttttgtgcttagaaaaccactcttcctgagtagtatagtcaagggtaagaagaatctgctaaactcagcaagtttagaaacaagcctgtcaattgaggcaccatggggagccataaatgctcagtccacctttaaacccaccatatcaactgcaaatatagcactcagctggagctcagtggagcatagaggcaataaagttttggtttcaggtagatcagagtctatcatgaaactcgaggagcgaacaggaatcagttggaacctaggggtagaggacgcatcagagtcaagaatgctaacggtctctgtcatggacttgtcacagatgtacttaccagtatttgaatatctgtctggtgacaggcaagtggaagagtggccaaaagcaacctgtacaggtgactgtccagaaagatgcggctgcacatcatcaacctgcttgcataaagaatggccgcactcaagaaactggagatgcaatcccacttggtgttggggggttggaacaggatgcacatgctgcggattagacgtgaaagacctgttcactgattatatgtttgttaagtggaaggttgagtatattaagactgaagccatagtttgtgttgagttaaccagccaagagagacagtgcagcttaattgaggccggcacaagattcaacttaggtcccgtgacaataacattatcagaaccaaggaacatccaacaaaagctcccttcagagatagtcacactgcatcccaaaatagaagaaggcttctttgacctcatgcatgtgcaaaaggtactatctgctagcacggtgtgcaagctgcagagctgcacgcacggagtggcgggagacctgcaggtctatcatgttggcaatttattaaaaggggacaaaataaatggacattcgattcacaagattgaaccacatctcaacacatcatggatgtcttgggatggctgtgatctagactattactgcaatatgggagattggccctcttgcacatacacaggggtgacacaacacaatcatgcagcatttgtcaacctactaaacattgaaactgattacaccaaaagcttccactttcactcaaaaagagtaacagcacatggagacactccccaactggacctgaaggcgcggcccatgtatggtgcaggcgaaataactgtcttggtggaggttgctgacatggaattgcactcaaagaacattgagatctcaggtctaaaatttgcaagcttgacctgctcaggctgttatgcctgcagctcaggtatttcatgcaaagtcagaatccatgtagacgagcccgatgagctagcagtacatgtaaagagtgatgatctggatgttgtggcagctagttcaagtcttatggcaagaaaaatagaattcggaacagatagcacatttaaagctttctcatctatgccaaaagaatctttatgcttctacattgttgaaagagacttctgtaaaagttgtgcagcagaagacacacaaaaatgtgtgaaagcaaaacttgaacagccacaaagcatacttattgaacacaaagggacaataattgggaaacaaaatgacacttgctcaaccaaaacaagctgttggttggagtcattcaaaagcttcttttatgggctaaaaaacatgctaagcggcgtttttggcagtgctattatgggcattctcttgttccttgccccctttatcttgttaatacttttcttcttttttggatggagaatcttattctgcctaagatgttgtagaaggaccagagggctgtttaagtacaagcatatcaaggatgatgaggaagcaggctacaaaaaaatcattgagaagcttaacaacaaaaaagggggaacaagtaaattgttagatggtgagagacttgcggacagaaagattgccgaacttttctcaacaaaagcacacatcggc

SEQ ID NO: 3694 - RNA, 3495 nt, synthetic construct
  misc_feature 1..3495: note = derived and/or modified CDS sequence (wt) from CCHVF(CCHVF 66019)__AB069669.1__Gn-NSm-Gc
  source 1..3495: mol_type = other RNA
tccgaagagtctggtgacgactgcatatctagaactcagctattgaggacagagactgcagaggtccatggtgacaactatggtggtccaggtgacaaaataactatctgtaatggttcaaccattgtggatcaaagacttggcagtgaactggggtgttatactatcaatagagtgaagtcattcaagctatgcgaaaatagtggcacgggaaaatcctgtaagatagataacaccccagttaagtgcaggcagggtttttgcttaaaaattactcaggaaggaaggggccatgtgaagctatcgagaggctcagaagttgtcttagatgcctgcgactcaagctgtgaaataatgataccgaagggcacaggagacatcctagtagactgttcaggtgggcaacaacatttcttaaaagataacttggttgatctaggatgccctaacattccactattaggtaaaatggctatctacatttgcaggatgtcaaatcaccctaaaacaactatggcttttctcttttggtttagtttcggctatgtaataacatgtatattttgtaaaatcattttttacttgttgatagtcgtggggacattggggaaaaagttcaaacagtaccgggagctgaaacctcagacttgtactatatgtgaaacaactcctaccaatgcaatagatgctgaaatgcacgatcttaaatgcagttacaatatatgcccttattgtgcatctagattaacctcggacgggcttgccaggcatgtgacacaatgccctaagcgaaaagagaaagtagaagagactgaactgtacttgaacttggaaagaattccttggattgtcagaaaactactgcaagtgtcagagtctaccggtgtggcactgaaaaggagcagttggctaattgtgttacttgtgctacttacagtttcattgtcaccggttcaatcagcacccattggacatggaaagacaattgaggcatatcagaccagagaggggtacacaagtgtttgcctgtttatgctgggaggcatcttgtttgtggtctcctgcctgatgaaagggctagttgacagtgtcagcaacagctttttccctgggttatctatttgcaaaacctgttctatcggcagtgtaaatggctttgaaattgaatcccataaatgttactgtagcttactttgttgcctttattgtagacattgctctgctgatagggaaatccaccaattgcacttgagcatctgcaaaaaaagaagggcaggaggcaatgtcatgctggctgtctgcaagcgcatgtgcctcagagcaactatggaggtaagcaataaggtcctattcatccgaagtattatcaacaccacttttgttatatgcatactggtattggcagtctgtatcgttagcacctccgcagtagagatggaaagcctaccagccggcacttgggaaagggaggaagacctgacaaacttctgccaccaggaatgccaagtcacagagactgaatgtctctgtccttacgaggctcttgtactcaggaaacccctattctcagacagtatagtcaagggcatgaaaaacctgctaaattcaactagcttggaaacaagcttatcaattgaagcaccatggggagcaataaacgtccagtcaacctttaaacccaccgtttcaactgcaaacatagcacttagctggagttcagtagaacacagaggtaacaaaattttggtctcaggcagatcagaatcaattatgaagctagaagaaaggacaggaatcagctgggatctgggcgtagaagatgcctctgagtctaagttgcttactgtttctgtcatggatttgtcacagatgtattctcctgtctttgagtacttatcaggtgacagacaggtagaggagtggcccaaagcaacctgcacaggtaattgcccagataggtgtggctgcacatcatcaacctgcttacacaaggaatggccccattcaaggaattggagatgcaaccccacttggtgttggggagtcggcactggatgcacctgctgtggactagatgtgaaagatctttttacagattatatgtttgtcaagtggaaagttgaatacataaagaccgaggccatagtgtgcgttgagctcaatagccaagaaaggcagtgcagcttgattgaggcaggcacaagattcaacttgggtcctgtgaccatcacgttgtcagaaccaagaaacattcagcagaagcttccttctgaaataatcacattgcatcctagaattgaggaaggcttcttcgatctgatgcatgttcaaaaggtgctgtctgcaagtacagtatgcaagctacaaagctgcacacatggtgtgccaggagacttacagatctaccacattggcaacttgttaaaaggggatagggtaaatgggcatctgattcacaaaattgagccacacttcaacacttcttggatgtcctgggatggctgtgacctagattactactgtaacatgggggattggccctcttgcacatatactggagtgacccaacataaccatgctgcttttgtaaacttacttaacatcgaaactgattacacaaagaacttccattttcattctaagagagttactgcacatggagacacaccacagctggatttgaaagctagaccaacttacggtgcgggtgaaatcactgtactagtggaggttgctgacatggagttacacacaaaaaagattgcgatatcaggtctgaaatttgcaagtttgacttgcacaggttgctatgcttgtagctctggcatctcctgtaaagtcaggattcatgtggatgaaccagatgagcttacagtacatgtgaaaagtgaagatccggacattgttgcagccagctcaagcctcatggcaaggaagcttgaatttgggacagacagcacattcaaggccttctcagccatgcccaaaacctccttgtgcttctacattgtagagagagaatactgtgagagctgcagcaaagaagacacacagaaatgtgttaacacaaagcttgagcaaccacaaagcattttaattgagcacaaaggaacaataatcggaaagcaaaatgacacttgcacagccaaagcaagctgctggttagagtcagtaaagagttttttttatggattgaagaacatgcttagcggcatcttcggcaacgtttttataggcattttcttattccttgctccttttattctgttaatactcttctttatgtttgggtggagaatcctgttttgctttaagtgttgcagaaggaccagaggcttattcaagtacagatatctcaaggacgacgaagagtctggttacagaagaatcattgaaagattaaacaacaaaaaaggaaaaaacaagttacttgacggtgaaagactagctgacaggaggatcgctgagttgttctctaccaaaacacacattggt

SEQ ID NO: 3695 - RNA, 3495 nt, synthetic construct
  misc_feature 1..3495: note = derived and/or modified CDS sequence (wt) from CCHVF(CCHVF 7001)__AB069670.1__Gn-NSm-Gc
  source 1..3495: mol_type = other RNA
gcagaaggaggaagcagtgactgcatttcaagaactcagctagttaaaacggaggttgcagaaattcatgaggacagttacggtgggcctggtgagaaaataacaatctgcaatggttccacaattgtagatcaaaggcttggtagtgaattgggctgttatacaatcaacagagtaagatcctacaagctatgcgagaacagtgcctcagggaaaagctgtgaaatagatagcatcccagtcaaatgcaaacaagggttttgcctcaaaataacccaagaaggaagaggtcatgtaaaactgtccagagggacagaaattgttctagatgtctgtgattccagctgtgagctgatgatacccaagggcactggagacattttagtggattgctcaggagggcaacagcattttttacaaaacaatctgattgacttgggatgccccaatgtcccattactgggtaaaatggccatatatgtctgcagaatgtcaaaccacccaaaaactaccatggcatttctgttctggttcagctttggctatgtcattacatgtatagcatgcagggtactcttctacttgctgattgccatcggaacagtagggaaaaagctaaaacagtatagagagctgaaaccacaaacatgcattgtctgtgaatctgtccctgttaatgcaatagatgctgaaatgcatgagcttaattgcagttacaatatatgcccatactgtgcatctagactgtctacagacgggctcatcaggcacgtaactcagtgtcccaaacggagggagaaggtggaagagactgagctattcttgaacttggaaagaataccttggctggtgagaaagctccttcaagtatcagagtcaacaggaatggctctaaagagaagctgttggatgatcacactcctcattctactattggtttcgatatcaccagtccaatctgcaccggtaggcaaagagagggcaatcgagacctatcaagcaagagaaacctacacaggcatatgcctctttgtgttaggaagtgttctctttgcggtatcctggctgacaaaggccttgattgatggcatcggcaacagcttcttccctggactttctgtctgcaagacatgctccattggtagtataaatggatttgaaatagagtctcataaatgctattgcagtctattctgttgtccttactgtagagcttgctcatccgacaaaaacactcaccggatgcacttaaatgtttgcaaaaaaaggaagatgggtagcaatgtcatgctggctgtctgtaaacgtatgtgctttagagcaaccattgaggcaagcaataaggctttactgatcaggagcatcataaattccacttttgtgatttgcatattaatcctaacaatctgtgtggtaagcacctccgcagttgatatggaaaatttgcctgcaggcatctgggagaaagaagaagatcttacaaacttctgtcaccaggagtgtcaagtgacagaaactgaatgcctctgcccgtatgaggccatggtactcaggaagccactcttcctggataacatagccaagggaatgaaaagcctgttgaactccacgagcttagaaactagtctgtcaattgaagctccgtggggagcaatcaatgtccagtcaactttcaaaccaacagtttcagctgctaacatagcacttagctggagttcagttgaacacaggggcaacaaaattttagtttcaggtagatcagagtcaatcatgaaattagaagaaagaacaggagtcagctggaatctgggtgtagaagatgcttctgagtcaaagacgcttactgtttccgtcatggacctgtcacaaatgtactctcctgtttttgagtacttgtcaggtgacagacaagtggaggaatggccaaaggcaacttgcacaggtgactgtccagagagatgcggctgcacttcgtcaacctgcttacataaagagtggccacattcaagaaactggcgatgtaatcctacctggtgttggggggtggggactggctgcacttgctgtgggctggatgtaaaggatttttttactgactacatgctggtaaaatggaaagtggaatatataaagacagaagctatagtgtgtgtcgagctgactagtcaagagaggcagtgtagtttaattgaagcaggcacaagatttaacctaggccctgtaacaataaccctatcagagccaagaaatgtccagcagaggcttcctcccgaaattgtaacactgcatcctaaaatagaggaaggtttttttgatttgatgcatgtacaaaaaatactgtctgcaagcacagtttgcaagctacagagctgcacacacggtgtgccgggcgattttcaggtctaccatgtcggtaacctgctgaggggagacaaggttaatggacactcaattcacaagatagaaccacattttaatacttcatggatgtcatgggatggttgcgatctggactatttctgcaatatgggggactggccttcatgcacatacactggagtgacacagcataaccgtgctgcatttatcaacatgctcaacattgagactgactatacaaaaactttccactttcattcgaagagggtcacggcacatggagatactccccagctagacctaaaagcgagaccggcatatggtgctggcgaggtcactgttctagtggaggttgcagacttggagttgcacacaaagaaacttgaagtgtcaggtttgaaaattgcaagtttgacctgctctgggtgttatgcctgcagctctggcatctcctgcaaagttagaatccatgtaaatgaaccagatgaatttacagtacatgtaagaagtagcgacccagatgttgtagcagcaggatcaagtcttatggcaaggaaaatagagtttggggctgacagtacattcaaggccttttcatcaatgcccaaggactccttatgcttttacatagtagaaaaggattactgcagcagctgcaccgacgatgacacacaaaagtgtgtcaacacgaagcttgaccatccacagagcatactcattgagcacaaaggaacaataattggcaagcaaaatgacacttgttcgaccaagacaagctgctggctagaatcagttaagggttttttctatgggctaaaaaacatgctaagtggcatctttggaaatgtttttttaggcatcttcttattccttgctccttttgtgctactgatattttttttcttttttgggtggaggcttctgttttgtctcaaatgttgcagaagaactagaggactgttgaaatacaagcaccttaaggatgaagaggaggctggatacaaaaaaatcattgaaaggctaaatggcaaaaaaggtaaaagtcaattgtttgatggtgaaaggcttgcagacaggaagattgctgagcttttttctactaaaattcacataggt

SEQ ID NO: 3696 - RNA, 3495 nt, synthetic construct
  misc_feature 1..3495: note = derived and/or modified CDS sequence (wt) from CCHVF(CCHVF 75024)__AB069671.1__Gn-NSm-Gc
  source 1..3495: mol_type = other RNA
tctgaagaatctggtgatgactgcatatcaagaactcagctattgaggacagagactgcagagatccatggtgataactatggcggtccgggtgacaagattactatttgcaatggttcgacaattgtagatcaaagactgggtagtgagatggggtgttacactatcaatagggtgaagtcattcaagctgtgcgaaaacagtgcaacagggaagagctgtgaaatagacagtatcccagttaagtgcaggcagggttattgcctaaaaatcactcaggaaggaaggggccatgtgaaattatccaggggctcagaggttgtcttggatgcatgcgactcaagctgtgaagtaatgatacctaagggcacaggtgacatcctggtagactgttcaggtgggcagcaacattttttgaaggacaacttaattgatctaggatgtcccagtattccattactgggtaaaatggctatttatatttgcagaatgtcgaatcaccctaagacaaccatggctttcctcttttggttcagttttggctatgtgataacttgtatactctgcaaggctattttctacttattaataattgttggaacgctagggaagaggtttaagcagtacagagagttaaaaccccagacctgtaccatatgtgagacaactcctgcaaatgcaatagatgctgaaatgcatgaccttaactgcagttacaacatatgtccctattgtgcatctagactaacctcagacgggcttgctaggcatgtgacacaatgccctaagcggaaggagaaagtagaagaaactgaattgtacttgaacttagagagaattccctgggttgtaagaaagctgttgcaggtatcggagtccaccggtgttgcattaaaaagaagcagctggctgattgtgctgcttgtgctgttcgcaatttcattatcaccagttcaatcagcacccatcggtcatgggaagacaattgaaacataccaggccagggaggaatacacaagcatctgcctctttgtactaggaagtatcctgtttatagtctcttgtctaatgaaagggctggttgacagtattggcaacatcttcttccctgggctgtccatttgcaaaacgtgctctataggtagtatcaatggctttgaaattgagtctcataagtgctattgtagcttgctttgttgcccctattgtaggcattgttctgctgatagagaaattcatcagctgcacttgagcatctgcaaaaaaagaaaaacaggaagtaatgttatgcttgcagtctgcaagcgcatgtgcttcagagcaactatggaagtgagcaataaggccctacttatccgtagtatcatcaacaccacttttgttgtgtgcatattaatactagcagtctgtgttgttagcacctcagcagttgagatggaaagcctaccagctgggacctgggaaagagaagaagacctaacaaatttctgtcatcaggaatgccaggttacggagactgagtgcctctgcccttatgaagccctagtactcagaaggcccttgttcctggacagtatagttagaggcatgaaaaatcagctaaactcaacaagtttagaaacaagcttatcgattgaggcaccatggggagcaataaatgttcagtcaacctacaaaccaactgtgtcaactgcaaacatagcacttagttggagctcagttgaacacagaggtaataagattttggtttcaggcagatcagaatcaattatgaagctggaagaaaggacaggaatcagctgggaccttggcgtagaagatgcctctgaatctaagctacttacagtctctgtcatggacttgtctcagatgtactctcctgtcttcgagtacttatcaggtgacagacaagtagaagagtggcccaaggcaacctgtacaggagactgcccagaaagatgtggctgcacaacatcaacctgcttgcataaagaatggccccattcaagaaactggagatgtaatcccacttggtgctggggggtggggactggctgcacttgttgtggattagatgtgaaagacctttttacagattatatgattgtcaagtggaaagttgaatacattaaaacagaggccatagtgtgtgtggaactcaccagtcaggaaaggcagtgtagcttgattgaggcaggcacaaggttcaatttaggttctgtgaccatcacattgtcagaaccgaggaacattcaacaaaagctccctcctgaaataatcacattgcatcctaggattgaagaaggtttttttgacctgatgcatgtacaaaaagtgttgtcagctagcacagtgtgtaagttgcagagttgcacacacggtgtgccaggtgatctacaggtctaccatgtcggaaatttattaaaaggagataaggtgaatggacacctaattcataaaattgagccacacttaaacacttcctggatgtcctgggatggctgtgatctagactactattgcaacatgggagactggccttcttgtacatataccggagttacccaacacaatcatgcttcatttgtaaacctgctcaacattgaaactgactatacaaaaagcttccactttcactctaaaagggttactgcacacggagacacaccacaattagatctgaaggcaagaccaacctacggcgcaggagaaatcactgtactggtagaagttgctgacatggagttcacaccgaagaagattgaaatatcaggcctaaaatttgcaagcctgacttgcacaggctgttatgcttgtagttctggcatttcctgcaaagttaggattcatgtggatgaaccagatgaacttacagtacatgttaagagtgatgatccagatgtagtagcagctagctcaagtctcatggcaaggaagcttgagtttggaacagacagtacatttaaagctttctcagctatgcccaaaacttccttatgtttctacattgtcgaaagggagtactgtaagagctgcagtaaagaagacacacaaaaatgtgttaacacaaaacttgagcaaccacagagcattttgatcgaacataagggaactataattggaaagcaaaacaatacctgcacagccaaagcaagttgctggttagagtcggttaaaagtttcttttatggtctaaagaacatgcttagtggcatttttggcaatctttttatgggcatcttcttatttcttgcccccttcatcttgttaatacttttctttatgtttggatggaggatcctgttttgctttaagtgttgcagaagaaccaggggcctgttcaagtatagacatctcaaagacgatgaagaaactggttacaggaggatcattgaaagactgaacaacaagaaggggaagaacaagctgcttgatggtgaaagacttgccgatagaagaattgccgaactattctccacaaaaacacacattggc

SEQ ID NO: 3697 - RNA, 3495 nt, synthetic construct
  misc_feature 1..3495: note = derived and/or modified CDS sequence (wt) from CCHVF(CCHVF 7803)__AB069672.1__Gn-NSm-Gc
  source 1..3495: mol_type = other RNA
tctgaagaatctggtgatgactgcatatcaagaactcagctattgaggacagagactgcagagatccatggtgataactatggtggtccgggtgacaagattactatttgcaatggttcgacaattgtagatcaaagactgggtagtgagatggggtgttacactatcaatagggtgaagtcattcaagctgtgcgaaaacagtgcaacagggaagagctgtgaaatagacagtatcccagttaagtgcaggcagggttattgcctaaaaatcactcaggaaggaaggggccatgtgaaattatccaggggctcagaggttatcttggatgcatgcgactcaagctgtgaagtaatgatacctaagggcacaggtgacatcctggtagactgttcaggtgggcagcaacattttttgaaggacaacttaattgatctaggatgtcccagtattccattattgggtaaaatggctatttatatttgcagaatgtcgaatcaccctaagacaaccatggctttcctcttttggttcagttttggctatgtgataacttgtatactctgcaaggctattttctacttattaataattgttggaacgctagggaagaggtttaagcagtacagagagttaaaaccccagacctgtaccatatgtgagacaactcctgcaaatgcaatagatgctgaaatgcatgaccttaactgcagttacaacatatgtccctattgtgcatctagactaacctcagacgggcttgctaggcatgtgacacaatgccctaagcggaaggagaaagtagaagaaactgaattgtacttgaacttagagagaattccctgggttgtaagaaagctgttgcaggtatcggagtccaccggtgttgcattaaaaagaagcagctggctgattgtgctgcttgtgctgttcgcaatttcattatcaccagttcaatcagcacccatcagtcatgggaagacaattgaaacataccaggccagggaggaatacacaagcatctgcctctttgtactaggaagtatcctgtttatagtctcttgtctaatgaaagggctggttgacagtattggcaacatcttcttccctgggctgtccatttgcaaaacgtgctctataggtagtatcaatggctttgaaattgagtctcataagtgctattgtagcttgctttgttgcccctattgtaggcattgttctgctgatagagaaattcatcagctgcacttgagcatctgcaaaaaaagaaaaacaggaagtaatgttatgcttgcagcctgcaagcgcatgtgcttcagagcaactatggaggtgagcaataaggccctacttatccgtagtatcatcaacaccacttttgttgtgtacatattgatactagcagtctgtgttgttagcacctcagcagttgagatggaaagcctaccagctgggacctgggaaagagaagaagacctaacaaatttctgtcatcaggaatgccaggttacggagactgagtgcctctgcccttatgaagccctagtactcagaaggcccttgttcctggacagtatagttagaggcatgaaaaatccgctaaactcaacaagtttagaaacaagcttatcgattgaggcaccatggggagcaataaatgttcagtcaacctacaaaccaactgtgtcaactgcaaacatagcacttagttggagctcagttgaacacagaggtaataagattttggtttcaggcagatcagaatcaattatgaagctggaagaaaggacaggaatcagctgggaccttggcgtagaagatgcctctgaatctaagctacttacagtctctgtcatggacttgtctcagatgtactctcctgtcttcgagtacttatcaggtgacagacaagtagaagagtggcccaaggcaacctgtacaggagactgcccagaaagatgtggctgcacaacatcaacctgcttgcataaagaatggccccattcaagaaactggagatgtaatcccacttggtgctggggggtggggactggctgcacttgttgtggattagatgtgaaagacctttttacagattatatgattgtcaagtggaaagttgaatacattaaaaccagaggcatagtgtgtgtggaactcaccagtcaggaaaggcagtgtagcttgattgaggcgggcacaaggttcaatttaggttctgtgaccatcacattgtcagaaccgaggaacattcaacaaaagctccctcctgaaataatcacattgcatcctaggattgaagaaggtttttttgacctgatgcatgtacaaaaagtgttgtcagctagcacagtgtgtaagttgcagagttgcacacacggtgtgccaggtgatctacaggtctaccatgtcggaaatttattaaaaggagataaggtgaatggacacctaattcataaaattgagccacacttaaacacttcctggatgtcctgggatggctgtgacctagactactactgcaacatgggagactggccttcttgtacatataccggagttacccaacacaatcatgcttcgtttgtaaacctgctcaacattgaaactgactatacaaaaagcttccactttcactctaaaagggttactgcacacggagacacaccacaattagatctgaaggcaagaccaacctacggcgcaggagaaatcactgtactggtagaagttgctgacatggagttcacaccgaagaagattgaaatatcgggcctaaaatttgcaagcctgacttgcacaggctgttatgcttgtagttctggcatttcctgcaaagttaggattcatgtggatgaaccagatgaacttacagtacatgttaagagtgatgatccagatgtagtagcagctagctcaagtctcatggcaaggaagcttgagtttggaacagacagtacatttaaagctttctcagctatgcccaaaacttccttatgtttctacattgtcgaaagggagtactgtaagagctgcagtaaagaagacacacaaaaatgtgttaacacaaaacttgagcaaccacagagcattttgatcgaacataagggaactataattggaaagcaaaacaatacctgcacagccaaagcaagttgctggttagagtcggttaaaagtttcttttatggtctaaagaacatgcttagtggcatttttggcaatttttttatgggcatcttcttatttcttgcccccttcatcttgttaatacttttctttatgtttggatggaggatcctgttttgctttaagtgttgcagaagaaccaggggcctgttcaagtatagacatctcaaagacgatgaagaaactggttacaggaggatcattgaaagactgaacaataagaaggggaagaacaagctgcttgatggtgaaagacttgccgatagaagaattgccgaactattctccacaaaaacacacattggc

SEQ ID NO: 3698 - RNA, 3495 nt, synthetic construct
  misc_feature 1..3495: note = derived and/or modified CDS sequence (wt) from CCHVF(CCHVF 79121)__AB069673.1__Gn-NSm-Gc
  source 1..3495: mol_type = other RNA
gcagaaggaggaagcagtgactgcatttcaagaactcagctagttaaaacggaggttgcagaaattcatgaggacagttacggtgggcctggtgagaaaataacaatctgcaatggttccacaattgtagatcaagggcttggtagtgaattgggctgttatacaatcaacagagtaagatcctacaagctatgcgagaacagtgcctcagggaaaagctgtgaaatagatagcatcccagtcaaatgcaaacaagggttttgcctcaaaataacccaagaaggaagaggtcatgtaaaactgtccagagggacagaaattgttctagatgtctgtgattccagctgtgagctgatgatacccaagggcactggagacattttagtggattgctcaggagggcaacagcattttttacaaaacaatctgattgacttgggatgccccaatgtcccattactgggtaaaatggccatatatgtctgcagaatgtcaaaccacccaaaaactaccatggcatttctgttctggttcagctttggctatgtcattacatgtatagcatgcagggtactcttctacttgctgattgccatcggaacagtagggaaaaagctaaaacagtatagagagctgaaaccacaaacatgcattgtctgtgaatctgtccctgttaatgcaatagatgctgaaatgcatgagcttaattgcagttacaatatatgcccatactgtgcatctagactgtctacagacgggctcatcaggcacgtaactcagtgtcccaaacggagggagaaggtggaagagactgagctattcttgaacttggaaagaataccttggctggtgagaaagctccttcaagtatcagagtcaacaggaatggctctaaagagaagctgttggatgatcacactcctcattctactattggtttcgatatcaccagtccaatctgcaccggtaggcaaagagagggcaatcgagacctatcaagcaagagaaacctacacaggcatatgcctctttgtgttaggaagtgttctctttgcggtatcctggctgacaaaggccttgattgatggcatcggcaacagcttctcccctggactttctgtctgcaagacatgctccattggtagtataaatggatttgaaatagagtctcataaatgctattgcagtctattctgttgtccttactgtagagcttgctcatccgacaaaaacactcaccggatgcacttaaatgtttgcaaaaaaaggaagatgggtagcaatgtcatgctggctgtctgtaaacgtatgtgctttagagcaaccattgaggcaagcaataaggctttactgatcaggagcatcataaattccacttttgtgatttgcatattaatcctaacaatctgtgtggtaagcacctccgcagttgatatggaaaatttgcctgcaggcatctgggagaaagaagaagatcttacaaacttctgtcaccaggagtgtcaagtgacagaaactgaatgcctctgcccgtatgaggccatggtactcaggaagccactcttcctggatagcacagccaagggaatgaaaagcctgttgaactccacgagcttagaaactagtctgtcaattgaagctccgtggggagcaatcaatgtccagtcaactttcaaaccaacagtttcagctgctaacatagcacttagctggagttcagttgaacacaggggcaacaaaattttagtttcaggtagatcagagtcaatcatgaaattagaagaaagaacaggagtcagctggaatctgggtgtagaagatgcttctgagtcaaagacgcttactgtttccgtcatggacctgtcacaaatgtactctcctgtttttgagtacttgtcaggtgacagacaagtggaggaatggccaaaggcaacttgcacaggtgactgtccagagagatgcggctgcacttcgtcaacctgcttacataaagagtggccacattcaagaaactggcgatgtaatcctacctggtgttggggggtggggactggctgcacttgctgtgggctggatgtaaaggatttttttactgactacatgctggtaaaatggaaagtggaatatataaagacagaagctatagtgtgtgtcgagctgactagtcaagagaggcagtgtagtttaattgaagcaggcacaagatttaacctaggccctgtaacaataaccctatcagagccaagaaatgtccagcagaggcttcctcccgaaattgtaacactgcatcctaaaatagaggaaggtttttttgatttgatgcatgtacaaaaaatactgtctgcaagcacagtttgcaagctacagagctgcacacacggtgtgccgggcgattttcagatctaccatgtcggtaacctgctgaggggagacaaggttaatggacactcaattcacaagatagaaccacattttaatacttcatggatgtcatgggatggttgcgatctggactatttctgcaatatgggggactggccttcatgcacatacactggagtgacacagcataaccgtgctgcatttatcaacatgctcaacattgagactgactatacaaaaactttccactttcattcgaagagggtcacggcacatggagatactccccagctagacctaaaagcgagaccggcatatggtgctggcgaggtcactgttctagtggaggttgcagacttggagttgcacacaaagaaccttgaagtgtcaggtttgaaaattgcaagtttgacctgctctgggtgttatgcctgcagctctggcatctcctgcaaagttagaatccatgtaaatgaaccagatgaatttacagtacatgtaagaagtagcgacccagatgttgtagcagcaggatcaagtcttatggcaaggaaaatagagtttggggctgacagtacattcaaggccttttcatcaatgcccaaggactccttatgcttttacatagtagaaaaggattactgcagcagctgcaccgacgatgacacacaaaagtgtgtcaacacgaagcttgaccatccacagagcatactcattgagcacaaaggaacaataattggcaagcaaaatgacacttgttcgaccaagacaagctgctggctagaatcagttaagggttttttctatgggctaaaaaacatgctaagtggcatctttggaaatgtttttttaggcatcttcttattccttgctccttttgtgctactgatattttttttcttttttgggtggaggcttctgttttgtctcaaatgttgcagaagaactagaggactgttgaaatacaagcaccttaaggatgaagaggaggctggatacaaaaaaatcattgaaaggctaaatggcaaaaaaggtaaaagtcaattgtttgatggtgaaaggcttgcagacaggaagattgctgagcttttttctactaaaattcacataggt

SEQ ID NO: 3699 - RNA, 3495 nt, synthetic construct
  misc_feature 1..3495: note = derived and/or modified CDS sequence (wt) from CCHVF(CCHVF 8402)__AB069674.1__Gn-NSm-Gc
  source 1..3495: mol_type = other RNA
tccgaagagtctggtgatgactgcatatcaagaactcagctattgaggacagagactgcggaaattcacaatgataactatggtggtccaggtgacaagataaccatctgcaatggttcaactgttgtggatcagagattgggcagtgaactggggtgttacactatcaatagagtaaagtcatttaagctttgcgagaacagtgccacaggcaaatcctgtgaaatagatagcaccccagtcaaatgcaggcagggtttctgtttgaaaattactcaggagggaaggggccacgtgaagctatcgagaggttcagaagttgtcctggacgcctgcgattcaagctgtgaaataatgataccaaagggcaccggagacatcctagttgactgttcaggtggacagcaacatttcttaaaagataacttgattgatctaggatgcccaaacatcccactattaggcaagatggctatctacatttgtagaatgtcaaatcatcctaaaacgactatggcttttcttttttggtttagctttggttatgtggtgacctgtatactctgtaaggtcatcttctatctattaatagttgtggggacgttggggaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagatggtcttgccagacatgtaatgcagtgccctaagcggaaggaaaaaatagaagaaaccgaattatacttaaacttggaaagaatcccctgggttgttaggaaattactgcaggtgtcagaatccaccggtgtggcactaaagaggagtagttggctggttgtgctacttgtgttacttacagtttcattgtcaccagtacaatcagcacctatcggccatggaaagacagttgaaacatatcaaaccagagaaggatacacaagtatttgcctctttgtactaggaagcatcttatttatagtctcttgcctaatgaaggggttggttgacagtgttggtaacagttttttccctggtttgtccatttgtaagacatgttctattggcagtgtaaatggctttgagattgaatctcacaaatgttactgtagcctattttgttgtccctactgtagacactgctctgccgatagagaaatacataggttgcacttgagcatctgcaagaaaaggaagactgggagtaatgtcatgctggccgtctgtaagcgcatgtgctttagggcaactgtggaagtaagcaacaaggctctactcatccgaaacatcatcaacaccacttttgttctgtgcatactgatattagcagtttgtgttgtcagcacctccgcagtggagatggaaagcctgccagctggcacttgggagagagaggaagatctgacaaatttctgtcatcaagaatgccaagtcactgagactgaatgcctctgtccctacgaagctcttgtgctcaggaaacccttgttttcagacagcattgtcaaaggcatgaagaacttgctaaattcaacaagcttagaaacaagcttatcaattgaggcaccatggggagcaataaatgtccaatcaaccttcaaacctactgtgtcagctgcgaatatagctcttagttggagctcagtggaacacaggggtaataagattttggtttcaggtagatcagagtcaatcatgaagctagaggaaaggacaggaatcagctgggatctaggggtagaagatgcttctgagtctaaattgcttactgtctctgttatggacttgtcacagatgtactctcctgtctttgagtacctatcaggtgacagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttatcaagtggaaagttgagtacattaaaacagaagctatagtgtgtgttgagcttactagccaagagagacaatgtaccttgattgaggcaggcacaagattcaacttaggtcctgtgaccatcacattgtcagagccaagaaacattcagcaaaagctccctccagagatagttacattgcaccccagaattgaagaaggtttctttgatttaatgcatgtacaaaaggtgctatcagcaagtacagtgtgtaagctacagagttgcacacatggtgtgccaggggacctacaggtctatcacataggaaacttgttaaaaggagacaaggtgaatgggcacctgattcacaaaattgaaccacacttcaacacttcctggatgtcttgggacggctgtgacctagactactactgtaatatgggggattggccatcttgcacatatactggagtaacccagcacaatcatgctgcatttgtaaacatgctcaacatcgaaactgattatacaaaaaacttccactttcactctaagagagttactgcacatggagacacaccacaattagatttgaaagctagaccaacttatggtgcaggtgaaatcactgtgctggtggaagttgctgacatggagttacacacaaagaaaattgagatatcaggtttgaagtttgcaagcttaacttgcacaggctgttatgcttgtagctctggtatctcctgtaaggttagaatccatgtagatgagccagatgagcttacagtacatgtgaagagtgaagacccagacatagttgctgctagctcaagtctcatggctagaaaacttgaatttgggacagatagtacattcaaagccttttcagccatgcccaaaacctccttatgcttttacattgtggagagagaatattgtaaaagctgcagcaaagaagatacacaaaaatgtgtcaacacaaagcttgagcaaccacagagcattttaatcgagcacaaaggaacgataattggtaagcagagcaacacctgcacagctaaagcaagctgttggctagagtcagtcaagagcttcttttatgggctaaagaacatgcttagtggcatttttggcaatgttttcataggggttttcttattctttgctccttttatccttttgatacttttctttatgtttggatggagaatcctgttctgctttaaatgttgcagaagaactagaggcctttttaagtacagacacctcaaggacgatgaagaaaccggttacaggaaaatcattgagagactgaacaacaaaaaagggaaaaacaaactgcttgatggtgaaagattagctgataggaagattgctgagctgttctccacaaagacacacattggc

SEQ ID NO: 3700 - RNA, 3495 nt, synthetic construct
  misc_feature 1..3495: note = derived and/or modified CDS sequence (wt) from CCHVF(CCHVF 88166)__AB069675.1__Gn-NSm-Gc
  source 1..3495: mol_type = other RNA
tccgaagagtctggtgatgactgcatatcaagaactcagctattgaggacagagactgcggaaattcacagtgataactatggtggtccaggtgacaagataaccatctgcaatggttcaactgttgtggatcagagattgggcagtgaactagggtgttacactatcaatagagtaaagtcatttaagctttgcgagaacagtgccacaggcaaatcctgtgaaatagatagcaccccagtcaaatgcaggcagggtttctgtttgaaaattactcaggagggaaggggccacgtgaagctatcgagaggttcagaagttgtcctggacgcctgcgattcaagctgtgaaataatgataccaaagggcactggagacatcctagttgactgttcaggtggacagcaacatttcttaaaagataacttgattgatctaggatgcccaaacatcccactattaggcaagatggctatctacatttgtagaatgtcaaatcatcctaaaacgactatgggttttcttttttggtttagctttggttatgtggtgacctgtatactctgtaaggtcatcttctatctattaatagttgtggggacgttggggaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagatggccttgccagacatgtaatgcagtgccctaagcggaaggaaaaaatagaagaaaccgaattatacttaaacttggaaagaatcccctgggttgttaggaaattactgcaggtgtcagaatccaccggtgtggcactaaagaggagtagttggctggttgtgctacttgtgttacttacagtttcattgtcaccagtacaatcagcacctatcggccatggaaagacagttgaaacatatcaaaccagagaaggatacacaagtatttgcctctttgtactaggaagcatcttatttatagtctcttgcctaatgaaggggttggttgacagtgttggtaacagtttttttcctggtttgtccatttgtaagacatgttctattggcagtgtaaatggctttgagattgaatctcacaaatgttactgtagcctattttgttgtccctactgtagacactgctctgccgatagagaaatacataggttgcacttgagcatctgcaagaaaaggaagacttggagtaatgtcatgctggccgtctgtaagcgcatgtgctttagggcaactgtggaagtaagcaacaaggctctacttatccgaaacatcatcaacaccacttttgttctgtgcatactgatattagcagtttgtgttgtcagcacctccgcagtggagatggaaagcctgccagctggcacttgggagagagaagaagatctgacaaatttctgtcatcaagaatgccaagtcactgagactgaatgcctctgtccctacgaagctcttgtgctcaggaaacccttgttttcagacagcattgtcaaaggcatgaagaacttgctaaattcaacaagcttagaaacaagcttatcaattgaggcaccatggggagcaataaatgtccaatcaaccttcaaacctaccatgtcagctgcgaatatagctcttagttggagctcagtggaacacaggggtaataagattttggtttcaggtagatcagagtcaatcatgaagctagaggaaaggacaggaatcagctggaatctaggggtagaagatgcttctgagtctaaattgcttactgtctctgttatggacttgtcacagatgtactctcctgtctttgagtacctatcaggtgacagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttatcaagtggaaagttgagtacattaaaacagaagctatagtgtgtgttgagcttactagccaagagagacaatgtaccttgattgaggcaggcacaagattcaacttaggtcctgtgaccatcacattgtcagagccaagaaacattcagcaaaagctccctccagagatagttacattgcaccccagaattgaagaaggtttctttgatttaatgcatgtacaaaaggtgctatcagcaagtacagtgtgtaagctacagagttgcacacatggtgtgccaggggacctacaggtctatcacataggaaacttgttaaaaggagacaaggtgaatgggcacctgattcacaaaattgaaccacacttcaacacttcctggatgtcttgggacggctgtgacctagactactactgtaatatgggggattggccatcttgcacatatactggagtaacccagcacaatcatgctgcatttgtaaacatgctcaacatcgaaactgattatacaaaaaacttccactttcactctaagagagttactgcacatggagacacaccacaattagatttgaaagctagaccaacttatggtgcaggtgaaatcactgtgctggtggaagttgctgacatggagttacacacaaagaaaattgagatatcaggtttgaagtttgcaagcttaacttgcacaggctgttatgcttgtagctctggtatctcctgtaaggttagaatccatgtagatgagccagatgagcttacagtacatgtgaagagtgaagacccagacttagttgctgctagctcaagtctcatggctagaaaacttgaatttgggacagatagtacattcaaagccttttcagccatgcccaaaacctccttatgcttttacattgtggagagagaatattgtaaaagctgcagcaaagaagatacacaaaaatgtgtcaacacaaagcttgagcaaccacagagcattttaatcgagcacaaaggaacgataattggtaagcagaacaacacatgcacagctaaagcaagctgttggctagagtcagtcaagagcttcttttatgggctaaagaacatgcttagtggcatttttggcaatgttttcataggggttttcttattctttgctccttttatccttttgatacttttctttatgtttggatggagaatcctgttctgctttaaatgttgcagaagaactagaggcctttttaagtacagacacctcaaggacgatgaagaaaccggttacaggaaaatcattgagagactgaacaacaaaaaagggaaaaacaaactgcttgatggtgaaagattagctgataggaagattgctgagctgttctccacaaagacacacattggc

SEQ ID NO: 3701 - RNA, 3495 nt, synthetic construct
  misc_feature 1..3495: note = derived and/or modified CDS sequence (wt) from CCHVF(CCHVF BA88166)__AF338470.1__Gn-NSm-Gc
  source 1..3495: mol_type = other RNA
tccgaagagtctggtgatgactgcatatcaagaactcagctattgaggacagagactgcggaaattcacagtgataactatggtggtccaggtgacaagataaccatctgcaatggttcaactgttgtggatcagagattgggcagtgaactagggtgttacactatcaatagagtaaagtcatttaagctttgcgagaacagtgccacaggcaaatcctgtgaaatagatagcaccccagtcaaatgcaggcagggtttctgtttgaaaattactcaggagggaaggggccacgtgaagctatcgagaggttcagaagttgtcctggacgcctgcgattcaagctgtgaaataatgataccaaagggcactggagacatcctagttgactgttcaggtggacagcaacatttcttaaaagataacttgattgatctaggatgcccaaacatcccactattaggcaagatggctatctacatttgtagaatgtcaaatcatcctaaaacgactatgggttttcttttttggtttagctttggttatgtggtgacctgtatactctgtaagggcatcttctatctattaatagttgtggggacgttggggaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagatggccttgccagacatgtaatgcagtgccctaagcggaaggaaaaaatagaagaaaccgaattatacttaaacttggaaagaatcccctgggttgttaggaaattactgcaggtgtcagaatccaccggtgtggcactaaagaggagtagttggctggttgtgctacttgtgttacttacagtttcattgtcaccagtacaatcagcacctatcggccatggaaagacagttgaaacatatcaaaccagagaaggatacacaagtatttgcctctttgtactaggaagcatcttatttatagtctcttgcctaatgaaggggttggttgacagtgttggtaacagtttttttcctggtttgtccatttgtaagacatgttctattggcagtgtaaatggctttgagattgaatctcacaaatgttactgtagcctattttgttgtccctactgtagacactgctctgccgatagagaaatacataggttgcacttgagcatctgcaagaaaaggaagacttggagtaatgtcatgctggccgtctgtaagcgcatgtgctttagggcaactgtggaagtaagcaacaaggctctacttatccgaaacatcatcaacaccacttttgttctgtgcatactgatattagcagtttgtgttgtcagcacctccgcagtggagatggaaagcctgccagctggcacttgggagagagaggaagatctgacaaatttctgtcatcaagaatgccaagtcactgagactgaatgcctctgtccctacgaagctcttgtgctcaggaaacccttgtatttagacagcattgtcaaaggcatgaagaacttgctaaattcaacaagcttagaaacaagcttatcaattgaggcaccatggggagcaataaatgtccaatcaaccttcaaacctaccatgtcagctgcgaatatagctcttagttggagctcagtggaacacaggggtaataagattttggtttcaggtagatcagagtcaatcatgaagctagaggaaaggacaggaatcagctggaatctaggggtagaagatgcttctgagtctaaattgcttactgtctctgttatggacttgtcacagatgtactctcctgtctttgagtacctatcaggtgacagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttatcaagtggaaagttgagtacattaaaacagaagctatagtgtgtgttgagcttactagccaagagagacaatgtaccttgattgaggcaggcacaagattcaacttaggtcctgtgatcatcacattgtcagagccaagaaacattcagcaaaagctccctccagagatagttacattgcaccccagaattgaagaaggtttctttgatttaatgcatgtacaaaaggtgctatcagcaagtacagtgtgtaagctacagagttgcacacatggtgtgccaggggacctacaggtctatcacataggaaacttgttaaaaggagacaaggtgaatgggcacctgattcacaaaattgaaccacacttcaacacttcctggatgtcttgggacggctgtgacctagactactactgtaatatgggggattggccatcttgcacatatactggagtaacccagcacaatcatgctgcatttgtaaacatgctcaacatcgaaactgattatacaaaaaacttccactttcactctaagagagttactgcacatggagacacaccacaattagatttgaaagctagaccaacttatggtgcaggtgaaatcactgtgctggtggaagttgctgacatggagttacacacaaagaaaattgagatatcaggtttgaagtttgcaagcttaacttgcacaggctgttatgcttgtagctctggtatctcctgtaaggttagaatccatgtagatgagccagatgagcttacagtacatgtgaagagtgaagacccagacatagttgctgctagctcaagtctcatggctagaaaacttgaatttgggacagatagtacattcaaagccttttcagccatgcccaaaacctccttatgcttttacattgtggagagagaatattgtaaaagctgcagcaaagaagatacacaaaaatgtgtcaacacaaagcttgagcaaccacagagcattttaatcgagcacaaaggaacgataattggtaagcagaacaacacatgcacagctaaagcaagctgttggctagagtcagtcaagagcttcttttatgggctaaagaacatgcttagtggcatttttggcaatgttttcataggggttttcttattctttgctccttttatccttttgatacttttctttatgtttggatggagaatcctgttctgctttaaatgttgcagaagaactagaggcctttttaagtacagacacctcaaggacgatgaagaaaccggttacaggaaaatcattgagagactgaacaacaaaaaagggaaaaacaaactgcttgatggtgaaagattagctgataggaagattgctgagctgttctccacaaagacacacattggc

SEQ ID NO: 3702 - RNA, 3495 nt, synthetic construct
  misc_feature 1..3495: note = derived and/or modified CDS sequence (wt) from CCHVF(CCHVF BA66019)__AF350448.1__Gn-NSm-Gc
  source 1..3495: mol_type = other RNA
tccgaagagtctggtgacgactgcatatctagaactcagctattgaggacagagactgcagaggtccatggtgacaactatggtggtccaggtgacaaaataactatctgtaatggttcaaccattgtggatcaaagacttggcagtgaactggggtgttatactatcaatagagtgaagtcattcaagctatgcgaaaatagtggcacgggaaaatcctgtaagatagataaacacccagttaagtgcaggcagggtttttgcttaaaaattactcaggaaggaaggggccatgtgaagctatcgagaggctcagaagttgtcttagatgcctgcgactcaagctgtgaaataatgataccgaagggcacaggagacatcctagtagactgttcaggtgggcaacaacatttcttaaaagataacttggttgatctaggatgccctaacattccactattaggtaaaatggctatctacatttgcaggatgtcaaatcaccctaaaacaactatggcttttctcttttggtttagtttcggctatgtaataacatgtatattttgtaaaatcattttttacttgttgatagtcgtggggacattggggaaaaagttcaaacagtaccgggagctgaaacctcagacttgtactatatgtgaaacaactcctaccaatgcaatagatgctgaaatgcacgatcttaaatgcagttacaatatatgcccttattgtgcatctagattaacctcggacgggcttgccaggcatgtgacacaatgccctaagcgaaaagagaaagtagaagagactgaactgtacttgaacttggaaagaattccttggattgtcagaaaactactgcaagtgtcagagtctaccggtgtggcactgaaaaggagcagttggctgattgtgttacttgtgctacttacagtttcattgtcaccggttcaatcagcacccattggacatggaaagacaattgaggcatatcagaccagagaggggtacacaagtgtttgcctgtttatgctgggaggcatcttgtttgtggtctcctgcctgatgaaagggctagttgacagtgtcagcaacagctttttccctgggttatctatttgcaaaacctgttctatcggcagtgtaaatggctttgaaattgaatcccataaatgttactgtagcttactttgttgcctttattgtagacattgctctgctgatagggaaatccaccaattgcacttgagcatctgcaaaaaaagaagggcaggaggcaatgtcatgctggctgtctgcaagcgcatgtgcctcagagccactatggaggtaagcaataaggtcctattcatccgaagtattatcaacaccacttttgttatatgcatactggtattggcagtctgtatcgttagcacctccgcagtagagatggaaagcctaccagccggcacttgggaaagggaggaagacctgactaacttctgccaccaggaatgccaagtcacagagactgaatgtctctgtccttacgaggctcttgtactcaggaaacccctattctcagacagtatagtcaagggcatgaaaaacctgctaaattcaactagcttggaaacaagcttatcaattgaagcaccatggggagcaataaacgtccagtcaacctttaaacccaccgtttcaactgcaaacatagcacttagctggagttcagtagaacacagaggtaacaaaattttggtctcaggcagatcagaatcaattatgaagctagaagaaaggacaggaatcagctgggatctgggcgtagaagatgcctctgaatctaagttgcttactgtttctgtcatggatttgtcacagatgtattctcctgtctttgagtacttatcaggtgacagacaggtagaggagtggcccaaagcaacctgcacaggtgattgcccagataggtgtggctgcacatcatcaacctgtttacacaaagaatggccccattcaagaaattggagatgcaaccccacttggtgttggggagtcggcactggatgcacctgctgtggactagatgtgaaagatctttttacagattatatgtttgtcaagtggaaagttgaatacataaagaccgaggccatagtgtgcgttgagctcaatagccaagaaaggcagtgcagcttgattgaggcaggcacaagattcaacttgggtcctgtgaccatcacgttgtcagaaccaagaaacattcagcagaagcttcctcctgaaataatcacattgcatcctagaattgaggaaggtttcttcgatctgatgcatgttcaaaaggtgctgtctgcaagtacagtatgcaagctacaaagctgcacacatggtgtgccaggagacttacagatctaccacattggcaacttgttaaaaggggatagggtaaatgggcatctgattcacaaaattgagccacacttcaacacttcttggatgtcctgggatggctgtgacctagattactactgtaacatgggggattggccctcttgcacatatactggagtgacccaacataaccatgctgcttttgtaaacttacttaacatcgaaactgattacacaaagaacttccattttcattctaaaagggttactgcccatggagacaccccacaactggatcttaaagctagaccaacttacggtgcgggtgaaatcactgttctggtggaggttgctgacatggagttacacacaaaaaagattgcgatatcaggtctgaaatttgcaagtttgacttgcacaggttgctatgcttgtagctctggcatctcctgtaaagtcaggattcatgtggatgaaccagatgagcttacagtacatgtgaaaagtgaagatccggacattgttgcagccagctcaagcctcatggcaaggaagcttgaatttgggacagacagcacattcaaggccttctcagccatgcccaaaacctccttgtgcttctacattgtagagagagaatactgtgagagctgcagcaaagaagacacacagaaatgtgttaacacaaagcttgagcaaccacaaagcattttaattgagcacaaaggaacgataatcggaaagcaaaatgacacttgcacagccaaagcaagctgctggttagagtcagtaaagagttttttttatggattgaagaacatgcttagcggcatcttcggcaacgtttttataggcattttcttattccttgctccttttattctgttaatactcttctttatgtttgggtggagaatcctgttttgctttaagtgttgcagaaggaccagaggcttattcaagtacagatatctcaaggacgacgaagagtctggttacagaagaatcattgaaagattaaacaacaaaaaaggaaaaaacaagttacttgacggtgaaagactagctgacaggaggatcgctgagttgttctctaccaaaacacacattggt

SEQ ID NO: 3703 - RNA, 3495 nt, synthetic construct
  misc_feature 1..3495: note = derived and/or modified CDS sequence (wt) from CCHVF(CCHVF BA8402)__AF350449.1__Gn-NSm-Gc
  source 1..3495: mol_type = other RNA
tccgaagagtctggtgatgactgcatatcaagaactcagctattgaggacagagactgcggaaattcacaatgataactatggtggtccaggtgacaagataaccatctgcaatggttcaactgttgtggatcagagattgggcagtgaactggggtgttacactatcaatagagtaaactcttttaacctttgcgaaaacactgccacgggcaaatcctgtgaaatagatagcaccccagtcaaatgcaggcagggtttctgtttgaaaattactcaggagggaaggggccacgtgaagctatcgagaggttcagaagttgtcctggacgcctgcgaatcaagctgtgaaataatgataccaaagggcaccggagacatcctagttgactgttcaggtggacagcaacatttcttaaaagataacttgattgatctaggatgcccaaacatcccactattaggcaagatggctatctacatttgtagaatgtcaaatcatcctaaaacgactatggcttttcttttttggtttagctttggttatgtggtgacctgtatactctgtaaggtcatcttctatctattaatagttgtggggacgttggggaaaaagttcaaacagtatagagagttgaaacctcagacctgtaccatatgcgaaacaactcctgttaatgcaatagatgctgaaatgcacgacctcaattgcagttacaatatatgtccatactgtgcatctaggccaacctcagatggtcttgccagacatgttatgcagtgccctaagcggaaggaaaaaattgaagaaaccgcattatacttaaacttggaaagaatcccctgggttgttaggaaattactgcaggtgtcagaatccaccggtgtggcactaaagaggagtagttggctggttgtgctacttgtgctacttacagtttcattgtcaccagtacaatcagcacctatcggccatggaaagacagttgaaacatatcaaaccagagaaggatacacaagtatttgcctctttgtactaggaagcatcttatttatagtctcttgcctaatgaaggggttggttgacagtgttggtaacagttttttccctggtttgtccatttgtaagacatgttctattggcagtgtaaatggctttgagattgaatctcacaaatgttactgtagcctattttgttgtccctactgtagacactgctctgccgatagagaaatacataggttgcacttgagcatctgcaagaaaaggaagactgggagtaatgtcatgctggccgtctgtaagcgcatgtgctttagggcaactgtggaagtaagcaacaaggctctactcatccgaaacatcatcaacaccacttttgttctgtgcatactgatattagcagtttgtgttgtcagcacctccgcagtggagatggaaagcctgccagctggcacttgggagagagaggaagatctgacaaatttctgtcatcaagaatgccaagtcactgagactgaatgcctctgtccctacgaagctcttgtgctcaggaaacccttgttttcagacagcattgtcaaaggcatgaagaacttgctaaattcaacaagcttagaaacaagcttatcaattgaggcaccatggggagcaataaatgtccaatcaaccttcaaacctactgtgtcagctgcgaatatagctcttagttggagctcagtggaacacaggggtaataagattttggtttcaggtagatcagaatcaatcatgaagctagaagaaaggacaggaatcagctgggatctaggggtagaagatgcttctgaatctaaattgcttactgtctctgttatggacttgtcacagatgtactctcctgtctttgagtacctatcaggtgacagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttatcaagtggaaagttgagtacattaaaacagaagctatagtgtgtgttgagcttactagccaagagagacaatgtaccttgattgaggcaggcacaagattcaacttaggtcctgtgaccatcacattgtcagagccaagaaacattcagcaaaagctccctccagagatagttacattgcaccccagaattgaagaaggtttctttgatttaatgcatgtacaaaaggtgctatcagcaagtacagtgtgtaagctacagagttgcacacatggtgtgccaggggacctacaggtctatcacataggaaacttgttaaaaggagacaaggtgaatgggcacctgattcacaaaattgaaccacacttcaacacttcctggatgtcttgggacggctgtgacctacactactactgtaatatgggggattggccatcttgcacatatactggagtcacccagcacaatcatgctgcatttgtaaacatgctcaacatcgaaactgattatacaaaaaacttccactttcactctaagagagttactgcacatggagacacaccacaattagatttgaaagctagaccaacttatggtgcaggtgaaatcactgtgctggtggaagttgctgacatggagttacacacaaagaaaattgagatatcaggtttgaagtttgcaagcttaacttgcacaggctgttatgcttgtagctctggtatctcctgtaaggttagaatccatgtagatgagccagatgagcttacagtacatgtgaagagtgaagaccccgacatagttgctgctagctcaagtctcatggctaggaagcttgaatttgggacagatagtacattcaaagccttttcagccatgcccaaaacctccttatgcttctacattgtggagagagaatattgtgaaagctgcagcaaagaagatacacaaaaatgtgttaacacaaagcttgagcaaccacagagcattttaatcgagcacaaaggcacgataattggtaagcagagcaacacctgcacagctaaagcaagctgttggctagagtcagtcaagagcttcttttatgggctaaagaacatgcttagtggcatttttggcaatgttttcataggggttttcttattctttgctccttttatccttttgatacttttctttatgtttggatggagaatcctgttctgctttaaatgttgcagaagaactagaggcctttttaagtacagacacctcaaggacgatgaagaaaccggttacaggaaaatcattgagagactgaacaacaaaaaagggaaaaacaaactgcttgatggtgaaagattagctgataggaagattgctgagctgttctccacaaagacacacattggc

SEQ ID NO: 3704 - RNA, 3495 nt, synthetic construct
  misc_feature 1..3495: note = derived and/or modified CDS sequence (wt) from CCHVF(CCHVF Matin)__AF467769.2__Gn-NSm-Gc
  source 1..3495: mol_type = other RNA
tccgaagagtctggtgatgactgtatatcaagaactcagctattgaggacagagactgcggaaattcacagtgatagctatggtggaccaggtgataagataaccatctgcaatggttcaactgttgtagatcagaggttgggcagtgaactagggtgttacactataaatagagtaaagtcatttaagctttgcgagaacagtgccacaggtaaatcctgtgaaatagatagcaccccagttaaatgcaggcagggtttttgcttaaaaattactcaggagggaaggggccacgtgaagctgtcgagaggttcagaagttgtcttggatgcctgtgactcaagctgtgaaataatgataccaaagggcactggagacatcctagttgactgttcaggtgggcagcaacatttcttaaaagataacctgattgatctgggatgccccaacattccactattaggcaaaatggccatctacatttgtagaatgtcaaatcatcccaaaacaactatggtttttcttttttggtttagctttggttatgtaataacctgtatactctgtaaggtcatcttctatctattaatagttgtagggacattagggaaaaagttcaaacagtatagagagttgaaacctcagacctgtaccatatgcgaaacaactcctgttaatgcaatagatgctgaaatgcacgaccttaactgcagttacaatatatgtccttactgtgcatccaggttgacatcagatggtcttgccagacatgtaatgcagtgccccaaacggaaggaaaaaatagaagaaaccgaattatacttaaacttagaaaggatcccttgggttgttaggaaattactgcaggtgtcagaatctaccggtgtggcactaaagaggagtagctggctggttgtgctacttgtgttacttacagtttcactatcaccagtacaatcagcacctatcggccatggaaagacagttgaaacatatcagatcagagaagggtacacaagtgtttgcctttttgtactagggagcatcttgtttatagtctcttgcctaatgaaagggctggttgacagtgacggtaacagttttttccctggtttgtccatttgcaagacatgttctattggcagtataaatggctttgaaattgaatctcacaaatgttactgtagcctattttgttgcccctactgtagacactgctctacagatagagaaatacataaattgcacttgagcatctgcaagaaaaggaaaactggaagtaatgtcatgttggccgtctgtaagcgcatgtgctttagggcaactgtagaagtaagcaacaaggctctactaatccgaagcatcatcaacaccacttttgttgtgtgtatactgatattagcagtttgtgttgtcagtacctccgcagtggagatggaaagcctgccagctggcacttgggagagagaagaagacctgataaatttctgtcatcaggaatgccaagtcactgagactgaatgtctctgtccttacgaagctcttgtgctcagaaaacccttgtttttagacagtattattaagggtatgaagaacttgctaaattcaacaagcttagaaacaagcttatcaattgaggcaccatggggagcaataaatgtccaatcaactttcaaacctactatgtcagctgcgaacatagcgctaagttggagctcagtggaacacagaggtaataagattttggtttcaggcagatcagagtcgatcatgaagctagaggaaaggacaggaatcagctgggatctaggagtagaagatgcctctgagtctaaattgcttactgtatctgttatggacttatcacagatgtattctcctgtctttgagtacttatcaggtgatagacaagtggaggaatggcccaaggcaacctgcacaggcgattgtccagaaagatgtggctgcacatcatcaacctgcctacacaaagaatggccccattcaagaaactggagatgcaatcctacttggtgttggggagtcggcactggatgtacctgctgtgggctagacgtaaaagacctttttactgattacatgtttgtcaagtggaaagttgaatacattaaaacggaagttatagtgtgtgttgagcttactagccaagaaagacaatgtagcttgattgaggcaggcacaagattcaacttaggtcctgtgaccattacattgtcagagccaagaaacattcagcaaaagctccctccagagatagtcacattgcatcccagaattgaagaaggtttctttgatttaatgcatgtacaaaaagtgctatcagcaagtacagtgtgcaagctacagagttgcacacatggtgtgccaggggacctacaggtctaccacataggaaacttgttaaaaggagataaggtgaacgggcacttgattcacaaaattgaaccacacttcaacacttcctggatgtcttgggacggctgtgacctagactactactgtaatatgggggattggccatcttgctcatatactggagtaacccaacacaatcatgctgcatttgtaaacatgctcagcatcgaaactgattatacaaaaaacttccactttcactctaagagagttactgcacatggagacacaccacaattagatctgaaagctaggccaacttacggtgcaggtgaaatcactgtgctggtagaggttgctgacatggaattacatacaaagaaaattgagatatcaggtttgaagtttgcaagcttaacttgcacaggatgttatgcttgtagctctggtatctcctgtaaggttagaatccatgtagatgaaccagatgagcttacagtacatgtgaagagtgaagacccagacatagttgctgctagctcaagtctcatggctagaaagcttgaatttgggacagatagtacattcaaagccttttcagccatgcccaaaacctccttatgcttttacattgtggagagagaatattgtaaaagttgcagtaaagaagacacacaaaaatgtgtcaacacaaagcttgagcaaccacagagcatcttaatcgagcataaagggacgataattggaaagcaaaacgacacctgtacagccaaagcaagctgctggctggagtcagtcaaaagttttttttatggactaaagaacatgcttagtggcatttttggcaatgttttcatagggattttcttattccttgctccttttgcccttttaatacttttctttatgtttggatggagaatcctgttctgctttaaatgttgcagaagaactagaggcctatttaaatacagacacctcaaggacgacgaagaaaccggttacaggaaaatcattgagaggctgaacaacaaaaaaggtaaaaacaaactgctcgacggtgaaagactagctgacaggaagatcgctgagctgttctccacaaaaacacacgttggc

SEQ ID NO: 3705 - RNA, 3495 nt, synthetic construct
  misc_feature 1..3495: note = derived and/or modified CDS sequence (wt) from CCHVF(CCHVF Baghdad 12)__AJ538197.2__Gn-NSm-Gc
  source 1..3495: mol_type = other RNA
tctgaagaatctggtgatgactgcatatcaagaactcggctattgagaacagagactgcagagatccatggtgacagctatggtggtccgggtgacaaaattactatttgcaacggttcaactattgtagatcaaagactgggaagtgagatggggtgttacactatcaatagagtgaagtcattcaagctgtgcgaaaacagtgcaacaggaaagagctgtaaaatagacagtatcccagttaagtgcagacagggttattgcctaaaaatcactcaggaaggaaggggccatgtgaaattatccaggggctcagaggttgtcttggatgcatgcgactcaagctgtgaagtaatgatacctaaaggcacaggtgacatcttagtagactgttcaggtgggcagcaacattttttgaaggataacttgattgatctaggatgccccaacattccattattaggtaaaatggctatttatatttgcagaatgtcaaatcaccctaagacaaccatggctttcctcttttggttcagttttggttatgtgataacctgtatactctgcaaggccatcttctacttattaataattgttgggacactagggaaaaggtttaagcagtacagagagttaaaaccccagacctgtactatatgtgagacaactcctgtaaatgcaatagatgctgaaatgcatgaccttaactgcagttacaatatatgtccctattgtgcatctagattaacctcagatgggcttgctaggcatgtgacacaatgccctaagcggaaggagaaagtggaagaaactgaattgtacttgaacttagagaggattccctgggttgtaagaaagctgttgcaggtatcagagtccacaggtgttgcattaaagagaagcagctggctgattgtgctgcttgtgctacttgcagtttcatcatcaccagttcaatcagcacccatcggttatgggaagacaattgagacataccaggccagggagggatacacaagtatttgcctctttgtactaggaagtatcctgtttatagtctcttgtctaacaaaagggctggttgacagtattggcaacatcttcttccctgggctgtccatttgcaaaacgtgctctataggtagtatcaatggctttgaagttgagtctcataagtgctattgtagcttgctttgttgtccctactgtaggcattgctctgctgatagagaaatccatcagctgcacttgagcatctgcaaaaaaagaaaaacaggaagtagtgtcatgcttgcagtctgcaagcgcatgtgcttcagagcaactatggaagtgagcaataaggccctacttatccgtagcattatcaacaccacttttgttgtctgcatattgacactagcagtctgtgttgttagcacctcagcagtagagatggaaagcctaccagctgggacctgggaaagagaagaagacctaacaaatttctgtcatcaagaatgccaggtcacggagactgagtgcctctgcccttatgaagccctagtactcagaaagcccttgttcctggatagtatagtcaaaggcacgaaaaatctgctaaactcaacaagtttagaaacaagcttatcgattgaggcaccatggggagcaataaatgttcagtcaacctataaaccaactgtgtcaactgcaaacatagcacttagttggagttcagttgaacacagaggtaacaagattttggtttcaggcagatcagaatcaattatgaagctagaagagagaacaggaatcagttgggatcttggcgtagaagatgcctctgaatctaagctacttacagtctctgtcatggacttgtctcagatgtactctcctgtctttgagtacttatcaggtgacagacaagtagaagaatggcccaaggcaacctgtacaggtgactgcccagaaagatgtggctgcacaacatcaacctgcttgcataaagaatggccccattcaagaaactggagatgtaatcccacttggtgctggggagtgggaactggctgcacttgttgcggattagatgtgaaggacctttttacagattatatgttcgtcaaatggaaagttgaatacattaaaacagatgccatagtgtgtgtggaactcactagtcaagaaaggcaatgcagcttgattgaggcaggtacaaggtttaacttaggttctgtgaccatcacattgtcagaaccgaggaacattcagcaaaagctccctcctgaaataatcacattacatcctaggattgaagaaggtttttttgacctgatgcatgtacaaaaagtgttgtcagctagcacagtgtgtaagttgcagagttgcacacacggtgtgccaggtgatctacaggtctaccacatcggaaatttattaaaaggggataaagtgaatggacacctaattcataaaattgagccacattttaacacttcttggatgtcctgggatggctgtgacttagactactattgcaatatgggagactggccttcttgcacatataccggagttacccaacacaatcatgcttcatttgtaaacctgctcaacattgaaactgattacacaaaaagcttccactttcactctaaaagggttactgcacatggagatacaccacagttagatctgaaggtaagaccaacctacggcgcaggagaaatcactgtactggtagaagttgctgacatggagttgcacacgaagaagattgaaatatcaggcctaaaatttgcaagcctgacttgcacaggctgttatgcttgtagctctggcatttcctgcaaagttaggatacatgtggatgaaccggatgaactcacagtacacgtcaaaagtgatgatccagatgtagtagcagctagctcaagtctcatggcaaggaagcttgagtttggaacagacagcacatttaaagctttctccgccatgccaaaaacttccttatgtttctacattgtcgaaagggagtactgtaaaagctgcagtaaagaagatacacaaaaatgtgttaacacaaaacttgagcaaccacagagcattttgattgaacataagggaactataatcggaaagcaaaacaatacctgcacagccaaaacaagttgctggttagagtcagttaaaagtttcttttatggtctaaagaatatgcttagtggcatttttggcaattttttcatgggcatcttcttatttcttgccccctttatcttgttaatacttttctttatgtttggatggaggatcctgttttgctttaagtgttgcagaagaaccaggggcctgtttaagtacagacatctcaaagatgatgaagaaactggttatagaaggatcattgaaagactgaacaacaagaaagggaagaacaagctgcttgatggtgaaagacttgccgatagaaggattgccgaactattctccacaaaaacacatattggc

SEQ ID NO: 3706 - RNA, 3495 nt, synthetic construct
  misc_feature 1..3495: note = derived and/or modified CDS sequence (wt) from CCHVF(CCHVF VLG/TI29414)__AY179961.1__Gn-NSm-Gc
  source 1..3495: mol_type = other RNA
tccgaggagccaggtgatgactgcatatcaagaactcagctattgagggcagaaccagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaatttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagcccctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaagagactgagctgtacttgaacctggaaagaattccttggaatgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcatcagttacacttgagtatctgcaaaaaaagaaaaatgggtagcaatgtcatgctggccgtctgcaagcgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttactaaactcaacaaacttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctgggaagtaggaactggctgcacctgctgcgggtggaatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgctgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggaatgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtgattgcagctagcacaagtctcatggcgaggaagcttgaatttgggacagacagtacattcaaggccttttcagctatgcccaaaacctctttatgtttttacattgcggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacgaaaacacacattggt

SEQ ID NO: 3707 - RNA, 3495 nt, synthetic construct
  misc_feature 1..3495: note = derived and/or modified CDS sequence (wt) from CCHVF(CCHVF TADJ/HU8966)__AY179962.1__Gn-NSm-Gc
  source 1..3495: mol_type = other RNA
tctgaagaatctggtgacgactgcatatcaagaactcagctactgaggacagagactgcagagatccatggtgatgattatggtggtccgggtgacaagattaccatttgcaatggttcgactattgtagatcaaagactgggtagtgaactggggtgttacactatcaatagagtgaagtcattcaagctgtgcgaaaacagtgcaacagggaagaactgcgaaatagacagcgtcccagttaaatgcaggcagggttattgcctaaaaattactcaggaaggaaggggccatgtgaaattatccaggggctcagaggttgttttggatgcatgcgattcaagctgtgaagtaatgatacctaagggcacaggtgacatctcagtagactgttcaggagggcagcaacattttttgaaagacaacttaattgatctgggatgtcccaagattccattattgggtaaaatggccatttatatttgcagaatgtcgaatcaccctaaaacaaccatggctttcctcttttggttcagttttggctatgtgataacccgtatactctgcaaggccattttctacttattaataattgttggaacactagggaagaggtttaagcaatatagagagttaaaaccccagacctgtaccatatgtgagacaactcctgcaaatgcaatagatgctgaaatgcatgaccttaactgcagttacaacatatgtccctattgtgcatctagactgacctcagatggactcgctaggcatgtgacacaatgccctaagcggaaggagagagtagaagaaactgaattgtacttgaacttagaaagaattccctggattgtaagaaagctgttgcaggtatcggagtccactggtgttgcattaaaaagaagcagctggctgattgtgctacttgtgctgttcacagtttcattatcaccagttcaatcagcacccattggttatgggaatacaattgaaacataccaggccagggaagaatacacaagcatttgcctctttgtactgggaagtatcttgtttatagtctcttgtctgatgaaagggctggttgacagtattggcaacatcttcttccctgggctgaccatctgcaagacatgctctataggtagtatcaatggctttgaaattgagtctcacaagtgctattgtagcttactttgttgcccctactgtaggcactgctctgctgatagagaaattcatcagctgcacttgagcatctgcaaaaaaagaaaaacaggaagtaatgtcatgcttgcagtctgcaagcgcatgtgcttcagagcaactatggaagtgagcaataaggccctacttatccgtagcatcatcaataccacttttgttgtgtgcatattaatattagcagtctgtattgttagcacctcagcagtagagatggaaagcctaccagctgggacctgggaaagagaagaagacctaacaaatttctgtcatcaggaatgccaggttacagagactgagtgcctctgcccttatgaagcccttgtgctcagaaggcccctgttcctggatagtatagtcaaaggcatgaaaaatccgctaaactccacaagtttagaaacaagcttgtcgattgaggcaccatggggggcaataaatgttcagtcaacttacaagccaactgtttcaactgcaaacatagcacttagttggagttcaattgaacacagaggtaataatattttggtttcaggcagatcagaatcaattatgaagctggaagaaagaacaggaattagtggggatcttggcgttgaagatgcctctgaatccaagctacttacagtctctgttatggacttgtctcagatgtactcccctgtcttcgagtacttatcaggtgacagacaagtagaagagtggcccaaggcaacctgtacaggtgactgcccagaaagatgtggctgcacatcatcaacctgcttacataaagaatggccccattcacgaaactggagatgcaatcccacttggtgctggggggtggggactggctgcacctgttgtggattagatgtgaaagacctatttatagattatatgttcgtcaagtggaaagttgattacattaaaacagaagccatagtgtgtgtagaactcaccagtcaggaaaggcagtgtagcttggttgaggcgggcacaaggttcaatttaggtcctgtgaccatcacattgtcagaaccgaggaacatacaacaaaagctccctcctgaaataatcacattgcatcctaggattgaagaaggtttttttgatctaatgcatgtgcaaaaagtgctgtcagcaagcacagtgtgtaaattgcagagttgcacacatggtgtgccaggagatctacaggtctaccacatcggaaacttattaaaaggagataaagagaacggacacctaattcataaaattgagccgcacttcaatacttcctggatgtcctgggatggctgtgacctagactactactgcaacatgggagactggccttcttgcacatataccggagttacccagcacaatcatgcttcatttgtaaacctgctcaacattgaaactgactatacaaaaagcttccactttcactctaaaagggttactgcacacggagacacaccacaattggatctgaaggcaagaccaacttacggcgcaggagaaatcactgtactggtagaagttgctgatatggagttacacacgaagaagattgaaataacaggcctcaaatttgcaagcctgacttgcacaggttgttatgcttgtagttcaggcatttcctgcaaagttaggattcatgtggacgagccagatgaacttacagtacatgttaaaagtgatgatccagatgtagttgcagctagctcaagtctcatggcaaggaagcttgagttcgggacagacagtacattcaaagctttctcagccatgcctaaaacttccttatgcttctacattgtcgaaagggagtaccgtaagagctgtagtaaagaggacacacagaaatgtgttaacacaaaacttgagcaaccacagagcattttgatcgaacacaagggaactataatcggaaagcaaaataatacttgcacagccaaagcaagttgctggttagagtcagtcaaaagtttcttttatggtctaaagaacatgcttagtggcatttttggcaatgtttttgtgggcattttcttgtttcttgccccttttatcttgttaatacttttctttatgtttggatggaggatcctgtcttgctttaagtgttgcagaagaaccaggggcctgcttaagcatagacatctcaaagacgatgaagaaactggttacagaaggatcattgaaagactgaacaacaagaaggggaaaaacaagctgcttgatggtgaaagacttgccgatagacggattgccgaactattctccacaaaaacacacattggc

SEQ ID NO: 3708 - RNA, 3495 nt, synthetic construct
  misc_feature 1..3495: note = derived and/or modified CDS sequence (wt) from CCHVF(CCHVF Hodzha)__AY223476.1__Gn-NSm-Gc
  source 1..3495: mol_type = other RNA
tctgaagaatctggtgacgactgcatatcaagaactcagctactgaggacagagactgcagagatccatggtgatgattatggtggtccgggcgacaagattaccatttgcaatggttcaactattgtagatcaaagactaggtagtgaactggggtgttacactatcaatagagtgaagtcattcaagctgtgcaaaaacagtgcaacagggaagagctgtgaaatagacagcaccccagttaaatgcaggcagggttattgcctaaaaatcactcaggaaggaaggggccatgtgaaattatccaggggctcggaggttgtcttggatgcatgcgattcaagctgtgaagtaatgatacctaagggcacaggtgacatcctagtagactgttcaggtgggcagcaacattttttgaaagacaacttaattgatctaggatgtcccagaattccattattaggtaaaatggctatttatatttgcagaatgtcgaatcaccctaagacaaccatggctttcctcttttggttcagttttggctatgtgataacctgtatactctgcaaggccattttctacttattaataattgttggaacactagggaagaggttcaagcagtatagagagttaaaaccccagacctgtaccatatgtgagacaactcctgcaaatgcaatagatgctgaaatgcatgaccttaactgcagttacaacatatgtccctattgtgcatctagactaacctcagatgggcttgctaggcatgtgacacaatgccctaagcggaaggagaaggtagaagaaactgaattgtacttgaacttagagagaattccctggattgtaagaaagctgttgcaggtgtcggagtccactggtgttgcattaaaaagaagcagctggctgattgtgctgcttgtgctgttcgcagtttcattatcacctgttcaatcagcacccattggtcatgggaagacaattgaaacataccaggccagggaagattacacaagtatttgcctctttgtactgggaagcatcttgtttatagtctcttgtctgatgaaagggctggttgacagtattggcaacatcttcttccctgggctgaccatctgcaagacatgctctataggtagtatcaatggctttgaaattgagtctcacaagtgctattgtagcttactttgttgcccctactgtaggcactgctctgctgatagagaaattcatcagctgcacttgagcatctgcaaaaaaaggaaaacaggaagtaatgtcatgctcgcagtctgcaagcgcatgtgcttcagagcaactatggaagtgagcaataaggccctacttatccgtagcatcatcaacaccacttttgttgtgtgcatattgatattagcagtctgtgttgttagcacctcagcggtagagatggaaagcctaccagctgggacctgggaaagagaagaagacctaacaaatttctgtcatcaggaatgccaggttacagagactgagtgcctctgcccttatgaagcccttgtgctcagaaggcccctgttcctggatagtatagttaaaggcacgaaaaatctgttaaactccacaagtttagaaacaagcttgtcgattgaggcaccatggggggcaataaatgttcagtcaacctacaaaccaactgtatcaactgcaaacatagcacttagttggagttcagttgaacacagaggtaataagattttggtttcaggcagatcagaatcaattatgaagctggaagaaagaacaggaatcagctgggatcttggcgttgaagatgcctctgaatctaagctacttactgtctctgtcatggacttgtctcagatgtactcccctgtcttcgagtacttatcgggtgacagacaagtagaagagtggcccaaagcaacctgcacaggtgactgcccagaaagatgtggctgcacatcatcaacctgcttacataaagaatggccccattcacgaaactggagatgcaatcccacttggtgctggggggtggggactggctgcacctgttgtggattagatgtgaaagacctatttacagattatatgttcgtcaagtggaaagttgattacattaaaacagaggccatagtgtgtgtagaactcaccagtcaggaaaggcagtgtagcttggttgaggcgggcacaaggttcaatttaggtcctgtaaccatcacattgtcagaaccgaggaacatacaacaaaagctccctcctgaaataatcacattgcatcctaggattgaagaaggtttttttgacctgatgcatgtacaaaaagtgctgtcagcaagcacagtgtgtaaattgcagagttgcacacatggtgtgccaggagatctacaggtctaccacatcggaaatttattaaaaggggataaagtgaacggacacctaattcataaaattgagccgcacttcaatacttcctggatgtcctgggatggctgtgacctagactactactgcaacatgggagactggccttcttgcacatataccggagttacccaacacaatcatgcttcatttgtaaacctgctcaacattgaaactgactatacaaaaagcttccactttcactctaaaagggttactgcacatggagacacaccacaattggatctgaaggcaagaccaacctacggcgcaggagaaatcactgtactggtagaagttgctgatatggagttacacacaaagaagatcgaaataacaggccttaaatttgcaagcctgacttgcacaggttgttatgcttgtagttcaggcatctcctgcaaagttaggattcacgtggatgaaccagatgagctaacagtacatgttaaaagtgatgacccagatgtagttgcagccagctcaagtctcatggcaaggaaacttgagtttggaacagacagtacattcaaagctttctcagccatgcctaaaacttccttatgcttctacattgtcgaaagggagtactgtaagagctgcagtaaagaagacacacagaaatgtgttaacacaaaacttgagcaaccacagagcattttgatcgaacgcaagggaactataatcggaaagcaaaacaatacttgcacagccaaggcaagttgctggttagagtcagttaaaagtttcttttatggtctaaagaacatgcttagtggcatttttggcaatgtttttgtaggcattttcttatttcttgccccctttatcttgttaatacttttcttcatgtttggatggaggatcctgttttgcttcaagtgttgcagaagaaccaggggcctgtttaagtataaacatctcaaagacgatgaagaaactggttacagaaggatcattgaaagactgaacaacaagaaggggaaaaacaagctgcttgacggtgaaagacttgccgatagaaggattgccgaactattctccacaaaaacacacattggc

SEQ ID NO: 3709 - RNA, 3495 nt, synthetic construct
  misc_feature 1..3495: note = derived and/or modified CDS sequence (wt) from CCHVF(CCHVF Kosovo/9553/2001)__AY675511.1__Gn-NSm-Gc
  source 1..3495: mol_type = other RNA
tccgaagagccaggtgatgactgcatatcaaggactcagctattgaggacagaaacagcagagatccatgacgataactatggtggtccaggtgacaaaataactatctgcaatggttcgaccattgtagatcagagactgggcagtgaactagggtgttataccatcaacagggtgaagtcattcaagctatgcgaaaacagcgccacagggaaaacctgtgagatagacagcactccagttaagtgcaggcaaggtttttgtttaaaaatcacccaagagggaaggggccacgtaaaattatctagaggctcagaggttgtcttggacgcttgcgactcaagctgtgaagtaatgatacccaaaggcactggagatatcctagtagactgctctggtggacagcagcatttcttaaaagacaacttgattgacctagggtgccctcatatcccactattgggtaagatggccatttacattgccagaatgtcaaatcatcctaaaacaaccatggcttttctcttctggttcagtttgggctatgtgatcacctgtatactttgcaaggctcttttttattcattgataattattgggacactagggaaaaaaatcaagcaatatagggaactgaaacctcaaacttgcaccatatgtgagacagctcctgtcaatgcaatagatgctgaaatgcatgacctcaactgtagttacaatatatgcccctattgtgcatcaagattgacctctgatgggctagctaggcatgtaaagcagtgccctaagcgaaaggagaaagtcgaggagactgagctgtacctgaacctggaaagaattccttgggtcgtcagaaagctattgcaagtgtcagagtccactggtgtggcattgaaacgaagcagttggctgattgtgctgcttgtgttactcacagtttcattgtcaccggttcaatcagcacccgttggtcatggtaagacaatcgaaacatatcagaccagagaaggattcacaagtatttgtctctttatgttaggaagcatcctattcatagtctcctgcttggtgaaagggctggttgacagtgtcagtgacagcttcttccctggcctgtctgtctgtaaaacatgctccattggcagtataaatggctttgaaattgaatcgcataaatgctactgtagcttgttctgctgcccctattgtagacactgctctgctgacagagaaattcaccaattgcacttgagtatctgcaaaaaaagaaaaacagggagcaatgtcatgctagctgtctgcaagcgcatgtgctttagagcaaccatagaagcaagcagaagagccctgctcatccgaagtattatcaataccacttttgtaatatgcattctaacattaacaatctgtgttgctagtacctctgcagtagagatggaaacccttccagcagccacctgggagagagaggaagacctgacaaatttctgtcatcaggaatgccaggtacccgagacggaatgcctttgcccatacgaagctcttgtgctcaggaaacctcttttcttagacagtatagtcaaaggtatgaaaaatttgctaaactcaacaagcttggaaacaagcttatcaattgaggcaccatggggagcaataaatgtccagtcaacctttaaaccaacagtatcgactgcgaacatagcactcagttggagctcagtggagcacagaggcaacaagatcttagtcacaggcaggtctgaatcaattatgaaactagaggaaaggacaggagtcagctgggatctaggggtagaagatgcctctgaatccaaattacttaccgtctctatcatggatttgtcacagatgtattccccagtttttgagtacttgtctggagacagacaggttgaagaatggcccaaagcaacttgtacaggtgactgcccagaaaggtgtggctgcacatcatcaacctgcttgcataaagaatggcctcattcaagaaactggagatgtaatcccacttggtgctggggagtgggaaccggctgcacctgctgcggggtggatgtaaaagacctttttacagatcacatgtttgtcaaatggaaggttgaatatataaaaactgaagccatagtgtgtgttgagctcaccagccaagaaagacagtgcagtctgattgaggcaggtactagattcaacttgggccctgtgactattaccctgtctgagccaagaaacattcagcagaagcttccccctgagatcattacgttgcatcccaaaattgaggaaggcttctttgacttgatgcatgtacaaaaagtgttgtccgcaagtacagtgtgtaaactgcagagttgcacacatggtataccaggagatctacaagtttaccacattggcaacttgttgaaaggggatagagtaaacgggcatctaattcacaaaattgaaccacatttcaacacctcttggatgtcctgggatggttgtgacttagactactactgcaacatgggggactggccttcttgtacatacacaggagtgacccagcataatcatgctgcatttgtaaacttgcttaacattgaaactgattacacgaaaaccttccacttccactctaaaagagtcacagcacatggtgacacaccacaattggacttaaaagcaaggccgacctacggtgcaggagagatcactgtgctggttgaggttgctgacatggagttgcataccaagaaagttgagatatcgggcttgaaatttgcaagtctggcttgcacaggttgctatgcctgtagctctggcatctcctgtaaagtcaggattcatgtagatgaaccagatgagctcacagtgcatgtaaagagcagtgacccagatgttgttgcagctagcacaagcctcatggcaaggaagcttgaatttgggacagacagcacattcaaggccttttcagctatgcccaaaacctctttatgtttttacattgtggagaaagaatactgcaagagctgcagtgaagatgatacaaaaaaatgtgttgacacaaaacttgagcagccacagagcatactaattgagcacagagggacgataattggaaagccgaatgatacttgcccagccaagacaagctgttggctagagtccgtcaagagctttttttatggattgaagaatatgcttggcagtgtctttggtaattttttcataggcattttgttattccttgccccttttttcctgtggatgctttcctttatgtttggatggaaaatcttgttctgctttaaatgttgcaggaggaccagaggcctgtttaagtatagacacctcaaagacgatgaggaaacaggctacagaaggattattgaaaggctgaacaacaaaaaagggaaaaatagactgcttgatggtgaaaggttggctgataggaaaattgccgagctgttttctacaaaaacacacattggc

SEQ ID NO: 3710 - RNA, 3495 nt, synthetic construct
  misc_feature 1..3495: note = derived and/or modified CDS sequence (wt) from CCHVF(CCHVF SPU41/84)__AY900142.1__Gn-NSm-Gc
  source 1..3495: mol_type = other RNA
tccgaggagtctagcgacgactgcatatcaagaactcaactattgaggacagagactgcagagatccacggcgataactatggtggcccaggtgacaagataaccatctgcaatggctcaactgttgtagaccagagactgggtagtgagctggggtgttacactatcaatagagtaaagacattcaaactatgcgaaaacagtgctacagggaagagttgtgagatagatagtgtcccagttaaatgcaggcagggttattgcctaaaaatcactcaggaaggaaggggccatgtaaaattatctagaggctcagaggttgtcttggatgcatgtgatacaagctgtgaagtaatgatacccaaaggcactggtgacatcctagttgactgttcaggtgggcagcaacattttctaaaagacaatctaatagacctaggatgccccaaaattccattactgggtaaaatggctatttacatttgcagaatgtcgaatcaccccaaaacaactatggctttcctcttctggttcagctttggctatgtgataacttgtataatttgtaaggtcattttttacttgttaataattgttggaacactaggaaaaaggttcaagcagtacagagagttaaaacctcagacctgcaccatatgtgagacaactcctgtgaatgcaatagatgctgagatgcatgacctcaattgcagttacaacatatgtccctattgtgcatctagactaacctcagacgggcttgctaggcatgtgacacagtgccctaagcggaaggaaaaagtggaggaaactgaattgtacttgaacttggagagaattccctgggttgtgagaaagctgttgcaggtatcagagtccactggtgtggcattgaaaaggagcagctggctggttgtgctgctggtgctgttgacggtttcattgtcaccggttcagtcagcgcccattagtcatgggaagacagttgaggcataccgggcaagagaggggtacacaagtatgtgtctctttgtgctgggaagtgtcctgtttttagtctcctgtctaatgaaaggactggttgacagtgtcggcaacaccttcttccctggactgtccatttgcaaaacgtgctctataagcagcattaatggctttgaaattgagtctcataggtgctattgcagcttgttttgttgcccatattgtaggcactgctctgctaataaagaaattcatcagctgcacttgagcatctgcaaaaaaaggaaagcaggaagtaatgtcatgctggctgtctgcaagcgcatgtgctttagggccaccatggaagtaagcaacagagccctgtttatccgtagcatcatcaacaccacttttgttttatgcatactgatactagcagcctgtgttgtcagcacctcagcagtggagatggaaagcctaccagccgggacctgggagagagaagaagacctaacaaacttctgtcatcaggaatgccaagttgcggatactgaatgcctctgcccttatgaagctctagtgctcagaagacctctattcttagatagtatagttaagggcatgaaaaatttgctaaactcaacaagtttagagacaagtttatcaattgaggcaccatggggagcaataaatgttcagtcaacctacaaaccaactgtatcaactgcaaacatagcgcttagttggagctcagtggaacacagaggcaataagatactggtttcaggcagatcagaatcaattatgaagctggaagaaaggacaggaataagctgggatctcggtgtggaagacgcctctgagtctaaactgcttacagtctctgtcatggacttgtctcagatgtactcacctgtcttcgagtacttatcaggagacagacaggtggaggagtggcccaaagcaacttgtacgggtgactgcccagaaagatgtggctgcacatcatcaacctgcttgcacaaagaatggccccactcaagaaattggagatgtaatcccacttggtgctggggtgtaggaactggctgcacctgttgtggattagacgtgaaagacctctttacagattatatgtttgtcaagtggaaagttgaatacattaagacagaagcaatagtgtgtgtagaacttactagtcaggaaagacagtgtagcttgattgaagcgggcacaaggttcaacttgggtcctgtgaccatcacattgtcagaaccaagaaacatccagcaaaagctcccacctgaaataatcacactgcatcccaggattgaggagggtttttttgacctgatgcatgtacaaaaagtgttgtcggcaagcacagtgtgtaagttgcagagttgcacacatggtgtgccaggagatctacaggtctaccacatcggaaatttactaaaaggggataaggtaaatgggcacctagttcataaaattgagccacacttcaatacttcttggatgtcctgggatggttgtgatctagactattattgcaacatgggagattggccttcttgcacatacacaggagttacccagcacaatcatgcctcatttgtaaacatgctcaacattgaaactgattacacaaaaaacttccactttcactctaaaagggtcactgcacacggagacacaccacaactagatcttaaagcaagaccaacctatggtgcaggtgagatcactgtattggtggaggttgctgacatggagttacacacaaagaagattgaaatatcaggcttaaaatttactagcttgacttgtacaggttgttatgcttgtagttctggcatctcatgcaaagttagaattcatgtggatgaaccagatgagcttacagtgcatgttaaaagtgaagatccagatgttgttgcagctagctcaagtctcatggcaagaaagcttgaatttggaacagacagtacatttaaagctttttcagccatgcctaaaacttctctatgtttctacattgtggaaagagaatactgtaagagctgcagtgaagaagacacacaaaaatgtgttaacacaaaacttgagcagccacagagcattttgatcgaacgtaagggaactataatcgggaagcaaaacaacacttgcaaggctaaggcgggttgctggttagagtcagttaagagttttttttacggcctaaagaacatgctcagtggcatttttggcaatgtatttataggcattttcttattccttgcccccttcatcctgttaatactattctttatgtttgggtggaggatcttgttttgttttaagtgttgtagaagaaccagaggcctgttcaagtacagacacctgaaagacgatgaagaaactggttatagaaagatcattgaaagactaaacaacaaaaaagggaaaaataaactgcttgatggtgaaagacttgctgatagaagaattgccgaactgttctctacaaaaacacacattggc

SEQ ID NO: 3711 - RNA, 3495 nt, synthetic construct
  misc_feature 1..3495: note = derived and/or modified CDS sequence (wt) from CCHVF(CCHVF UG3010)__AY900143.1__Gn-NSm-Gc
  source 1..3495: mol_type = other RNA
gcagaaggagtgagcaatgactgtgtttcaaggacccagctaatcaaaacagaagttgcagagattcatgaagatagttatggtgggcctggagaaaaaataacaatctgcaacggctccacaatcgtggaccaaagactcggtagcgaactaggctgctacacaatcaaccgtgtgaagacttataagctttgtgagaatagtgctacagagaagggttgtgagatcgatagtgtcccagtcaaatgcaaacaagggttctgcctcaaagtaacccaagagggcaggggccatgtaaaactgtccagaggaacggaaattgtcctagatgtatgtgacaccagttgtgagttgatgatacccaagggcactggggacatattggtggactgctcaggaggacagcagcactttttgcaggataacttgattgacttaggttgtccaaatgtaccattattaggcaagatggcaatatatatctgcaggatgtcaaatcatcctaaaactaccatggcttttctgttctggtttagctttggctatgtcatcacatgcatagtatgtaaagtgcttttctatctgctaattgtcatcgggacactaagtaagaaacttaaacagtatagggaattaaaacctcaaacatgcattgtctgtgaatcaacccctgttaatgcaatagatgctgaaatgcacgagctcaattgtaattacaacatatgcccatactgcgcgtccagactaacttcagatggactagtcagacatgtgaatcaatgtcccaaaaggaaagaaaaggtcgaggagactgaactatacttgaacctggagaggataccttggctagtaaggaggctactacaagtgtcagagtcaacggggatggctctaaagagaagttgctggatgaccacactcctcattctgctagtagtttcattatcgccagttcaatctgctccagttggtcaggggaaagcagtcgaagtctaccgggtgagagaaagctacacaagcatatgcctctttgtattaggaagtgttctctttgcggtatcctggctgataaagggtttgattgacggtatcggcaacagttttttccctgggctttctgtctgcaaaacatgctctattggcagcataaatgggttcgagatagagtctcacaaatgctattgtagtctgttttgttgtccttattgcagagcttgctcatctgacaaaatcactcaccgaatgcatttgaacgtctgcaagaaaaggaaagcgggtagcaatgttatgctggctgtctgtaagcgtatgtgctttaaggcaactgttgaagcaagcaacacagccttgctcatcaggggtatcataaattccacttttgtgatatgcgtactgatcctggttatctgtgtggtaagcacatctgctgttgacatggagaatctaccagcaggaatctgggagagagaagaagaccttacaaacttttgccaccaagaatgtcaagtaacagaaactgagtgtctttgcccgtatgaagccttaattctcagaaagcctctttacctagacagcatagccaaggggatgaaaagtctgctaaattctacgaatttagagacaagcctgtcgattgaggccccgtggggagcaatcaatgttcagtcaacttttaaaccaacagtttcagctgccaatatagcacttagctggagttcagttgaacacaggggcaacaaaatcctagtttcgggcaggtcagagtcaattatgaagctggaagaaaggaccggtatcagctggagcctaggtgtagaggatgcttctgagtcaaagacgctgactgtttctgtcatggacctatcccaaatgtattctcccgtctttgagtatctgtcaggtgatagacaggtagaagagtggccaaaagccacctgcacaggcgactgccaagagagatgtggctgcacttcttcaacctgcttgcataaagaatggccacactcgagaaactggcgatgcaaccccacttggtgttggggagtggggactggctgcacctgctgtggattggatgtgagagaccttttcacggactacatgatggttaagtggaaagtggaatatgtaaaaacagaagctataatgtgtgttgagctaaccagtcaggagaggcaatgtagtttgattgaagcaggtacaagatttaacctaggccctgtgacaataaccctgtcagagccaagaaacatccagcaaaggctcccttccgaaatcgttacactgcaccctaagatagaagaagggttctttgacttgatgcatgtgcaaaaggtactatctgcaagtacagtctgcaaactacagagctgcacacacggtgtccctggcgatctacaggtctaccatgttggcaacctactgaaaggagataaggtcaatgggcactcaatccacaagatagagtcccatttcaacacttcatggatgtcatgggatggatgtgatctagactacttctgcaacatgggtgactggccctcatgtacatacactggagtgacacagcacaaccgtgcggcattcatcaatatgctcaatattgagactgattatacaaagactttccacttccattccaagagagtaacggcacatggtgacacccctcaactggatctgaaggcaaggcctacatatggtgcaggcgaagtcactgttctagtagaggttgcagatctggagctacacaccaagaaaattgaagtgtcaggactgaagtttgcaagtctgacctgctccggttgttacgcctgcagctccggtatctcctgcaaagttagaattcatgtgaatgaaccagatgaatttactgtacatgtgaaaagcagtgatccagatgttgtggcagcaggatcaagtttgatggcaaggaaaatagagtttggggctgacagcaccttcaaagctttctcatcaatgcctaaaaactctttgtgcttctatatagtggaaagagactactgcagcagctgcaccaatgatgacactcagaagtgtgttgacacaaagctcgaacatccacaaagcatattaattgagcataagggaacaataattggcaaacaaaacgacacctgttcgaccaaaacaagctgttggctagaatcagtcaagagttttttttatggactaaaaaacatgctgggtggcatcttcggtaatgtcttcttaggcatcttcctgttccttgctccttttgcactgctaatattcttcttcttcttcgggtggaggcttctgttctgtctgaagtgttgcagaagaaccagggggctgctaaagtataaacaacttaaggacgaagaagaagccgggtacaagaaaatcatcgagaggctaaatgacaaaaaaggcaaaagtcgactgtttgacggagagaggcttgcagataggaagattgcagaactcttttcaaccaaaactcatataggg

SEQ ID NO: 3712 - RNA, 3495 nt, synthetic construct
  misc_feature 1..3495: note = derived and/or modified CDS sequence (wt) from CCHVF(CCHVF Hy13)__AY900145.1__Gn-NSm-Gc
  source 1..3495: mol_type = other RNA
tccgaagagtctggtgatgactgcatatcaagaactcagctatcgaggacagagactgcggaaattcacagtgataactatggtggtccaggtgacaagataaccatctgcaatggttcaactattgtagatcagagattgggcagtgaactagggtgttacactatcaatagagtaaagtcatttaagctttgcgagaacagtgccacaggtaaatcctgtgaaatagatagcaccccaattaaatgcaggcagggtttttgtttaaaaattactcaggagggaaggggccacgtgaagctatcaagaggttcagaagttgtcttggacgcctgtgattcaagctgtgagataatgataccaaagggcactggagacatcctagttgactgttcaggtggacagcaacatttcttaaaagataacttgattgatctgggatgcccaaacatcccactattaggtaagatggctatctacatttgtagaatgtcaaatcatcctaaaacgactatggcttttcttttttggtttagctttggttatgtgataacctgtatactctgtaaggtcatcttctacctattaatagttgtggggacgttgggaaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagacggtcttgccagacatgtaatgcagtgccctaagcggaaggaaaaagtagaagaaaccgaattatacttaaacttagaaagaatcccctgggttgttaggaaattactgcaggtatcagaatccaccggtgtggcactaaagaggagtagttggctggttgtgctacttgtgttacttacagtttcattgtcaccagtacaatcagcacctatcggccatggaaagacagttgaaacatatcaaaccagagaagggtacacaagcatttgcctttttgtactaggaagcatcttatttatagtctcttgcctaatgaaggggttggttgacagtgttggtaacagttttttccctggttcgtccatttgtaagacatgttctattggcagcataaatggctttgagattgaatctcacaaatgttactgtagcctattttgttgcccctactgtagacactgctctgccgatagagaaatacataagttgcacttgagcatctgcaagaaaaggaagactgggagtaatgtcatgttggccgtctgtaagcgcatgtgctttagggcaactgtggaagtaagcaacaaggctctacttatccgaaacatcatcaataccacttttgttgtgtgcatactgatattagcagtttgtgttgtcagcacctccgcagtggagatggaaagcctgccagctggcacttgggagagagaggaagatctgacaaatttctgtcatcaagaatgccaagccactgagactgaatgcctctgtccttacgaagctcttgtgctcaggaaacccttgttttcagacagtattgtcaaaggcatgaagaacttgctaaattcaacaagcttagaaacaagcttatcaattgaggcaccatggggagctataaatgtccaatcaaccttcaaacctactgtgtccgctgcgaacatagctcttagttggagctcagtggaacacaggggtaataagattttggtttcaggtagatcagagtcaattatgaagctagaggaaaggacaggaatcagctgggatctaggggtagaagatgcctctgagtctaaattgcttactgtctctattatggacttgtcacagatgtattctcctgtctttgagtacctatcaggtgatagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagatcacatgtttgtcaagtggaaagttgagtacattaaaacagaagctatagtgtgtgttgagcttactagccaagagagacaatgtagcttgattgaggcaggcacaagattcaacttaggtcctgtgaccatcacattgtcagagccaagaaacattcagcaaaagctccctccagagatagttacattgcatcccagaattgaagaaggtttctttgatttaatgcatgtaaaaaaagtgctatcagcaagtacagtatgtaagctacagagttgcacacatggtgtgccaggggacctacaggtctaccacataggaaacttgttaaaaggagacaaggtgaatgggcacctgattcacaaaattgaaccacacttcaacacttcctggatgtcttgggacggctgtgacctagactactactgtaatatgggagactggccatcttgctcatatactggagtaacccagcacaatcatgctgcatttgtaaacatgctcaacatcgaaactgattatacaaaaatcttccactttcactctaagagagttactgcacatggagacacaccacaattagatttgaaagctagaccaacttatggtgcaggtgaaatcactgtgctagtggaagttgctgacatggagttacacacaaagaaaattgagatatcaggtttaaagtttgcaagcttaacttgcacaggctgttatgcttgtagctctggtatctcctgtaaggttagaatccatgtagatgagcctgatgagcttacagtacatgtgaagagtgaagacccagacatagttgctgctagctcaagtctcatggctagaaaacttgaatttgggacagatagcacattcaaagccttttcagccatgcccaaaacctccttgtgcttttacattgtggagagagaatattgtaaaagctgcagtaaagaagatacacaaaaatgtgtcaacacaaagcttgagcaaccacagagcattttaattgagcacaaaggaacgataattggtaagcaaaacgacacctgcacatctaaagcaggctgttggctagagtcagtcaagagcttcttttatgggctaaaaaacatgcttagtggcatttttggcaatgttttcatagggattttcttattccttgctccttttatccttttaatacttttctttatgtttggatggagaatcctgttctgctttaaatgttgcagaagaactagaggcttatttaagtacagacacctcaaggacgatgaagaaaccggttacaggaaaatcattgagaggctgaacaacaaaaaagggaaaaacaaactgcttgatggtgaaagattagctgataggaagattgctgagctgttctccacaaagacacacattggc

SEQ ID NO: 3713 - RNA, 3495 nt, synthetic construct
  misc_feature 1..3495: note = derived and/or modified CDS sequence (wt) from CCHVF(CCHVF Semunya)__DQ094832.1__Gn-NSm-Gc
  source 1..3495: mol_type = other RNA
gcagaaggagtgagcaatgactgcgtttcaaggacccagctaatcaaaacagaagttgcggagattcatgaagatagctacggtgggcctggagaaaaaataacaatctgcaacggctccacaatcgtggaccaaaggcttggtagcgaactaggttgctacacaattaaccgcgtgaagacttataagctttgtgagaacagtgccacagaaaagggttgtgagatcgatagtgttccagtcaaatgcaaacaagggttctgcctcaaagtaacccaagagggcaggggccatgtgaaactatctagaggaacggaaattgtcctggatgtgtgtgacaccagttgtgagttgatgatacctaaaggcactggagacatattggtggactgctcaggaggacagcagcacttcttgcaggacaacttgattgacttaggttgcccaaatgtaccattactaggcaagatggcaatatatatctgcaggatgtcgaaccatccaaagaccaccatggcttttttgttctggttcagttttggctatgtcatcacatgcgtagtatgcaaagtgctcttctatctgctaattgtcatcgggacactaggaaagaaacttaaacagtatagggaactaaaacctcagacatgcattgtctgtgaatcaatccctgtcaatgcaatagatgctgaaatgcacgagctcaattgcaattacaatatatgcccatactgtgcgtccagactgacttcagatggactagttagacatgtgactcaatgtcccaaaaggaaggaaaaggtcgaggagactgagctgtacttgaacctggagaggataccctggttggtaagaagactactgcaagtgtcagagtcaacagggatggctctaaagagaagttgctggatgaccacactcctcattctgctagtagtttcattgtctccagttcaatctgctccagtaggtcaggagaaagcaatcgaagtctaccaggtgagagaaagttacacaagcatatgcctctttgtattaggaagtgttctctttgcagtctcctggctggtaaagggtttgattgacggtatcggcaacagttttttccctgggctttctgtctgcaaaacatgctctattggcagcataaatggatttgaaatagagtcccacaaatgctattgtagtctgttctgttgtccttactgcagagcttgctcatctgacaaaatcactcaccgaatgcatttgaatatctgcaagaggaggaaagtgggtagcaatgttatgctggctgtctgtaagcgtatgtgctttaaggcgactgttgaagcaagcaactcagccctgctcatcagaagcatcataaactccacctttgtgatatgcgtgctgattctagttatctgtgtggtaagcacatctgctgtcgacatggagaatctaccagcaggcatctgggagagagaagaagaccttacaaacttctgccatcaagaatgccaagtgacagagactgagtgtctttgcccgtatgaagccttaattctcagaaagccccttttcctggatagcatagccaaggggaagaaaagtctgttaaattctacgaacttagagacaagcctgtcgattgaggccccatggggagcaatcaatgttcagtcaacttttaaaccaacagtttcagctgccaacatagcacttagctggagttcagttgaacacaggggcaacaaaatcctagtttcgggcaggtcagagtcaattatgaaactggaagaacggaccggcatcagctggagcctaggtgtagaggatgcttctgagtcaaagacgcttactgtttctgtcatggacctgtctcaaatgtattctcctgtctttgagtatctgtcaggtgatagacaagtagaagagtggccaaaggccacttgcacaggcgactgcccggagagatgtggctgcacctcctcaacctgcttgcataaagaatggccgcactcgagaaactggcgatgcaaccccacttggtgttggggagtagggactggctgcacctgctgtggactggatgttagagaccttttcacggactacatgatggtcaagtggaaagtggaatatgtaaaaacagaagctataatgtgtgttgagctaactagtcaggaaaggcagtgtagtttaattgaggcaggtacaaggtttaacctaggccctgtgacaataaccctgtcagagccaagaaatgtccagcaaaggcttccctccgaaatcgttacactgcaccctaagatagaggaaggattctttgatttgatgcatgtgcaaaaagtactattctgcaagtacagtttgcaagctacaagctgcacacacggcgtcccaggcgatttgcaggtctaccatgttggcaacctactgaaaggagacaaggttaatgggcactcaattcacaagatagagtctcatttcaacacctcatggatgtcatgggatggatgtgacctagactacttttgcaacatgggtgactggccttcatgtacatatactggagtgacacagcacaatcgtgcggcattcgtcaacatgctcaatattgagactgattatacaaagacttttcacttccattccaagagggttacggcacacggtgacacccctcaactggatctgaaggcaagaccaacatatggtgcaggcgaggtcactgttctagtggaggttgcagatctggagctacacactaagaaaatagaagtgtcagggttgaagtttgcaagtctgacctgctccggttgttatgcctgcagttccggcatctcctgcaaagttagaattcatgtgaatgaaccagatgagttcacagtacacgtgaaaagcaatgatccagacgttgtggcagcaggatcaagtctgatggcaaggaaaatagagtttggggctgacagcacctttaaagccttttcatcaatgcctaaaaactctttgtgcttttatatagtggaaagagactactgcagcagctgcaccgatgatgacactcagaagtgtgttaacataaagctcgaacatccacaaagcatattaattgagcataagggaacaataattggtaagcaaaatgacacctgtccgaccaaaacaagctgctggctagaatcagtcaagagttttttttatggactgaaaaacatgctgggtggcatcttcggcaatgtcttcttaggcatcttcctattccttgctccttttgcactgctgatactcttcttcttctttggatggaggcttctgttctgtctgaagtgttgcagaaggaccaggggtctgctaaagtataaacaacttaaggatgaagaagaagccgggtacaagaaaatcatcgagaggctgaatgacaaaaagggcaaaagtcgactttttgatggagagaggctcgctgacaggaagattgctaaactcttctcaaccaagactcatataggg

SEQ ID NO: 3714 - RNA, 3495 nt, synthetic construct
  misc_feature 1..3495: note = derived and/or modified CDS sequence (wt) from CCHVF(CCHVF SPU128/81/7)__DQ157174.1__Gn-NSm-Gc
  source 1..3495: mol_type = other RNA
tccgaagaacccagtgatgactgcatatcaagaactcaactattgaggacagagactgcagagatccacggcgacaactatggtggcccgggtgacaaaataaccatctgcaacggctcaactattgtagaccaaagactaggcagtgagctagggtgttacactatcaacagagtgaagtcattcaagctatgcgaaaatagtgccacagggaagagctgtgaaatagaaagtgtcccagttaaatgcaggcagggttattgcctgagaatcactcaggaagggaggggccatgtaaaattatctaggggctcagaggttgtcttagatgcatgtgatacaagctgtgaaataatgatacctaagggcactggtgacatcttggttgactgttcaggtgggcagcaacattttctaaaggacaatttgatagatctaggatgccccaaaattccattattgggcaaaatggctatttacatttgcagaatgtcgaatcaccccaaaacaaccatggctttcctcttctggttcagctttggctacgtaataacttgtatactttgcaaggccatcttctacttgttaataattattggaacactagggaaaaggttcaagcagtatagagagttaaaacctcagacctgcaccatatgtgagacaactcctgtaaatgcaatagatgctgagatgcacgacctcaattgcagttacaacatttgtccctactgtgcatctagactaacctcagatgggcttgctaggcatgtgacacaatgccctaagcggaaggagaaagtggaagaaactgaactgtacttgaacttagaaagaattccttgggttgtaagaaagctgttgcaggtatcagagtccactggtgtggcattgaaaagaagcagctggctgattgtgctgcttgtgctgttcacggtttcattgtcaccagttcaatcagcacccattggtcacgggaagacaattgaggcataccgggccagggagggatacacaagtatatgtctctttgtactaggaagtatcctattcatagtctcttgcctaatgaaagggctggttgacagtgttggcaactccttcttccctggactgtccatttgcaagacgtgctccataagcagcattaatggctttgaaattgagtcccataagtgctattgcagcttattctgttgcccctattgtaggcactgctctgctgataaagaaattcataagctgcacttgagcatctgcaaaaaaagaaaaacaggaagtaatgtcatgttggctgtctgcaagcgcatgtgtttcagggccaccatggaagtaagtaacagagccctgtttatccgtagcatcatcaacaccacttttgttttgtgtatactgatactagcagtttgtgttgttagcacgtcagcagtggagatggaaaacctaccagccgggacctgggaaagagaagaagacctaacaaatttctgtcatcaggaatgtcaggttacagagactgaatgcctctgcccttatgaagctctagtactcagaaagcctctattcctagatagtatagttaaaggcatgaaaaatctgctaaactcaacaagtttagaaacaagtttatcaattgaggcaccatggggggcaataaatgttcagtcaacctacaaaccaactgtgtcaactgcaaacatagcactcagttggagctctgtggaacacagaggcaataagatcttggtttcaggcagatcagaatcaattatgaagctggaagaaaggacaggaatcagctgggatctcggcgtagaagacgcctctgagtctaaactgcttacagtctctgtcatggacttgtctcagatgtactctcctgtcttcgagtacttatcaggagacagacaggtggaagagtggcccaaagcaacttgtacaggtgactgcccagaaagatgcggctgcacatcatcaacgtgtttgcacaaagaatggccccattcaagaaattggagatgcaatcccacttggtgctggggtgtagggactggctgcacctgttgtggattagatgtgaaagacctttttacagattatatgtttgtcaagtggaaagttgaatatattaagacagaggccatagtgtgtgtagaacttaccagtcaggaaaggcagtgtagcttgattgaagcgggcacaaggttcaatttaggtcctgtgaccatcacactgtcagaaccaagaaacatccaacagaagctccctcctgaaataatcacactgcatcccaggatcgaagaaggtttttttgacttgatgcatgtacagaaagtgttatcggcaagcacagtatgtaagttgcagagttgcacacatggtgtaccaggagacctacaggtctaccacatcggaaatttattgaaaggggataaggtaaatggacatctaattcataaaattgagccacacttcaacacttcctggatgtcctgggatggttgtgacctggactactactgcaacatgggagattggccttcttgcacatacacaggagtcacccaacacaatcatgcttcatttgtaaacctgctcaacattgagactgattacacaaaaaacttccactttcactctaaaagggtcactgcacacggagacacaccacaactagatcttaaggcaagaccaacctatggtgcaggtgagatcactgtactggtagaagttgctgacatggagttacacacaaagaagattgaaatatcaggcttaaaatttgcaagcttgacttgcacaggttgttatgcttgtagctctggcatctcatgcaaagttagaattcatgtggatgaaccagatgaacttacagtacatgttaaaagtgatgatccagatgtagttgcagctagctcaagtctcatggcaagaaagcttgaatttggaacagacagtacatttaaagctttctcagccatgcctaaaacttctctatgtttctacattgttgaaagagaacactgtaagagctgcagcgaagaagacacaaaaaaatgtgtcaacacaaaacttgagcaaccacaaagcattttgatcgaacacaagggaactataatcggaaagcaaaacagcacttgcacagccaaggcgagttgctggttagagtcagtcaaaagttttttttatggtctaaagaacatgcttagtggtatttttggcaatgtttttataggtattttcttgttccttggccccttcatcttgttaatactattctttatgtttgggtggaggatcctattttgctttaaatgttgtagaagaactagaggcctgctcaagtatagacacctcaaggaagatgaagaaactggttatagaaggattattgaaagactaaacaataaaaaaggaaaaaacaaactgcttgatggtgaaagacttgctgatagaagaattgccgaactgttctctacaaaaacacacattggc

SEQ ID NO: 3715 - RNA, 3495 nt, synthetic construct
  misc_feature 1..3495: note = derived and/or modified CDS sequence (wt) from CCHVF(CCHVF ROS/HUVLV-100)__DQ206448.1__Gn-NSm-Gc
  source 1..3495: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagcccctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcatcagttacacttgagtatctgcaaaaaaagaaaaacgggtagcaatgtcatgctggctgtctgcaaacgcatgtgctttagggcaaccatagaagcaagcagaagagccttgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcctatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacattgcatcccaaagttgaagagggcttctttgacttgatgcatgtgcaaaaagtgctgtctgcaagtacagtgtgtaaactgcagagttgcacacatggtataccaggagatctacaagtttaccatattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaattttttcataggcattttgttattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaagggaaaaaacagactgcttgatggtgaaaggttggctgataggaaaattgctgagctgttctccacaaaaacacacattggt

SEQ ID NO: 3716 - RNA, 3495 nt, synthetic construct
  misc_feature 1..3495: note = derived and/or modified CDS sequence (wt) from CCHVF(CCHVF AP92)__DQ211625.1__Gn-NSm-Gc
  source 1..3495: mol_type = other RNA
tcagaagggggtgatggaggctgcatctcaagaactcaactgataaaaacagaaactgcggaggtgcacggagacgattacggtggacctggcgagaaaattaccatctgcaatggttcaaccatcgttgatcagaggttaggtagtgaactggggtgttacacaattaacagaataaaatctttcaaactatgcgagaatagtgcccagggcaagaactgtgagatagacagtgcaccagtacaatgcaggcaaggttattgcttgaaaattagtcaagagggaagaggacatgtgaaactttccaggggttcagaaattgttctagatgtttgtgacacaagctgtgagataatgattcctaagggcacaggtgacatcttagtagactgctcaggagggcagcagcattttctacagagcaacttagttgacctgggttgtccgaacattccgctgctgggcaagatggctatttatatttgcagaatgtcaaatcaccctaaaacaaccatggctttccttttttggttcagctttggctacgtgatcacttgtatattgtgcaagacacttttttacatacttataattattgggacattagggaaaaaattaaagcagtacagagagctgaaaccccaaacatgtaccatatgtgaatcagtaccggttaatgcaatagatgctgaaatgcatgacctcaactgcagctacaacatatgcccttattgtgcctccagactcacctcagaggggctcactagacatgtgaaccagtgccccaaaaggaaagagaaggtagaagagacagagttatacctgaacctggaaaggatcccctggattgttaggaagctcctacaggtatctgagtcaacaggtgtggccttaaaaagaagcagctggatgatcgtgctcctcatattactgatagtctctatgtcaccggttcaatctgcaccaataagtcaggagagaacagttgccctctatcaatccagagaagattatatgggcatttgccttgtcataatggggagtgttcttctggcagtctccttgctggttagggggctgattgacagcattagcagtaccttttttcctggattatctgtttgcaggacatgccatatcggtagcataaatggttttgagattgagtctcataagtgctactgtggcctactgtgctgtccttactgtagggcttgctcaactgaccaggatgcccaccagttccatctaagtgtctgtaagaagagaaaggcaggaagcaacgtcatgttggctgtctgtaagcgtatgtgtttcaaggcaattatcgaagccagcaacaaggtcctattcatcagaaatgtcataaacactacttttgttgtatgcatacttgtgatggtggcctgcatagccagttcggccgctgtagagatggaaaacctaccggcaggaacctgggaacgagaagaagagctcacaaacttctgtcatcaagagtgtcaagtgacagaaactgaatgcctctgtccttatgagtctttcatacttaggaaaccactttttttggatagcatagctaaaggtgttaagaacctcttgaactcaacaagcctggaaactagcttgtcaattgaagcaccatggggggccatcaatgcccaatcaacttacaaaccaactgcatcaagtgctaatattgctctaacatggagctcagtggaacacaggggcaacaagatcttggtctcaggcaggtctgaatcaattatgaaacttgaagagaggaccggaataagctggaacttgggcgttgaagatgcttctgagtcaagaacactcaccatctccgtcatggatctatcacagatgtattcccctgtctttgagtacctgtcaggagatcgtcaggtggaggaatggccaaaggcaacctgcactggcaactgcccggagagatgcggctgcacatcgtcaacctgcctttacaaggagtggccacattcgagaaactggagatgcaaccccacctggtgttggggggttgggactggctgcacatgctgtggactagatgtcaaagaactgttcacggatcacatgctagtaaaatggaaagttgagtacatcaagacagaggccatagtgtgtgttgagcttaccagtcaagaaaggcagtgcagtttgattgaagcaggtacgagatttagcttaggaccagtaacaatcaccttgtctgagccaaggaacattcagcagaagcttcctcctgaattaattacattacacccaaagatagaagacggctactttgacttaatgcatgttcaaaaggttatgtccgccagtacagtgtgcaagctgcaaagttgcacacacggtgtgcccggggacttgcaaatttatcatgttggcaatctgttgaagggggacagagtgaatgggcacctgatccacaaggttgagccacacctgaacacatcctggatgtcgtgggatggttgtgacttagactatttctgcaatatgggggactggccctcctgcacatacaccggggtgacacaacacaatcatgccgcatttgcaaatctgcttaacattgaaaccgactatacaaagactttccatttccactccaaaagagtgacggcccatggagacacaccacagctggacttgaaggcaaggcctaggtatggtgcaggtgaaatcactgttctggttgaagtagctgatatggagttacatacaaagaaggtcgaggtaacaggcttaaaatttgcaagcctaacttgttcaggatgctatgcctgtagttcaggtatctcctgcaaggttagaatacatgtggacgagccagatgagctcacagtgcatgtgaaaagcagcgacccagacattgtggcagccagctcaagtctcatggcaaggaagattgagtttggggttgacagtactttcaaagcgttctcctctatgcctaaagattctctgtgcttttatattgtcgaaagagactattgcaacagctgcaaaaatgaggaaacacagaggtgtgtgaacgcaaagcttgaacagccacagagcatcctcatcgaacatacaggtacaatcattggcaagcagaacgacacctgtggatctaggacaagctgctggctagactcatttaaaagtttcttttatggactaaagagcatgttgagcggcatttttggtaatgtctttctaggcatcttcttgtttcttgccccctttgctctgctgctgtttttctttttctttggatggagaatcctgttttgctttaagtgctgtagaagaaccagaggcctgtttaaatacagacacatcaaggacgatgaagaggttggctacaaaaaaatcatcgaaagactgaacaataaaaaaggcaaacacagacttcttgacggcgagagacttgcagataggaagatcgctgaacttttctcaactaagacacacattgga

SEQ ID NO: 3717 - RNA, 3495 nt, synthetic construct
  misc_feature 1..3495: note = derived and/or modified CDS sequence (wt) from CCHVF(CCHVF ArD8194)__DQ211626.1__Gn-NSm-Gc
  source 1..3495: mol_type = other RNA
gcagagggggggagcaatgattgtgtttcaagaacccagctagtcaaaacagaggttgcagaaattcatgaagacagttacggtggtcctggcgaaaaaatcacaatttgcaacggctccacaatagtggatcaaaggcttggcagcgaattaggttgctatacaataaacagagtgagaacctataagctctgtgagaacagtgccacagaaaagagctgtgaaatagacagtgttccagttaaatgcaaacaggggttctgcctcaaaataactcaggaaggtaggggccatgtgaaattgtctagagggacagaaatcgttttggatgtctgtgatactagctgtgaactgatgatacccaaaggcactggggatatattggtggactgctcaggagggcagcaacactttttacaggacaatctaattgacttgggatgcccaaatattccattgctaggtcgaacagctatatatgtttgtagaatgtcaaaccatcccaagacaaccatggcttttctgttttggttcagttttggctatgtcatcacatgtgtagtgtgcaaggtgctcttctatttgctaattgtcatcgggacactaggaaaaaggctgaaacagtacagagagctaaagcctcaaacatgtattgtctgtgaatctatccctgtcaatgcaatagatgctgaaatgcacgatcttaactgcaactacaacatatgcccttactgtgcatccagactgacctcagatggtctcgtcaggcacgtaactcaatgtcccaaacggaaagagaaggtcgaagaaactgaactatacttaaacctggagagaataccttggttggtgagaaaactcctacaagtgtcggagtcaacaggagtggctctaaagagaagctgctggatgatcacactccttattctgctgactgtttcaatgtcaccagttcagtccgcaccagtaggccacaaaagggcagttgaagtctatcaaatgagagaaagctatacaggtatttgcctcttcgtgttaggaagtgttctcttcgcagtctcttggctggtgaaggccctgattgatagcatcggcaatagtttcttcccggggctttccatatgcaagacatgttccattggtagcataaatggatttgaaatagagtcacacaaatgctactgcagtctattttgctgtccttactgtagggcctgctcatcggacaaaatcactcaccgaatgcatttgaatgtgtgcaaaaagagaaaggtgggtagtaatgttatgctagccgtttgcaagcgcatgtgttttaaagcaactattgaagcaagcaacagggctactttcatcagaaacatcataaactccacttttgtcatatgcatactaatcctggtgatctgtgtggttagtacctctgctgtcgacatggaaaatttaccggcaggcatctgggaaaaagaggaagacctaacaaacttctgtcatcaggagtgtcaagtaacagaaactgaatgcctttgcccatatgaggccttaatgcttagaaaaccacttttcttagatagaatagccaagggaatgaaaagcttgttgaactccacaagtttagaaacgagcttgtcaattgaagctccatggggggcaatcaatgttcaatcaactttcaaaccaacagtttcagccgccaatatagcacttagctggagttcagttgaacacaagggcaacaagatcttagtttcaggcagatcagagtcaattatgaaattagaagaaagaactggaatcagctggtgtctaggtgtggaagatgcctctgagtcaaaaacactcaccgtttctgttatggatctgtctcaaatgtattctcctgttttcgagtacctgtcaggtgaccgacaggtggaggagtggccaaaagcaacctgcacaggtgactgtccagaaagatgtggctgcacttcatcaacctgcctgcataaggagtggccgcactcgaggaactggcgctgtaaccccacttggtgttggggggtgggaactggctgcacctgctgtgggctagatgtaaaggatctcttcacagactacatgttggttaaatggaaagtggaatatataaaaacagaagccataatatgtgttgagcttactagtcaagagaggcagtgtagtttaattgaagcaggcacaaggtttaacctaggccctgtgacaataactctatcagaaccaaggaacgtacagcagaggcttcctcccgagatcatcacactgcaccctaaaatagaagaagggttttttgatttgatgcatgtacagaaggtaatgtctgcaagcacggtttgtaagctgcaaagctgtactcatggtgtgcctggagacttacaagtctaccatgttggcaacttgttaaagggggacaaagtcaatgggcactcaatccacaagatagaatcacacctcaacacctcatggatgtcatgggatgggtgtgatttagactatttttgcaacatgggggactggccctcatgcacatacacaggggtgacacaacacaaccatgctgcattcatcaacatgcttaacattgagactgattacacaaaaacctttcactttcattcaaaaagggtcacagcacacggagacacccctcagttggacctaaaagcgagaccagcatatggtgcaggcgaaatcactgttctagtagaagttgcagatttagaactgcacacgaagaaaattgaagtgtcgggtctgaaattcgcaagtttgtcatgctccggatgttatgcttgcagctctggcatctcctgcaaagttaggattcatgtaaatgaaccggatgaattcacagtacatgtaaaaagtaatgacccagatgttgtagcagcaggatcaagtctcatggctagaaagatagagtctggggccgacagcacgtttaaggctttttcatcaatgccaaaaaactctctatgtttttacatagtagaaagagattattgtagcagctgtacagatgatgacactcagaaatgtgttgacattaaacttgaacatccacagagcatactcattgaacacaaaggaacgattattggcaagcagaatgacacctgtccaactaaaacaagctgctggttggaatctattaagagttttttttatgggcttaaaaacatgctgagtgggatcttcggtaatgttttcttaggcatgctcctgtttcttgctccttttatattgctaatattgtttttcttcttcgggtggagacttctcttttgccttaagtgctgtagaaggaccagaaagctgctaaagtataagcaccttagggacgaagaagagagtggttacaaaaaaatcattgaaaggctaaatgacaaaaaaggcaaaagtcgattgtttgatggagaaaggcttgcagacagaaagattgccgaactcttttcaactaaaactcatataggt

SEQ ID NO: 3718 - RNA, 3495 nt, synthetic construct
  misc_feature 1..3495: note = derived and/or modified CDS sequence (wt) from CCHVF(CCHVF ArD15786)__DQ211627.1__Gn-NSm-Gc
  source 1..3495: mol_type = other RNA
gcagagggggggagcaatgactgtgtttcaagaacccagctagtcaaaacagaggttacagaaattcatgaagacagttacggtggtcctggcgaaaaaatcacaatttgcaacggctccacaatagtggatcaaaggcttggcagcgaattaggttgctatacaataaacagagtgagaacctataagctctgtgagaacagtgccacagaaaagagctgtgaaatagacagtgttccagttaaatgcaaacaggggttctgcctcaaaataactcaggaaggtaggggtcatgtgaaattgtctagagggacagaaatcgttctggatgtctgtgatactagctgtgaactgatgatacccaaaggcactggggatatattggtggactgctcaggagggcagcaacactttttacaggacaatctaattgacttgggatgcccaaatattccattgctaggtcaaacggctatatatgtctgtagaatgtcaaaccatcccaagacaaccatggcttttctgttttggttcagttttggctatgtcatcacatgtgtagtgtgcaaggtgctcttctatttgctaattgtcatcgggacactaggaaaaaggctgaaacagtacagagagctaaagcctcaaacatgtattgtctgtgaatctatccctgtcaatgcaatagatgctgaaatgcatgatcttaactgcaactacaacatatgcccttactgtgcatccagactgacctcagatggcctcgtcaggcacgtaactcaatgtcccaaacggaaagagaaggtcgaagaaactgaactatacttaaacttggagagaataccttggttggtaagaaagctcctacaagtgtcggagtcaacaggagtggctctgaagagaagctgctggataatcacactccttattctgctgactgtttcaatgtcaccagttcagtccgcaccggtaggccacaaaagggcagttgaagtctatcaaataagagaaagctatacaggtatttgcctcttcgtgttaggaggtgttctcttcgcagtctcttggctggtgaaggccctgattgatagcatcggcaatagtttcttccctgggctttccatatgcaagacgtgttccattggtagcataaatggatttgaaatagagtcacacaaatgctactgcagtctactctgctgtccttactgtagggcctgctcatcggacaaaatcactcaccgaatgcatttgaatgtgtgcaaaaagagaaaggtgggtagtaatgttatgctagccgtttgcaaacgcatgtgttttaaagcaactattgaagcaaacaacagggctactttcatcagaaacatcataaactccacttttgtcatatgcatactaatcctggtgatctgtgtagttagtacctctgctgtcgacatggaaaatttaccggcaggcatctgggaaaaagaggaagacctaacaaacttctgtcatcaggagtgtcaagtaacagaaactgaatgcctttgcccatatgaggccttaatgcttagaaagccactttccttagatagtatagccaagggaatgaaaagcttgttgaactccacaagtttagaaacgagcttgtcaattgaagctccatggggggcaatcaatgttcaatcaaccttcaaaccaacaatttcagccgccaacatagcacttagctggagttcagttgaacacaagggcaacaagatcttagtttcaggcagatcagagtcaattatgaaattagaagaaagaactggaatcagctggtgtctaggtgtggaagatgcttctgaatcaaaaacactcactgtttctgttatggatctgtctcaaatgtattctcctgttttcgagtacctgtcaggtgaccgacaggtggaggagtggccaaaagcaacctgcacaggtgactgtccagaaagatgtggctgcacttcatcaacctgcctacataaggagtggccgcactcgaggaactggcgctgtaaccccacttggtgttggggggtgggaaccggctgcacctgctgtgggctagatgtaaaggatctcttcacagactacatgttggttaaatggaaagtggaatatataaaaacagaagccataatatgtgttgagcttactagtcaagagaggcagtgtagtttaattgaagcaggcacaaggtttaacctaggccctgtgacaataactctatcagaaccaaggaacgtacagcagaggcttccccccgagatcattacactgcaccctaaaatagaagaagggttttttgatttgatgcatgtgcagaaggtaatgtctgcaagcacggtttgtaagctgcaaagctgtactcacggtgtgcctggagacttacaagtctaccatgttggcaacttgttaaagggggacaaagtcaatgggcactcaatccacaagatagaatcgcacctcaacacctcatggatgtcatgggatgggtgtgatttagattatttttgcaacatgggggactggccctcatgcacatacacaggggtgacacaacacaaccgtgctgcattcatcaacatgcttaacattgagactgattacacaaaaacttttcactttcattcaaaaagggtcacagcacacggagacacccctcagttggacctaaaagcgaggccaacatatggtgcaggcgaaatcactgttctagtggaagttgcagatttagaactacacacgaagaaaattgaagtgtcgggtctgaaattcgcaagtttgacatgctctggatgttatgcttgcagctctggcatctcctgcaaagttaggattcatgtaaatgaaccggatgaattcacagtacatgtaaaaagcaatgacccagatgttgtagcagcaggatcaagtctcatggctagaaagatagagtctggggccgacagcacgtttaaggctttttcatcaatgccaaaaaactctctatgtttttacatagtagaaagagattattgtagcagctgtacagatgatgacactcaaaaatgcgttgacataaaacttgaacatccacaaagcatacttattgaacacaaaggaacgattattggcaagcaaaatgacacctgtccaactaaaacaagctgctggttggaatctatcaagagtttcttttatgggcttaaaaatatgctgagtgggatcttcggtaatattttcttaggcatgctcctgtttcttgctccttttgtattgctaatattgtttttcttcttcgggtggagacttctcttttgccttaagtgctgtagaaggactagaaagctgctaaagtataagcaccttagggacgaagaagagagtggttacaaaaaaatcattgaaaggctaaatgacaagaagggcaaaagtcgattgtttgatggagaaaggcttgcagacagaaagattgccgaactcttttcaactaaaactcatgtaggt

SEQ ID NO: 3719 - RNA, 3495 nt, synthetic construct
  misc_feature 1..3495: note = derived and/or modified CDS sequence (wt) from CCHVF(CCHVF ArD39554)__DQ211628.1__Gn-NSm-Gc
  source 1..3495: mol_type = other RNA
tcagaaagcaacaacaatgattgcgtatcaaggactcagctgatcaagacagaaaatgctgaaatacatggtgatgactatggcgggcccggagagaaaataaccatctgcaacggctctactattgtagaacaaagattaggcagcgaattaggatgctacactatcaacagaataaagtccttcaaactatgcgaaaatagtgcttcaggaaagggttgtgaaattgacagtactccagtaaaatgtaagcaaggcttctgtttgaaaataacccaagaaggaaggggtcatgttaaactttccagaggctcagagataattctagacgtttgcgactcaagctgtgaaatgatgataccaaaagggtctggtgatatcctggtagattgctctggaggacagcagcacttcctacaggacaacttggtcgacttaggatgcccaaacgttcccctactgggcaaaatggccatatacatctgcagaatgtcaaaccaccccaagacaaccatggccttcctcttttggttcagctttggctatgtcataacctgcatcttttgcaaggttatcttttatgtgctaataataattggaacattaggaaaaaggatcaaacagtacagagagcttaagcctcagacctgcactatatgtgaagcaactcctgttaatgcaatagatgctgaaatgcatgatcttaactgtagctacaacatatgcccttattgcgcatctagattaacttcagaaggtctggttaggcatgtgactcagtgtcctaagaggaaggaaaagatagaggaaacagagctgtacttaaatttggaaaggataccctggtttgtcagaaagctcttgcaggtatcagaatcaacaggggtagcgctcaagagaagcagctggctggtgacacttcttgtgttgctaacagtatctttgtcgcctgtgcaatcagcacccattggtcaggaaagaacggtagtaacgtaccaagtcagagaaagttacacaggcatgtgtcttttcatcctaggtagtgtcctttttgcaatctcctggttgacaaagggactggtagacagtgttggtaacattttctttcctggactttcagtttgtaaaacatgttccatcggcagcataaatggctttgaaattgaatcccacaaatgctattgtagccttttctgctgcccttactgtagatactgctcggccgacagaggtgctcaccagtctcatttgagtgtttgtaaaaagaggaaaactggaagcaatgtcatgttagctgtctgcaagcgcatgtgttttagagctactttaaaggtgagcagtgaggctttgattatcaggagcattataaacactacttttgttgtgtgcattctaatattagttgtctgtgttgttagcacctcagccgtagagatggagaacttgccagcaggtacttgggagaaggaagaggacctaacaaacttctgtcaccaagaatgtcaggtaacagaaaccgaatgcctctgtccatacgaggcttttgtgcttagaaagccactttttttggacagtactgccaagagcatgaaaagcctgttaaattcaacaagtttggaaacaagcctgtcaattgaagcaccctggggggcaattaatgtacagtcaactttcaaacccaccgcttcgactgcaaatatagcgctcagttggagctcagtagaacacagaggcaataagattcttgttacaggtagatcagagtcgattatgaaactggaagaaagaacaggaatcagttggaatctcggtgtggaagatgcttctgaatcaaagacactcactgtatcagtcatggacttatctcagatgtattccactgtcttcgagtacttatcaggcgaccggcaagtagaggagtggcctaaagcaacctgcacaggtgattgtccagaaagatgtggctgtacatcatctacttgcctccacaaggcgtggccccattcaaggaactggaggtgcaaccccacgtggtgttggggagttggaactggttgcacttgctgtggattggatgtgaaaaacctctttactgactatatgcttatcaaatggaaagttgaatttataaaaactgaagccatagtgtgtgttgaactcacaagccaggaaaggcaatgcagtcttatagaagcaggcacaagatttaacttgggccctgttaccatcactttatcagaaccaagaaacattcagcagaagctccctcctgaactggttacgctgcatccaagagtagaagaaggcttcttcgaccttatgcatgtgcagaaagtgctttctgcaagcactgtgtgtaaattgcagagctgcacgcatggtgtaccaggtgacttgcaagtgtatcatgtaggcaacttgctgaaaggggataaaataaatggcaactcatttcacaaaattgagccgaacctaaatacatcatggatgtcttgggacggctgtgatcttgattactactgcaacatgggagactggccctcctgtacttacacaggtgtgacgcagcacaaccatgctgcttttgtgaacctgctcaacattgaaactgactatacaaagaacttccactttcactcaaagagagtcacagcacatggagagacgccccagctagaccttaaagccagaccaaagtatggagcaggtgaggtcacagtcctggtggaagttgctgacatggagctgcacactaaaaagattgagatatcaggtttgaaatttgctagcctgacctgcacgggctgctatgcttgtagctcaggtatctcctgcaaggttaggcttcatgtagatgagccagatgagctcacggtacacgtgaagagtgatgatccggatgtagttgcagccagctcaagcctgatggccagaaaaattgaatttggaactgatagcacatttaaagctttctcgtccatgcctaaggataaactctgcttttacattgtggaaagagactactgcagcagttgcagcaaagaggacacacaaaagtgtgtaaatgcaaaacttgagcagcctcagagtatacttattgaacataaaggcaccataattgggaagcaaaatgacacttgtacagtcaaggcgagctgttggttggaatcggtaaaaagttttttttatggactaaaaaacatgttgggtggtatcttcggcaacgttatcttgggcatcatcatgttccttgctccttttgccttgttactgctcttcttccttttcggatggagaattctgttctgccttagatgctgcagaaggactagggggctatttaagtacaaacacatcaaagatgatgaagaatcaggctacaaaaggattattgaaaggttaaataacaagaaaggtaagaacaagttatttgacggcgagagattggcagacaagaaaattgctgaactattctcaacgaagacacacattggc

SEQ ID NO: 3720 - RNA, 3495 nt, synthetic construct
  misc_feature 1..3495: note = derived and/or modified CDS sequence (wt) from CCHVF(CCHVF C-68031)__DQ211629.1__Gn-NSm-Gc
  source 1..3495: mol_type = other RNA
tccgaagagtctggtgatgactgcatatcaagaactcagctatcgaggacagagactgcggaaattcacagtgataactatggtggtccaggtgacaagataaccatctgcaatggttcaactattgtagatcagagattgggcagtgaactagggtgttacactatcaatagagtaaagtcatttaagctttgcgagaacagtgccacaggtaaatcctgtgaaatagatagcaccccaattaaatgcaggcagggtttttgtttaaaaattactcaggagggaaggggccacgtgaagctatcaagaggttcagaagttgtcttggacgcctgtgattcaagctgtgagataatgataccaaagggcactggagacatcctagttgactgttcaggtggacagcaacatttcttaaaagataacttgattgatctgggatgcccaaacatcccactattaggtaagatggctatctacatttgtagaatgtcaaatcatcctaaaacgactatggcttttcttttttggtttagctttggttatgtgataacctgtatactctgtaaggtcatcttctacctattaatagttgtggggacgttgggaaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagacggtcttgccagacatgtaatgcagtgccctaagcggaaggaaaaagtagaagaaaccgaattatacttaaacttagaaagaatcccctgggttgttaggaaattactgcaggtgtcagaatccaccggtgtggcactaaagaggagtagttggctggttgtgctacttgtgttacttacagtttcattgtcaccagtacaatcagcacctatcggccatggaaagacagttgaaacatatcaaaccagagaagggtacacaagcatttgcctttttgtactaggaagcatcttatttatagtctcttgcctaatgaaggggttggttgacagtgttggtaacagttttttccctggtttgtccatttgtaagacatgttctattggcagcataaatggctttgagactgaatctcacaaatgttactgtagcctattttgttgcccctactgtagacactgctctgccgatagagaaatacataagttgcacttgagcatctgcaagaaaaggaagactgggagtaatgtcatgttggccgtctgtaagcgcatgtgctttagggcaactgtggaagtaagcaacaaggctctacttatccgaaacatcatcaataccacttttgttgtgtgcatactgatattagcagtttgtgttgtcagcacctccgcagtggagatggaaagcctgccagctggcacttgggagagagaggaagatctgacaaatttctgtcatcaagaatgccaagtcactgagactgaatgcctctgtccttacgaagctcttgtgctcaggaaacccttgttttcagacagtattgtcaaaggcatgaagaacttgctaaattcaacaagcttagaaacaagcttatcaattgaggcaccatggggagctataaatgtccaatcaaccttcaaacctactgtgtccgctgcgaacatagctcttagttggagctcagtggaacacaggggtaataagattttggtttcaggtagatcagagtcaattatgaagctagaggaaaggacaggaatcagctgggatctaggggtagaagatgcctctgagtctaaattgcttactgtctctattatggacttgtcacagatgtattctcctgtctttgagtacctatcaggtgatagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttgtcaagtggaaagttgagtacattaaaacagaagctatagtgtgtgttgagcttactagccaagagagacaatgtagcttgattgaggcaggcacaagattcaacttaggtcctgtgaccatcacattgtcagagccaagaaacattcagcaaaagctccctccagagatagttacattgcatcccagaattgaagaaggtttctttgatttaatgcatgtaaaaaaagtgctatcagcaagtacagtatgtaagctacagagttgcacacatggtgtgccaggggacctacaggtctaccacataggaaacttgttaaaaggagacaaggtgaatgggcacctgattcacaaaattgaaccacacttcaacacttcctggatgtcttgggacggctgtgacctagactactactgtaatatgggggactggccatcttgctcatatactggagtaacccagcacaatcatgctgcatttgtaaacatgctcaacatcgaaactgattatacaaaaatcttccactttcactctaagagagttactgcacatggagacacaccacaattagatttgaaagctagaccaacttatggtgcaggtgaaatcactgtgctagtggaagttgctgacatggagttacacacaaagaaaattgagatatcaggtttaaagtttgcaagcttaacttgcacaggctgttatgcttgtagctctggtatctcctgtaaggttagaatccatgtagatgagcctgatgagcttacagtacatgtgaagagtgaagacccagacatagttgctgctagctcaagtctcatggctagaaaacttgaatttgggacagatagcacattcaaagccttttcagccatgcccaaaacctccttgtgcttttacattgtggagagagaatattgtaaaagctgcagtaaagaagatacacaaaaatgtgtcaacacaaagcttgagcaaccacagagcattttaattgagcacaaaggaacgataattggtaagcaaaacgacacctgcacatctaaagcaggctgttggctagagtcagtcaagagcttcttttatgggctaaaaaacatgcttagtggcatttttggcaatgttttcatagggattttcttattccttgctccttttatccttttaatacttttctttatgtttggatggagaatcctgttctgctttaaatgttgcagaagaactagaggcctatttaagtacagacacctcaaggacgatgaagaaaccggttacaggaaaatcattgagaggctgaacaacaaaaaagggaaaaacaaactgcttgatggtgaaagattagctgataggaagattgctgagctgttctccacaaagacacacattggc

SEQ ID NO: 3721 - RNA, 3495 nt, synthetic construct
  misc_feature 1..3495: note = derived and/or modified CDS sequence (wt) from CCHVF(CCHVF Drosdov)__DQ211630.1__Gn-NSm-Gc
  source 1..3495: mol_type = other RNA
tctgaagagccaggtgacgactgcatatcaagaactcagctattgaagacagaaacagcagagatccatgacgacaactatggtggtccaggtgacaaaataactatctgcaatggttcaaccattgtggatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaagtaatgatacctaaaggcactggagatatcctagtagactgttcaggtggacagcagcatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttactcattgataattattgggacactagggaaaaaaatcaagcaatatagggagctgaaacctcaaacttgcaccatatgtgagacagctcctgtcaatgcaatagatgctgaaatgcatgacctcaaatgtagttacaatatatgcccttattgtgcatcaagattgacctctgatgggctagctaggcatgtgacacaatgccctaagcgaaaggagaaagttgaggagactgaactgtacttgaacctggaaagaattccttggatagtcagaaagctattgcaagtgtcagagtccactggtgtagcattgaaacgaagcagttggctgattgtgctgcttgtgttactcacagtctcattgtcaccggttcaatcagcacctgttggtcatggtaagacaattgaaacatatcagaccagagaaggattcacaagtatctgtctctttatgttaggaagcatcctattcatagtctcttgcctagtaaaggggctggttgacagtgtcagtgacagcttcttccccggcctgtctgtctgtaagacatgctctattggcagtataaatggctttgaaattgaatcgcataaatgctactgtagtttattttgctgcccctactgtaggcactactctgctgacagagaaattcaccagttgcacttgagtatctgcaaaaaaaggaaaacggggagcaatgtcatgctggctgtctgcaaacgcatgtgctttaaggcaactatagaagcaagcagaagagccctgctcatccgaagtattatcaacaccacttttgtaatatgtattctaatattagcaatctgtgttgttagcacctctgcagtagagatggaaaaccttccagcaggcacttgggagagagaggaagacctgacaaatttctgccaccaggaatgccaggtgaccgagacggaatgcctctgtccatacgaagctcttgtgctcaggaaacctcttttcttagacagtacagttaaaggtatgaaaaatttgctaaactcaacaagcttggaaacaagcttatcaattgaggcaccatggggagcaataaatgtccagtcaacctttaaaccaacagtatcgactgcaaacatagcactcagttggagctcagtggagcacagaggcaacaagatcttggtcacaggcaggtctgaatcaattatgaaactagaggaaaggacaggagtcagctgggatctaggcgtagaagatgcctctgaatccaaattacttaccgtctccatcatggatttgtcacaaatgtattcccctgtttttgagtacttatcaggagatagacaggttgaagaatggcccaaggcaacctgtacaggtgattgcccagaaaggtgtggctgcacatcatcaacctgcttgcataaagaatggcctcactcaagaaactggagatgtaaccccacttggtgctggggagtaggaaccggctgcacatgctgcggagtggatgtaaaagacctttttacagatcacatgtttgtcaaatggaaggttgaatatatgaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtacaaaaagtgttatctgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactattgcaacatggggaattggccttcttgcacatacacaggagtgacccaacataatcatgctgcatttgtaaatttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctggtttgcacgggttgctatgcttgtagctctggcatttcctgtaaagtcagaattcatgtagatgaaccagatgagctcacagtgcatgtaaagagcagtgatccagatgtggttgcagctagcacaagccttatggcaaggaagcttgaatttgggacagatagcatattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggtgcttttctttatgtttggatggaaaatcttgttttgctttaagtgttgcaggaggaccagaggcttgtttaagtatagacacctcaaagacgatgaggaaacaggctacagaaggattattgaaagactgaatagtaaaaaaggaaaaaacagactgcttgatggtgagaggttggctgataggaaaattgctgagctgttctccacaaaaacacacattggc

SEQ ID NO: 3722 - RNA, 3495 nt, synthetic construct
  misc_feature 1..3495: note = derived and/or modified CDS sequence (wt) from CCHVF(CCHVF Kashmanov)__DQ211631.1__Gn-NSm-Gc
  source 1..3495: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtactatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgcactattggcagtataaatggctttgaaattgaatcgcataaatgctactgtagcctattttgctgcccctactgtaggcactgctctgctgacagagaaattcaccagttacacttgagtatctgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaattcgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggataggataaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 3723 - RNA, 3495 nt, synthetic construct
  misc_feature 1..3495: note = derived and/or modified CDS sequence (wt) from CCHVF(CCHVF Oman)__DQ211632.1__Gn-NSm-Gc
  source 1..3495: mol_type = other RNA
tccgaagagtctggtgaagactgtatatcaaggactcagctattgaggacagaaactgcagaaatccatggtgataactatggtggtccaggtgacaaaataaccatctgcaatggttcaaccattgtagatcaaaggctgggtagtgaactggggtgttacactatcaatagggtgaagtcatttaagctatgcgaaaacagtgccacaggtaagtcctgtgaaatagataacactccagtaaaatgcaagcaaggtttttgcttgaaaataacccaagaaggaaggggccacgtgaagctttcaagagactcagaagttgtcctggacgcctgcgattcaagctgtgaaataatgataccaaagggcactggagacatcctggttgactgctcaggtgggcagcagcacttcttaaaagacaacctgattgatctgggatgccccaacatcccattattaggcaaaatggcaatctacatttgtagaatgtcaaatcatcctaaaacaactatggcttttcttttttggtttagctttggttatgtgataacctgcatactttgtaaagtcattttttatctattgatagttgttggaactttagggaaaaagtttaaacagtatagagagttaaaacctcagacctgcacaatatgtgaaacaactcctgtcaatgcaatagatgctgagatgcacgatctcaattgtagttacaatatatgtccttattgtgcatctaggttaacttcagatggtcttgccagacatgtaatgcagtgtcctaagcggaaggaaaaaatagaagaaaccgaattatacctgaacttagaaagaatcccttgggttgtcagaaaactactgcaggtgtcagaatccactggtgtagcactaaagaggagcagttggctgattgtgctacttgtgcttctcacagtttcattgtcaccagtacaatcagcacctatcggtcatgggaagaccatagaaacgtatcaaactagagaagggtacacaagtatttgtctttttgtgctaggaagcattttgtttatagtttctcacctaatgaaggggctggttgacagtgttggtaacagtttttttcctgggttatctatctgcaagacatgctctattggcagtataaatggctttgaaattgaatctcacaaatgtttctgtagcctattttgttgcccctactgtagacactgctctgccgataaagaaatccataagttgcatttgagcatctgcaaaaaaagaaaagctgggagtaatgtcatgttggccgtctgtaagcgcatgtgttttagggcaactatggaagtgagcaacaaggctctactcatccgaagtgtcatcaacactacttttgttgtatgcatactaatattagcagtttgtgttgttagcacctctgcagtagagatggaaagcctgccagctggcacttgggagagagaggaagacctaacaaacttctgccatcaagaatgccaggtcactgaaactgaatgtctctgtccctatgaagctcttgtactcagaaagcccttatttttagacagtattgctaagggcatgaagaacctgctgaattcaacaagcttagaaacaagcttatcaattgaggcaccatggggagcaataaacgttcaatctactttcaaacctactgtgtcaactgcaaacatagcacttagttggagctcagtggaacacagaggtaataagatcttggtttcaggcagatcagagtcaatcatgaagctagaagaaagaacaggaatcagctgggatttgggagtagaagatgcctctgagtccaaattacttactgtttccgtcatggacttatcacagatgtactctcctgtctttgagtacctatcaggtgacagacaagtagaggaatggccaaaggcaacctgtacaggcgattgcccggaaagatgtggctgcacatcatcaacctgcctacacaaggaatggcctcactcaagaaactggagatgcaaccccacttggtgttggggagtcggcaccggatgcacctgttgtggactagatgtaaaggacctttttacagattacatgtttgttaaatggaaggtcgaatatataaaaacagaggctatagtgtgtgttgagcttactagccaagaaagacaatgtagcttgattgaggcaggcacaagattcaacttaggtcctgtgactatcacattatcagagccaagaaacattcagcaaaagctccctccagaaattgtcacattacatcctagaattgaagaaggtttttttgacttaatgcatgtacagaaggtactatcagcaagcacagtgtgcaagctacagagttgcacacatggcgtaccaggagacttacaggtctaccacatcggaaacttactaaaaggagacaaagtgaacgggcatctgatacataaagttgaaccacatttcaacacctcctggatgtcttgggacggctgtgacctagattactactgcaatatgggggattggccctcttgcacgtatactggagttacccaacataatcatgctgcatttgtaaacctacttaacattgaaactgattacacaaagaacttccactttcactctaagagagtcactgcacatggggacactccacaattagatttaaaagccagaccaaattatggtgcaggtgaggtcactgtgctggtggaagttgctgacatggagttacacacaaagaaaattgagatatcaggtttgaagtttgcaagcctaacttgcacaggttgttatgcttgtagctctggcatctcatgtaaggttaggatccatgtagatgaaccagatgagcttacagtacatgtgaagagtgaagacccagacatagttgctgctagctcaagtctcatggcaagaaagcttgaattcgggacggatagtacattcaaagccttctcagccatgcctaaaacctccttgtgcttttacattgttgagagagaatactgtaaaagctgcagtaaagaagacacacaaaagtgtgttaacgcaaagcttgagcgaccacagagcattttaattgagcacaaaggaacgataattggaaagcagaacgacacttgcacagctaaagcaagctgctggctagagtcagtcaagagtttcttttatggactaaagaacatgcttagtggcatttttggcaatgttttcatagggattttcttattccttgctccttttatcctgttaatacttttctttatgtttgggtggagaatcctattctgctttaagtgctgcaggagaactagaggcctatttaagtacagacacctcaaagatgatgaagaaaccggttataggaaaatcattgagagactaaacaacaaaaaaggtaaaaacaagctgcttgacggtgaaagattagctgatagaaagatcgctgagctgttctctacaaaaacacacattggc

SEQ ID NO: 3724 - RNA, 3495 nt, synthetic construct
  misc_feature 1..3495: note = derived and/or modified CDS sequence (wt) from CCHVF(CCHVF SPU97/85)__DQ211633.1__Gn-NSm-Gc
  source 1..3495: mol_type = other RNA
tccgaggagtctgatggtgactgtatatcaagaactcaactattgaggacagagactgcagaaatccacagtgacaactatggtggcccaggtgacaaaataactatctgcaatggttcaactattgtagatcaaagactaggcagtgaactggggtgttatactatcaatagggtaaagtcatttaagctttgcgaaaacagtgccacaggaaaatcttgtgaaatagatagcaccccagttaagtgcagacaaggtttttgcttgaaaatcactcaagaagggaggggccacgtgaagctgtcgagaggctcagaaattgtcttggacgcctgcgattcaagctgtgaaataatgataccaaagggcaccggagacatcttagttgactgttcaggtggacaacaacatttcttaaaagataatttgattgatcttggatgtcccaatatcccattattaggcagaatggccatctacatttgcagaatgtccaatcatcctaaaacaaccatggcctttctcttttggtttagctttggttatgtgataacctgtatcctttgtaaggtgatcttttacctattgatagttgcagggacagtagggaaaaagttcaaacagtatagagagttgagacctcagacctgcaccatatgtgaaacaactcctgtcaatgcaatagatgctgaaatgcatgacctcaactgcagttacaatatatgtccttattgcgcatctagattaacctcagatggtcttgccagacatgtaatgcaatgccccaagcggaaggaaaaaatagaggaaactgaattatacttaaacctagaaaggattccctgggttgttaggaaattattgcaagtttcagagtctaccggtgtggcattgaagaggagcagttggctgacagtgctgcttgtgttgcttatagtttcattgtcaccggtgcagtcagcacctattggtcatggaaagacaattgaaacatatcaggccagagaggggtatacaagcttctgcctttttatactaggaagcatcttgtttatagtctcttgcctagtaaagggtctgattgacagtgtcggtaacagcttcttccctggactgtccatttgcaagacatgctctattggcagtgtaaatggttttgagattgaatcccacaaatgttactgtagtctattttgttgcccttattgtagacactgctctgccgatagagaaatccataagttgcacttgagcatctgcaaaaaaagaaaaactgggagcaatgtcatgttggccgtctgcaagcgcatgtgctttagagcaaccatagaagttagcaatagggctttacttatccggagtatcatcaataccacttttgctgtgtgtatactaacactagcagtttgtgttgtcagcacctctgcagtggagatggaaagtctaccagccggcacctgggagagagaggaagacctaacaaacttctgtcatcaggaatgccaagtcactgagactgaatgcctctgtccttacgaagcccttgtactcagaaaacccttatttttagacagtattgttaaaggcaagaagaacttgctaaactcaacaagcttggaaacaagcttatcaattgaagcaccatggggtgcaataaatgtccaatcaaccttcaaacctactgtgtcagctgcaaacatagcacttagctggagctcagtggaacacagaggcaacaagattttggtttcaggcaggtcagaatcaatcatgaagctggaggaaaggacaggaatcagctgggatctgggagtagaagacgcctctgagtccaaattgctcaccgtctctgtcatggacttgtcacagatgtattcccccgtctttgagtacctgtcaggtgatagacaggtagaagagtggcccaaggcgacctgtacaggcgattgcccagaaagatgtggctgcacatcatcaacctgtttgcacaaggaatggccccattcaaggaactggagatgcaaccccacttggtgttggggggtcggcactggatgcacctgttgtggactagatgtaaaagacctctttacagattacatgtttgtcaagtggaaagttgaatacataaaaacagaggccatagtgtgcgtcgaacttactagccaagaaagacaatgtagcttgattgaagcaggcacaagattcaatttaggtcctgtgactatcacattgtcagagccaagaaacattcagcaaaagctccctccagagataatcacattgcatcctagaattgaagaaggcttttttgacttaatgcatgtgcaaaaagtgctgtcagcaagcacagtgtgcaagctacagagttgcacacatggtgttccaggagacctacaggtctaccacatcggaaacttgttaaaaggagacaaggtaaacgggcatctgattcacaagattgaaccacatttcaacacttcctggatgtcttgggatggctgtgacctagactactactgcaatatgggggactggccttcttgcacatacactggagtaacccaacataaccatgctgcatttgtaaatttgctcaatatcgaaaccgattatacaaaaaactttcattttcactccaagagagttactgcacatggagacacaccacagttagacttgaaggccagaccaacttatggtgcaggggaggtcactgtactagtggaggttgctgacatggagttgcacacaaagaaaattgagatatcaggcttgaagtttgcaagcctatcttgcacaggctgctatgcttgtagctctggtatctcctgtaaggtcaggatccatgtagatgaaccagatgagcttacagtacatgtgaagagtgaagacccagacatagttgctgcaggctcaagtctcatggcaaggaagcttgaatttggggcagatagtacattcaaagccttttcagccatgcccaaaacctccttgtgcttttacattgtggagagagaatactgtaagagctgcagtagagaagacacacaaaaatgtgttaacactaaacttgagcgaccacagagcattttgatcgaacataaaggaacgattattggaaagcaaaacgacacttgcacagctaaagcaagctgctggctagagtcagtcaaaagttttttctacggattaaagagtatgcttagtggcatttttggcaacgttttcatagggattttcttattcattgctccttttgtcctgttaatacttttctttatgtttgggtggaggattctgttctgctttaagtgctgcagaagaaccaggggcctatttaagtacagacacctcaaggacgatgaagaaaccggttacaggaaaatcattgagaggctaaataacaaaaagggaaaaaacaaactacttgatggggaaaggctagctgacaggaaaatcgccgagttattctccacaaaatcacatatcggc

SEQ ID NO: 3725 - RNA, 3495 nt, synthetic construct
  misc_feature 1..3495: note = derived and/or modified CDS sequence (wt) from CCHVF(CCHVF SPU103/87)__DQ211634.1__Gn-NSm-Gc
  source 1..3495: mol_type = other RNA
tccgaggagtctagcgacgactgtatatcaagaactcaactattgaggacagagactgcagagatccacggcgataactatggtggcccaggtgacaagataaccatctgcaatggctcaactattgtagaccagagactgggtagtgagctggggtgttacactatcaatagagtaaagacattcaaactatgcgaaaacagtgctacagggaagagttgtgaaatagatagtgtcccagttaaatgcaggcagggttattgcctaaaaatcactcaggaaggaaggggtcatgtaaaattatctagaggctcagaggttgtcttagatgcatgtgacacaagctgtgaagtaatgatacccaaaggcactggtgacatcctagttgactgttcaggtgggcagcaacattttctgaaagacaatctgatagatctaggatgccccaaaattccattgctgggtaaaatggctatttatatttgcagaatgtcgaatcaccccaaaacaactatggctttcctcttctggttcagctttggctatgtgataacttgtgtactttgcaaggccattttttacttgttaataattgttggaacactaggaaaaaggctcaagcagtacagagagttaaaacctcagacctgcaccatatgtgagacaactcctgtgaatgcaatagatgctgagatgcatgacctcaattgcagttacaacatatgtccctattgtgcatctagactaacctcagacgggcttgctaggcatgtgacacagtgccctaagcggaaggaaaaagtggaggaaactgaattgtacttgaacttggaaagaattccttgggttgtgagaaggctgttgcaggtatcagagtccactggtgtggcattgaaaagaagcagctggctgattgtgctactggtgctgttcacggtttcattgtcaccggttcagtcagcgcccattagtcatgggaagacagttgaggcataccaggccagagaggggtacacaggcatgtgtctctttgtgctgggaagtatcctgtttttagtctcttgtctaatgaaaggactggttgacagtgtcggcaacaccttcttccctggactgtccatttgcaaaacgtgctctataagcagcattaatggctttgaaattgagtcgcataggtgctattgcagcttgttttgttgcccatactgtagacactgctctgctaataaagaaattcatcagctgcacttgagcatctgcaaaaaaaggaaaacaggaagcaatgtcatgctggctgtctgcaagcgcatgtgctttagggccaccatggaagtaagcaacagagccctgtttatccgtagcatcatcaacaccacttttgttttatgcatactgatactagcagtttgtgttgttagcacctcagcagtggagatggaaagcctaccagccggaacctgggagagagaagaagacctaacaaatttctgtcatcaggaatgccaagttacggatactgaatgcctctgcccttatgaggctctagtgctcagaagacccctattcttagataatatagttaaaggcatgaaaaatttgctaaactcaacaagtttggagacaagtttatcaattgaggcaccatggggagcaataaatgttcagtcaacctacaaaccaactgtatcaactgcaaacatagcgcttagttggagctcagtagaacacagaggcaataagatactggtttcgggcagatcagaatcaattatgaagctggaagaaaggacaggaataagctgggatctcggtgtagaagacgcctctgagtctaaactgcttacagtctctgtcatggacttgtcacagatgtactcacctgtcttcgagtacttatcaggagacagacaggtggaagagtggcccaaagcaacttgtacgggtgattgcccagaaagatgtggctgcacatcatcaacctgcttacataaagaatggccccattcaaggaattggagatgtaaccccacttggtgctggggtgtagggactggctgcacctgttgtggattagacgtgaaagacctctttacagattatatgtttgtcaagtggaaaattgaatacattaaaacagaagcaatagtgtgtgtagaacttactagtcaggaaagacagtgtagcttgattgaagcgggcacaaggttcaatttgggtcccgtgaccatcacattgtcagaaccaagaaacatccagcaaaagctcccttctgaaataatcacactgcatcccaggattgaggagggtttttttgacctgatgcatgtacaaaaagtgttgtcggcaagcacagtgtgtaagttgcagagttgcacacatggtgtgccaggagatctacaggtctaccacatcggaaatttattaaaaggggataaggtaaatggacacctagttcataaaattgagccacacttcaatacttcttggatgtcctgggatggttgtgatctagactattattgcaacatgggagattggccttcttgcacatacacaggagttacccagcacaatcatgcttcatttgtaaacctgctcaacattgaaactgattacacaaaaaacttccactttcactctaaaagggtcactgcacacggagacacaccacaactggatcttaaggcaagaccaacctatggtgcaggtgagatcactgtattggtggaagttgctgacatggagttacacacaaagaagattgaaatatcaggcttaaaatttacaagcctgacttgtacaggctgttatgcttgtagttctggcatctcatgcaaagttagaattcatgtggatgaaccagatgaacttacagtgcatgttaaaagtgatgatccagatgttgttgcagctagctcaagtctcatggcaagaaagcttgaatttggaacagacagtacatttaaggctttttcagccatgcctaaaacttctctatgtttctacattgtggaaagagaatactgtaagagctgcagtgaagaagacacacaaaaatgtgttaacacaaaacttgagcagccacagagcattttgatcgaacataagggtactataatcgggaagcaaaacaacacttgcaaggctagggcgggttgctggttagagtcagttaagagttttttttacggcctaaagaacatgctcagtggcatttttggcaatgtatttataggcattttcttatttcttgcccccttcatcctattaatactattctttatgtttgggtggaggatcttgttttgttttaagtgttgtagaagaactagaggcctgttcaagtatagacacctgaaagacgatgaagaaactggttatagaaagatcattgaaagactaaacaacaaaaaagggaaaaataaactgcttgatggtgaaagacttgctgatagaagaattgccgaactgttctctacaaaaacacacattggc

SEQ ID NO: 3726 - RNA, 3495 nt, synthetic construct
  misc_feature 1..3495: note = derived and/or modified CDS sequence (wt) from CCHVF(CCHVF SPU415/85)__DQ211635.1__Gn-NSm-Gc
  source 1..3495: mol_type = other RNA
tccgaggagtctgatggtgactgtatatcaagaactcaactattgaggacagagactacagaaatccacagtgacaactatggtggcccaggtgacaaaataactatctgcaatggttcaactattgtagatcaaagactaggcagtgaactggggtgttatactatcaatagggtgaagtcatttaagctttgcgaaaacagtgccacaggaaaatcttgtgaaatagatagcaccccagttaagtgcagacaaggtttttgcttgaaaatcactcaagaagggaggggccacgtgaagctgtcgagaggctcggaaattgtcttggacgcttgcgattcaaactgtgaaataatgataccaaagggcaccggagacatcttagttgactgttcaggtggacaacaacatttcttaaaagataatttgattgatcttggatgtcccaatatcccattattaggcaaaatggccatctacatttgcagaatgtccaatcatcctaaaacaaccatggcctttctcttttggtttagctttggttatgtgataacctgtatactttgtaaggtgatcttttacctattgatagttgcagggacagtaggaaaaaagttcaaacagtatagagagttgagacctcagacctgcaccatatgtgaaacaattcctgtcaatgcaatagatgctgaaatgcatgacctcaactgcagttacaatatatgtccgtattgcgcatctagattaacctcagatggtcttgccagacatgtaatgcaatgccctaagcggaaggaaaaagtagaggaaactgaattatacttaaacctagaaaggattccctgggttgttaggaaattattgcaagtttcagagtctaccggtgtggcattgaagaggagcagttggctgacagtgctgcttgtgttgcttatagtctcattgtcaccggtgcagtcagcacctattggtcatggaaagacaattgaaacatatcaggccagagaagggtacacaagcttctgcctttttatactaggaagcatcttgtttgtagtctcttgcctagtaaagggtctaattgacagtgtcggtaacagctttttccctggattgtccatttgcaagacatgctcgattggcagtataaatggttttgagattgaatcccacaaatgttactgtagtctattttgttgcccttattgtagacactgctctgccgatagagaaatccataagttgcacttgagcatctgcaaaaaaagaaaaactgggagcaatgtcatgttggccgtctgcaagcgcatgtgctttagagcaaccatagaagttagcaatagggctctacttatccggaatatcatcaatactacttttgttgtgtgtatactgacactagcagtttgtgttgtcagcacctctgcagtggagatggaaagtctaccagccggcacttgggagaaagaggaagacctaacaaacttctgtcatcaggaatgccaagtcactgagactgaatgcctctgtccttacgaagcccttgtactcagaaaacccttatttttagacagtattgttaaaggcatgaagaacttgctaaactcaacaagcttggaaacaagcttatcaattgaggcaccatggggtgcaataaatgtccaatcaaccttcaaacccactgtgtcagctgcaaacatagcacttagctggagctcagtggaacacagaggcaacaagattttggtttcaggcaggtcagaatcaatcatgaagctggaggaaaggacaggaatcagctgggatctgggagtagaagacgcctctgagtccaaattgctcaccgtctctgtcatggacttgtcacaaatgtattcccccgtctttgagtacctgtcaggtgatagacaggtagaagagtggcccaaggcgacctgtacaggcgattgcccagaaagatgtggctgcacatcatcaacctgtttgcacaaggaatggccccattcaaggaactggagatgcaaccccacttggtgttggggggtcggcactggatgcacctgttgtgggctagatgtaaaagacctctttacagattacatgtttgtcaagtggaaagttgaatacataaaaacagaggccatagtgtgtgtcgaacttactagccaagaaaggcaatgtagcttgattgaagcaggcacaagattcaatttaggtcctgtgactatcacattatcggagccaagaaacattcagcaaaagctccctccagaaataattacattgcatcctagaattgaagaaggcttttttgacttaatgcatgtgcaaagagtgctgtcagcaagcacagtgtgcaagctacagagttgcacacatggtgtgccaggagacctacaggtctaccacatcggaaacttgttaaaaggagacaaggtaaacgggcatctgattcacaagattgaaccacatttcaacacttcctggatgtcttgggatggctgtgacctagattactactgcaatatgggggattggccttcttgcacatacactggagtaacccaacataaccatgctgcatttgtaaatttgctcaatatcgaaaccgattatacaaaaaactttcattttcactccaagagagttactgcacatggagacacaccacaattagacttgaaggccagaccaacttatggtgcaggggaggttactgtactagtggaggttgctgacatggagctgcacacaaagaaaattgagatatcaggcttgaagtttgcaagtctaacttgcacaggctgctatgcttgtagctctggtatctcctgtaaggtcaagatccatgtagatgaaccagatgagcttacagtacatgtgaagagtgaagacccagacatagttgctgcaggctcaagtctcatggcaaggaagcttgaatttggggcagatagtacattcaaagccttttcagccatgcccaaaacctccttgtgcttttatattgtggagagagaatactgtaagagctgcagtagagaggacacacgaaaatgtgttaacactaagcttgatcgaccacagagcattttgatcgaacataaaggaacgattattggaaagcaaaacaacacatgcacagctaaagcaagctgctggctagagtcagtcaaaagttttttctacggattgaagaatatgcttagtggcattttcggtaatgttttcatagggattttcttattcattgctccttttgtcctgttaatacttttctttatgtttgggtggaggatcctgttctgctttaagtgctgcagaagaaccagaggcctatttaagtacagacacctcaaggacgatgaagaaaccggttacaggaaaatcattgagaggctaaataacaaaaagggaaaaaacaaactacttgatggggaaaggctagctgataggaaaatcgccgagttattctccacaaaatcacatatcggc

SEQ ID NO: 3727 - RNA, 3495 nt, synthetic construct
  misc_feature 1..3495: note = derived and/or modified CDS sequence (wt) from CCHVF(CCHVF Turkey200310849)__DQ211636.1__Gn-NSm-Gc
  source 1..3495: mol_type = other RNA
tccgaagagccaggtgatgactgcatatcaagaactcagctattgaggacagaaacagcagagatccatgatgacaactatggtggtccaggtgataaaataactatctgcaacggttcaaccattgtagatcagagactgggcagtgaactagggtgttataccatcaacagggtgaagtcattcaagctatgcgaaaacagcgccacagggaaaacctgtgaggtagacagcactccggttaagtgcaggcaaggtttttgtttaaaaatcacccaagagggaaggggccacgtaaaattatctagaggctcagaggttgtcctggatgcttgcgactcaagctgtgaagtaatgatacctaaaggcactggggatatcctagtggactgttcaggtgggcagcaacatttcttaaaagacaacttaattgacctagggtgcccccatatcccgctattgggtaagatggctatttacatttgcagaatgtcaaatcatcctagaacaaccatggcttttctcttctggttcagctttggctatgttatcacctgtatatcttgcaaggctcttttttattcattgataattattggaacactaggaaaaaagatcaagcaatatagggaactgaaacctcaaacctgcaccatatgtgagacagctcctgtcaatgcaatagatgctgaaatgcatgacctcaactgtagttacaatatatgcccttattgtgcatcaagattgacctccgatgggctagccaggcatgtaacgcaatgccccaagcggaaagagaaggttgaagagactgaactgtacctgaacctggaaagaattccttggattgtcagaaagctattgcaggtgtcagagtccactggtgtggcattaaaacgaagcagctggctgattgtactgcttgtgttactaacagtttcattgtcaccggttcaatcagcacctgttggtcatggaaagacaatcgaaatatatcagaccagggaaggattcgcaagcatctgtctctttatgttaggaagcattctatttatagtctcttgcttggtgaaagggctagttgacagtgtcagtgacagcttcttccccggcctatctgtctgtaagacatgctctattggcagtgtaaatggctttgaaattgaatcgcacaaatgctactgtagcctattttgctgcccctactgcaggcactgctctgctgacagagaaattcaccagttacacttgagtatctgcaaaaaaaggaaaacggggagcaatgtcatgctggccgtctgcaaacgcatgtgctttagggcaaccatagaagcaagcagaagagccctgctcatccgaagcattatcaataccacttttgtaatatgcattctaacattgacaatctgtgttgttagcacctctgcagtggagatggaaaaccttccagcaggaacttgggagagggaggaagatctgacaaatttctgtcatcaggaatgccaggtaactgagacagaatgcctctgtccatacgaagctcttgtgctcagaaaacctcttttcttggacagtatagttaaaggtatgaaaaatttgctaaactcaacaagcttggaaacaagcttatcaattgaggcaccatggggagcaataaatgtccagtcaacctttaaaccagctgtatcgactgcaaacatagcactcagttggagctcagtggagcacagaggcaacaagatcttagtcacaggcaggtctgaatcaattatgaaactggaggaaaggacaggagtcagctgggatctaggtgtagaagatgcctctgaatccaaattacttaccgtttctatcatggatttgtcacaaatgtattctcctgtttttgagtacttgtcaggagacagacaggttgaagaatggcccaaagcaacttgtacaggtgattgcccggagaggtgtggttgcacatcatcaacctgcttacataaagaatggcctcactcaagaaactggagatgtaatcccacttggtgctggggagtaggaaccggctgcacctgctgcggggtggatgtaaaagatctttttacagatcacatgtttgtcaaatggaaagttgaatacataaaaactgaagctatagtatgtgttgaactcaccagccaagaaagacagtgcagtctgattgaggcaggtactagattcaacttgggccctgtgactattaccctgtctgagccaagaaacattcagcagaagcttcctcctgagattatcacgttgcatcccaaaattgaagaaggcttctttgacttgatgcatgtacaaaaagtgttgtctgcaagtacagtgtgtaaactgcagagttgcacacatggtataccaggagatctacaagtttaccacattggcaacttgttgaaaggggatagagtaaacgggcatctaattcacaaaattgaatcacatttcaacacctcttggatgtcctgggatggttgtgacttagactactactgcaacatgggggattggccatcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgaaatatcaggcttgaaatttgcaagtctggcttgcacgggttgctatgcttgtagctctggcatctcctgtaaagttagaattcatgtagatgaaccagatgagctcacagtacatgtaaagagcagtgatccagatgtggttgcagctagcacaagtctcatggcgaggaagcttgaatttgggacagacagcacattcaaggccttttcagctatgcccaaaacctctttatgtttttacattgtggagagagaatactgcaagagctgcagtgaagatgatacacaaaaatgtgttgacacaagacttgagcagccacagagcatactaattgagcacaaaggaacgataattggaaagcagaatgatacttgcacagccaaggcaagctgttggttagagtcagtcaagagttttttttatggattgaagaatatgcttggcagtgtttttggtaatcttttcataggcattttgttattccttgccccttttgtcctgttggtgcttttctttatgtttgggtggaaaatcttgttttgctttaaatgttgcaggaggaccagaggcttatttaagtatagacacctcaaagacgatgaggaaacaggctacagaaggattattgaaagactgaacagcaaaaaagggaaaaacaggctgcttgatggtgatagactggctgataggaaaattgctgagctgttctccacaaaaacacacattggc

SEQ ID NO: 3728 - RNA, 3495 nt, synthetic construct
  misc_feature 1..3495: note = derived and/or modified CDS sequence (wt) from CCHVF(CCHVF Iran-52)__DQ446215.1__Gn-NSm-Gc
  source 1..3495: mol_type = other RNA
tccgaagaatctggtgatgactgcatatcaagaactcagctattgaggacagagactgcagaggtccatggcgataactatggtggtccaggtgataagataaccatctgtaatggttcaactgttgtagatcaaagactgggtagtgaactggggtgttacactatcaatagagtgaggtcattcaagctatgcgaaaacagtgccacagggaagagctgtgaaatagacagtatcccagtcaagtgtaagcagggttattgcctaaaaatcactcaggaaggaaggggccatgtgaagttatctagaggctcagaagttgtcttggatgtatgtgattcaagctgtgaagtgatgatacctaagggcactggtgacattctagtagattgttcaggtgggcagcaacattttttaaaagacaacctggttgacctagggtgtcccaaaattccgttactgggcaaaatggctatttatatctgcaggatgtcgaatcaccccaagacaaccatggccttcctcttttggttcagctttggctatgtgataacttgtatactttgcaaggccatttttttcttattaataatttttggaacactagggaaaaggttcaagcagtacagagagttgaaaccccagacctgcaccatatgtgagacaacacctgtaaatgcaatagatgctgaaatgcatgatctcaactgcagttacaatatatgtccctattgtgcgtctagactgacttcagatgggcttgctaggcatgtgacacaatgtcctagacggaaggagaaagtggaggaaaccgaattatacctgaatttagagagaattccctgggttgtaagaaagctattgcaggtgtcagagtccactggtacagtattaaaaaggagcagctggctaattgtattacttgtgctgttcacagtttcattgtcaccagttcaatcagcacccattggtcacgggaaaacaattgaaacataccgggttagggaagaatacacaagtatttgcctctttgtactaggaagtatcctgtttatagtctcttttctaatgaaaggactggttgacggtgttggcaacatcttctttcctgggctgtccgtctgtaagacatgctctataggtagcattaatggctttgaaattgagtctcataagtgctactgtagcttgttttgttgcccttactgtaggcactgctctgctgatggagaaatccatcagctgcacttgagcatctgcaaaaaaaggaaaacaggaagtaatgttatgctggctgtttgcaaacgcatgtgtttcagggcaactatggaagtaagcaacaaggccctatttatccgtagcattatcaacaccacttttgttgtgtgcatactgatactagcggtttgtgttgttagcacctcagcagtagagatggaaagcctaccagctgggacctgggaaagagaagaagacctaacaaatttctgccatcaggaatgccaggtcacagagactgagtgcctctgcccttatgaagctctagtgctcagaaggcccctatttctagatagtatagtcaaaggtatgaaaaatctgctaaactcaacaagtctagaaacaagcttatcaattgaggcaccatggggagcaattaatgttcagtcaacctacaaaccaactgtatcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagtcatggacttgtctcagatgtactctcctgtcttcgagtacttatcaggtgacagacaagtggaagagtggcctaaagcaacctgcacaggtgactgcccagaaagatgtggctgcacatcatcaacctgcttacacaaagagtggccccactcaaggaattggagatgtaatcctacttggtgctggggtgtagggactggctgcacctgttgtggtttagatgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagaaccaaggaacattcaacaaaagctccctcctgaaataatcacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacctgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacagctagatctgaaggcaaggccaacctatggtgcaggtgagatcaccgtgctggtggaagttgctgacatggagttacacacaaagaagattgaaatatcaggcttaaaatttgcaggcctaacttgcacaggttgttatgcttgtagttctggcatctcttgtaaagttagaattcatgtagaggaaccagatgaacttacagtacatgttaaaagtgatgacccagatgtagttgcagctagctcaagtctcatggcgaggaagcttgagtttggaacagacagtacatttaaagctttctcagccatgcctaaaacctccctatgtttctacattgtggaaagagaatactgtaagagctgcagtaaagaagatacacaaaaatgtgttaacacgaaactcgaacaaccacagagcattttgatcgaacataagggaactataattggaaagcaaaacaatacttgcacggctaaagcgagttgctggttagagtcagttaagagttttttttatggtctgaagaatatgctcggtggcatatttggcaatgtttttataggcattttcacatttcttaccccctttatcttgttaatacttttctttatgtttgggtggaggatcctgttttgcttcaagtgttgcagaagaaccagaggcctattcaagtacagacacctcaaagacgatgaagaaactggttacagaaagatcattgaaagactgaacaacaaaaagggaaaaaacaggctgcttgatggtgaaagacttgctgacagaaagattgctgaactgttctccacaaaaacacacattggc

SEQ ID NO: 3729 - RNA, 3495 nt, synthetic construct
  misc_feature 1..3495: note = derived and/or modified CDS sequence (wt) from CCHVF(CCHVF Iran-53)__DQ446216.1__Gn-NSm-Gc
  source 1..3495: mol_type = other RNA
tccgaagaatctggtgatgactgcatatcaagaactcagctattgaggacagagactgcagaggtccatggcgataactatggtggtccaggtgataagataaccatctgtaatggttcaactgttgtagatcaaagactgggtagtgaactggggtgttacactatcaatagagtgaggtcattcaagctatgcgaaaacagtgccacagggaagagctgtgaaatagacagtatcccagtcaagtgtaagcagggttattgcctaaaaatcactcaggaaggaaggggccatgtgaagttatctagaggctcagaagttgtcttggatgtatgtgattcaagctgtgaagtgatgatacctaagggcactggtgacattctagtagattgttcaggtgggcagcaacattttttaaaagacaacctggttgacctagggtgtcccaaaattccgttactgggcaaaatggctatttatatctgcaggatgtcgaatcaccccaagacaaccatggccttcctcttttggttcagctttggctatgtgataacttgtatactttgcaaggccatttttttcttattaataatttttggaacactagggaaaaggttcaagcagtacagagagttaaaaccccagacctgcaccatatgtgagacaacacctgtaaatgcaatagatgctgaaatgcatgatctcaactgcagttacaatatatgtccctattgtgcgtctagactgacttcagatgggcttgctaggcatgtgacacaatgtcctagacggaaggagaaagtggaggaaaccgaattatacctgaatttagagagaattccctgggttgtaagaaagctattgcaggtgtcagagtccactggtacagtgttaaaaaggagcagctggctaattgtattacttgtgctgttcacagtttcattgtcaccagttcaatcagcacccattggtcacgggaaaacaattgaaacataccgggttagggaagaatacacaagtatttgcctctttgtactaggaagtatcctgtttatagtctcttttctaatgaaaggactggttgacggtgttggcaacatcttctttcctgggctgtccgtctgtaagacatgctctataggtagcattaatggctttgaaattgagtctcataagtgctactgtagcttgttttgttgcccttactgtaggcactgctctgctgatggagaaatccatcagctgcacttgagcatctgcaaaaaaaggaaaacaggaagtaatgttatgctggctgtttgcaaacgcatgtgtttcagggcaactatggaagtaagcaacaaggccctatttatccgtagcattatcaacaccacttttgttgtgtgcatactgatactagcggtttgtgttgttagcacctcagcagtagagatggaaagcctaccagctgggacctgggaaagagaagaagacctaacaaatttctgccatcaggaatgccaggtcacagagactgagtgcctctgcccttatgaagctttagtgctcagaaggcccctatttctagatagtatagtcaaaggtatgaaaaatctgctaaactcaacaagtctagaaacaagcttatcaattgaggcaccatggggagcaattaatgttcagtcaacctacaaaccaactgtatcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagtcatggacttgtctcagatgtactctcctgtcttcgagtacttatcaggtgacagacaagtggaagagtggcctaaagcaacctgcacaggtgactgcccagaaagatgtggctgcacatcatcaacctgcttacacaaagagtggccccactcaaggaattggagatgtaatcctacttggtgctggggtgtagggactggctgcacctgttgtggtttagatgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagaaccaaggaacattcaacaaaagctccctcctgaaataatcacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacctgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacagctagatctgaaggcaaggccaacctatggtgcaggtgaggtcaccgtgctggtggaagttgctgacatggagttacacacaaagaagattgaaatatcaggcttaaaatttgcaggcctaacttgcacaggttgttatgcttgtagttctggcatctcttgtaaagttagaattcatgtagatgaaccagatgaacttacagtacatgttaaaagtgatgacccagatgtagttgcagctagctcaagtctcatggcgaggaagcttgagtttggaacagacagtacatttaaagctttctcagccatgcctaaaacctccctatgtttctacattgtggaaagagaatactgtaagagctgcagtaaagaagatacacaaaaatgtgttaacacgaaactcgaacaaccacagagcattttgatcgaacataagggaactataattggaaagcaaaacaatacttgcacggctaaagcgagttgctggttagagtcagttaagagttttttttatggtctgaagaatatgctcggtggcatatttggcaatgtttttataggcattttcacatttcttaccccctttatcttgttaatactcttctttatgtttgggtggaggatcctgttttgcttcaagtgttgcagaagaaccagaggcctattcaagtacagacacctcaaagacgatgaagaaactggttacagaaagatcattgaaagactgaacaacaaaaagggaaaaaacaggctgcttgatggtgaaagacttgctgacagaaagattgctgaactgttctccacaaaaacacacattggc

SEQ ID NO: 3730 - RNA, 3495 nt, synthetic construct
  misc_feature 1..3495: note = derived and/or modified CDS sequence (wt) from CCHVF(CCHVF Kosova Hoti)__EU037902.1__Gn-NSm-Gc
  source 1..3495: mol_type = other RNA
tccgaagagccaggtgatgattgcatatcaaggactcagctattgaggacagaaacagcagagatccatgacgataactatggtggtccaggtgacaaaataactatctgcaatggttcaaccattgtagatcagagactgggcagtgaactagggtgttacaccatcaacagggtgaagtcattcaagctatgcgaaaacagcgccacagggaaaacctgtgagatagacagcactccagttaagtgcaggcaaggtttttgtttaaaaatcacccaaaagggaaggggccacgtaaaattatctagaggctcagaggttgtcttggacgcttgcgactcaaactgtgaagtaatgatacctaaaggcactggagatatcctagtggactgttcaggtggacagcagcatttcttaaaagacaacttgattgacctggggtgccctcatatcccactattgggtaagatggccatttacatttgcagaatgtcaaatcatcctaaaacaaccatggcttttctcttctggttcagctttggttatgtgatcacctgtatattttgcaaggctcttttttattcattgataattattgggacactaggaaaaaagatcaagcaatatagggaactgaaacctcaaacttgcaccatatgtgaaacagctcctgtcaatgcaatagatgctgaaatgcatgacctcaactgtagttacaatatatgcccttattgtgcatcaagattgacctccgatgggctagctaggcatgtaaagcaatgccctaagcgaaaggagaaagtcgaggagactgagctgtacctgaacctggaaagaattccttgggtcgtcagaaagctattgcaagtgtcagagtccactggtgtggcattgaaacgaagcagttggctgattgtgctgcttgtgttactcacagtttcattgtcaccggttcaatcagcacctgttggtcatggtaagacgatcgaaacatatcagaccagagaaggattcacaagtatttgtctctttatgttaggaagcatcctattcatagtctcttgcttggtgaaagggctggttgacagtgtcagtgacagcttcttccccggcctgtctgtctgcaagacatgctccattggcagtataaatggctttgaaattgaatcgcataaatgctactgtagcttattttgctgcccctattgtagacactgctctgctgacagagaaattcaccaattgcacttgaatatctgcaaaaaaagaaaaacggggagcaatgtcatgctagctgtctgcaagcgcatgtgctttagggcaaccatagaagcaagcagaagagccctgctcatccgaagtattatcaataccacttttgtaatatgcattctaacattaacaatctgtgttgttagtacctctgcagtagagatggaaaaccttccagcaggcacctgggagagagaggaagacctgacaaatttttgtcatcaggaatgccaggtaaccgagacggaatgcctttgtccatacgaagctcttgtgctcaggaaacctcttttcttagacagtatagtcaaaggtatgaaaaatttgctaaactcaacaagcttagaaacaagcttatcaattgaggcaccatggggagcaataaatgtccagtcaaccttcaaaccaacagtgtcgactgcgaacatagcactcagttggagctcagtggaacacagaggcaacaagatcttagtcacaggcaggtctgagtcaattatgaaactagaggaaaggacaggaatcagctgggatctaggcgtagaagatgcctctgaatccaaattacttaccgtctctatcatggatttgtcacagatgtattccccagtttttgagtacttgtcaggggacagacaggttgaagaatggcccaaagcaacttgcacaggtgactgcccacaaaggtgtggctgcacatcatcaacctgcttgcataaagaatggcctcattcaagaaactggagatgtaatcccacttggtgctggggagtgggaactggctgcacctgctgcggggtggatgtaaaagacctttttacagatcacatgtttgtcaaatggaaggttgaatatataaaaactgaagccatagtgtgtgttgagctcaccagccaagaaagacagtgcagtctgattgaggcaggtactagattcaacttgggccctgtgactattaccctgtctgagccaagaaacattcagcagaagctcccccctgagatcattacgttgcatcccaaaattgaggaaggcttctttgacttgatgcatgtacaaaaagtgttgtccgcaagtacagtgtgtaaactgcagagttgcacacatggtataccaggagatctacaagtttaccacattggcaatttgttgaaaggggatagagtgaacgggcatctaattcacaaaattgaaccacatttcaacacctcttggatgtcctgggatggttgtgacttagactactactgcaacatgggggactggccttcttgtacatacacaggagtgacccagcataatcatgctgcatttgtaaacttgctcaacattgaaactgattacacaaaaaccttccacttccactctaaaagagtcacagcacatggtgacacaccacaattggacttaaaagcaaggccgacctacggtgcaggagagatcactgtgctggttgaggttgctgacatggagttgcataccaagaaagttgagatatcgggcttgaaatttgcaagtctggcttgcacaggttgctatgcctgtagctctggtatctcctgtaaagtcaggattcatgtagatgaaccagatgagctcacagtgcatgtaaagagcagtgatccagatgtggttgcagctggcacaagcctcatggcaaggaagcttgaatttgggacagacagcacattcaaggccttttcagctatgcccaaaacctctttatgtttttacattgtggagaaagaatactgcaagagctgcagtgaagatgatacaaaaaaatgtgttgacacaaaacttgagcagccacagagcatactaattgagcacagagggacgataattggaaagcagaatgatacttgcacagccaaggcaagctgttggctagagtcagtcaagagttttttttatggattgaagaatatgcttggcagtgtttttggtaattttttcataggtattttgttattccttgccccttttgtcctgttggtgcttttctttatgtttggatggaaaatcttgttttgctttaaatgttgcaggaggaccagaggcttgtttaagtatagacacctcaaagacgatgaggaaacaggctacagaaggattattgaaaggctgaacaacaaaaaagggaaaaatagactgcttgatggtgaaaggttggctgataggaaaattgccgagctgttttccacaaaaacacacattggc

SEQ ID NO: 3731 - RNA, 3495 nt, synthetic construct
  misc_feature 1..3495: note = derived and/or modified CDS sequence (wt) from CCHVF(CCHVF YL04057)__FJ562094.1__Gn-NSm-Gc
  source 1..3495: mol_type = other RNA
gcagaaggaggaagcagtgactgcatttcaagaactcagctagttaaaacagaggttgcagaaattcatgaggacagttacggtgggcctggtgagaaaataacaatctgcaatggttccacaattgtagatcaaaggcttggtagggaattgggctgttatacaatcaacagagtaagatcctacaagctatgcgagaacagtgcctcagggaaaagctgtgaaatagatagcatcccagtcaaatgcaaacaagggttttgcctcaaaataacccaagaaggaagaggtcatgtaaaactgtccagagggacagaaattgttctagatgtctgtgattccagctgtgagctgatgatacctaagggcactggagacattttagtggattgctcaggagggcagcagcattttttacaaaacaatctgattgacttgggatgccccaatgtcccactactgggtaaaatggccatatatgtctgcaggatgtcaaaccacccaaaaactaccatggcatttctgttctggttcagctttggctatgtcattacatgtatagcatgcagggtactcttctacttgctgattgccatcggaacagtagggaaaaagctaaaacagtatagagagctgaaaccacaaacatgcattgtttgtgaatctgtccctgttaatgcaatagatgctgaaatgcatgagcttaattgcagttacaatatatgcccatactgtgcatctagactgtctacagacgggctcatcaggcacgtaactcagtgtcccaaacggagggagaaggtggaagagactgagctattcttgaacttggaaagaataccttggctggtgagaaagctccttcaagtatcagagtcaacaggaatggctctaaagaggagctgttggatgatcacactcctcattctactattggtttcgatatcaccagtccaatctgcaccggtaggcaaagagagggcaatcgagacctatcaagcaagagaaacctacacaggcatatgcctctttgtgttaggaagtgttctctttgcggtatcctggctgacaaaggccttgattgatggcataggcaatagcttcttccctggactttctgtctgcaagacatgctccattggtagtataaatggatttgaaatagagtctcataaatgctattgcagtctattctgttgtccttactgtagagcttgctcatccgacaaaaacactcaccggatgcacttaaatgtttgcaaaaaaaggaaaatgggtagcaatgtcatgctggctgtctgtaaacgtatgtgctttagagcaaccattgaggcaagcaataaagctttactgatcaggagcatcataaattccacttttgtgatttgcatattaatcctaacaatctgtgtggtaagcacctccgcagttgatatggaaaatttgcctgcaggcatctgggagaaagaagaagatcttacaaacttctgtcaccaggagtgtcaagtgacagaaactgaatgcctctgcccgtatgaggccatggtactcaggaagccactcttcctggatagcatagccaagggaaagaaaagcctgttgaactccacaagcttagaaactagtctgtcaattgaagctccgtggggagcaatcaatgttcagtcaactttcaaaccaacagtttcagctgctaacatagcacttagctggagttcagttgaacacaggggcaacaaaattttagtttcaggtagatcagagtcaatcatgaaattagaagaaagaacaggagtcagctggaatctgggtgtagaagatgcttctgagtcaaagacgctcactgtttccgtcatggacctgtcacaaatgtactctcctgtttttgagtacttgtcaggtgacagacaagtggaggaatggccaaaggcaacttgcacaggtgactgtccagagagatgcggctgcacttcgtcaacctgcttacataaagagtggccacattcaagaaactggcgatgtagtcctacctggtgttggggggtggggactggctgcacttgctgtgggctggatgttaaggatttttttactgactacatgctggtaaaatggaaagtggaatatataaagacagaagctatagtgtgtgtcgagctgactagtcaagagaggcagtgtagtttaattgaagcaggcacaagatttaacctaggccctgtaacaataacactatcagagccaagaaatgtccagcagaggcttcctcccgaaattgtaacactgcatcctaaaatagaggaaggtttttttgatttgatgcatgtacaaaaaatactgtctgcaagcacagtttgcaagctacagagctgcacacacggtgtgccgggcgattttcaggtctaccatgtcggtaacctgctgaggggagacaaggttaatggacactcaattcacaagatagaaccacattttaatacttcatggatgtcatgggatggttgcgatctggactatttctgcaatatgggggactggccttcatgcacatacactggagtaacacagcataaccgtgctgcatttatcaacatgctcaacattgagactgactatacaaaaactttccactttcattcgaagagggtcacggcacatggagatactccccagctagacctgaaagcgagaccggcatatggtgctggcgaggtcactgttctagtggaggttgcagacttggagttgcacacaaagaaacttgaagtgtcaggtttgaaaattgcaagtttgacctgctctgggtgttatgcctgcagctctggcatctcctgcaaagttagaatccatgtaaatgaaccagatgaattcacagtacatgtaagaagtagcgacccagatgttgtagcagcaggatcaagtcttatggcaaggaaaatagagtttggggctgacagtacattcaaggccttttcatcaatgcccaaggactccttatgcttttacatagtagaaaaggattactgcagcagctgcaccgacgatgacacacaaaagtgtgtcaacacgaagcttgaccatccacagagcatactcattgagcacaaaggaacaataattggcaagcaaaatgacacttgttcgaccaagacaagctgctggctagaatcagttaagggttttttctatgggctcaaaaacatgctgagtggcatctttggaaatgtttttttaggcatcctcttattccttgctccttttgtactactgatattttttttcttttttgggtggaggcttctgttttgtctcaaatgttgcagaagaactagaggactgttgaaatataagcaccttaaggacgaagaggaggctggatacaaaaaaatcattgaaaggctaaatggcaaaaaaggtaaaagtcaattgtttgatggtgaaaggcttgcagacaggaagattgctgagcttttttctactaaaattcacataggt

SEQ ID NO: 3732 - RNA, 3495 nt, synthetic construct
  misc_feature 1..3495: note = derived and/or modified CDS sequence (wt) from CCHVF(CCHVF V42/81)__GU477490.1__Gn-NSm-Gc
  source 1..3495: mol_type = other RNA
tccaaagagccaggtgatgactgtatatcaagaactcagctaatgaggacagaaacagcagagatccatgatgacaactatggtggtccaggtgataaaataactatctgcaatggttcaaccattgtggatcagagactgggcagtgaactagggtgttataccatcaacagggtgaagtcattcaagctatgtgaaaacagcgccacagggaaagcctgtgaagtggacagcactccggttaagtgcaggcagggtttttgtttaaaaatcacccaagagggaaggggccatgtaaagttatctagaggctcagaggttgtcttggatgcttgcgactcaagctgtgaagtaatgatacctaaaggcactggagatatcctagtggactgttcaggtggacagcaacatttcttaaaggacaacttaattgacctagagtgccctcatatcccgctattaggtaagttggccatttacatttgcagaatgtcaaatcatcctagaacaactatggcttttctcttctggttcggctttggctatgtgatcacctgtatactctgcaaggctcttttttattcattgataattattgggacactagggaaaaagatcaagcaatatagggaactgaaacctcaaacttgcaccatatgtgagacagctcctgtcaatgcaatagatgctgaaatgcatgaccttaactgtagttacaatatatgcccttattgtgcatcaagattgacctccgatgggctagctaggcatgtaacgcaatgccccaagcgaaaagagaaagttgaggagactgaactgtacttgaatctggagagaattccttggattgtcaggaagctcctgcaagtgtcggagtccactggcgtggtattgaaacgaagcagttggctgattgtgctgcttgtgttactcacagtttcattgtcaccagttcagtcagcacctgttggtcatggtaagacaattgaaacatatcagaccagagaaggattcacaagcatctgtctctttatgttaggaagcatcctatttatagtctcttgcatagtgaaggggctggttgacagtgtcagtgacagcttcttccccggcctgtctgtctgtaagacatgctctatcagcagtataaatggctttgaaattgaatcgcataaatgctactgtagcttattttgctgcccctactgtaggcactgctctgctgacagagaaattcaccagttacacttgagtatctgcaggaaaagaagaacggggagcaatgtcatgctggctgtctgcaaacgcatgtgctttagggcaaccatagaagtaagcagaagagccctgctcatccgaagcatcatcaataccacttttgtaatatgtattctaacattaacaatctgtgttgttagcacttctgcagtagagatggaaaacctcccagcaggcacttgggagagagaggaagacctaacaaatttctgtcatcaggaatgccaggtaaccgagacggagtgcctctgtccatacgaagctcttgtgctcagaaaacctcttttcttagacagtatagttaaaggtaagaaaaatttgttaaactcaacaagtttggaaacaagcttatcaattgaagcaccatggggagcaataaatatccagtcaacctttaaaccaacagtatcggctgcaaacatagcactcagttggagctcagtggagcacagaggcaacaagatcttagtctcaggcaggtctgaatcaattatgaaactagaggaaagaacaggagtcagctggaatctaggtgtagaagatgcctctgaatccaaattacttaccgtctctatcatggatttgtcacaaatgtattcccctgtttttgagtacttgtcaggagacagacaggttgaagaatggcctaaagcaacttgtacaggtgactgcccagaaaggtgtggttgcacatcatcaacctgcttgcataaagaatggcctcactcaagaaactggagatgcaatcctacttggtgctggggggtaggaaccggctgcacctgctgcggagtggatgtaaaagacctttttatagatcacatgtttgttaaatggaaggttgaatatataaaaactgaagccatagtatgtgttgagctcaccagccaagaaagacagtgcagtctgattgaggcaggtactagattcaacttgggccctgtgactattaccctatccgagccaagaaacattcagcagaagcttccccctgagattatcacgttgcaccccaaaattgaagaaggcttctttgacttgatgcatgtacaaaaagtgttgtctgccagtacagtgtgtaaactgcaaagttgcacacatggtataccaggagatctgcaagtctaccacattggcaacctattgaaaggggatagagtaaacgggcatctaattcacaaaatcgaaccacattttaacacctcttggatgtcctgggatggttgtgacctagactactactgcaacatgggggattggccttcttgcacatacacaggagtgacccagcacaatcatgctgcatttgtaaacttgcttaacattgaaactgattacacgaaaactttccacttccactctaaaagagttacagcacatggtgaaacaccacaattagacttaaaagcaaggccggcatacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgaaccagatgagctcacagtacatgtgaagagcaatgatccagatgtggttgcagctagcacaagtctcatggcaaggaagcttgaatctgggacagacagcacatttaaggccttttcagctatgcccaaaacctctttatgtttttacattgtggagagagaatactgcaagagctgcagtgaagatgatacacagaaatgtgttgaaacaaaacttgaacagccacaaagcatactaattgaacacaaaggaacgataattggaaagcagaatgatacttgcacagccaaggcaagctgttggctggaatcagtcaagagttttttttatggattgaagaacatgcttggcagtgtttttggtaattttttcataggcattttgttattccttgccccctttgtcctgttagtacttttctttatgtttggatggaaaatcttgttttgctttaaatgttgcaggaggaccagaggcttgtttaagtatagacacctcaaagaagatgaggaaacaggctacagaaggattattgagagactgaacagcaaaaaagggaaaaacagactgcttgatggtgaaaggttggctgataggaaaattgctgagctgttctctacaaaaacacacattggc

SEQ ID NO: 3733 - RNA, 3495 nt, synthetic construct
  misc_feature 1..3495: note = derived and/or modified CDS sequence (wt) from CCHVF(CCHVF 79121M18)__GU477493.1__Gn-NSm-Gc
  source 1..3495: mol_type = other RNA
gcagaaggaggaagcagtgactgcatttcaagaactcagctagttaaaacggaggttgcagaaattcatgaggacagttacggtgggcctggtgagaaaataacaatctgcaatggttccacaattgtagatcaagggcttggtagtgaattgggctgttatacaatcaacagagtaagatcctacaagctatgcgagaacagtgcctcagggaaaagctgtgaaatagatagcatcccagtcaaatgcaaacaagggttttgcctcaaaataacccaagaaggaagaggtcatgtaaaactgtccagagggacagaaattgttctagatgtctgtgattccagctgtgagctgatgatacccaagggcactggagacattttagtggattgctcaggagggcaacagcattttttacaaaacaatctgattgacttgggatgccccaatgtcccattactgggtaaaatggccatatatgtctgcagaatgtcaaaccacccaaaaactaccatggcatttctgttctggttcagctttggctatgtcatcacatgtatagcatgcagggtactcttctacttgctgattgccatcggaacagtagggaaaaagctaaaacagtatagagagctgaaaccacaaacatgcattgtctgtgaatctgtccctgttaatgcaatagatgctgaaatgcatgagcttaattgcagttacaatatatgcccatactgtgcatctagactgtctacagacgggctcatcaggcacgtaactcagtgtcccaaacggagggagaaggtggaagagactgagctattcttgaacttggaaagaataccttggctggtgagaaagctccttcaagtatcagagtcaacaggaatggctctaaagagaagctgttggatgatcacactcctcattctactattggtttcgatatcaccagtccaatctgcaccggtaggcaaagagagggcaatcgagacctatcaagcaagagaaacctacacaggcatatgcctctttgtgttaggaagtgttctctttgcggtatcctggctgacaaaggccttgattgatggcatcggcaacagcttctcccctggactttctgtctgcaagacatgctccattggtagtataaatggatttgaaatagagtctcataaatgctattgcagtctattctgttgtccttactgtagagcttgctcatccgacaaaaacactcaccggatgcacttaaatgtttgcaaaaaaaggaagatgggtagcaatgtcatgctggctgtctgtaaacgtatgtgctttagagcaaccattgaggcaagcaataaggctttactgatcaggagcatcataaattccacttttgtgatttgcatattaatcctaacaatctgtgtggtaagcacctccgcagttgatatggaaaatttgcctgcaggcatctgggagaaagaagaagatcttacaaacttctgtcaccaggagtgtcaagtgacagaaactgaatgcctctgcccgtatgaggccatggtactcaggaagccactcttcctggatagcacagccaagggaatgaaaagcctgttgaactccacgagcttagaaacaagtctgtcaattgaagctccgtggggagcaatcaatgtccagtcaactttcaaaccaacagtttcagctgctaacatagcacttagctggagttcagttgaacacaggggcaacaaaattttagtttcaggtagatcagagtcaatcatgaaattagaagaaagaacaggagtcagctggaatctgggtgtagaagatgcttctgagtcaaagacgcttactgtttccgtcatggacctgtcacaaatgtactctcctgtttttgagtacttgtcaggtgacagacaagtggaggaatggccaaaggcaacttgcacaggtgactgtccagagagatgcggctgcacttcgtcaacctgcttacataaagagtggccacattcaagaaactggcgatgtaatcctacctggtgttggggggtggggactggctgcacttgctgtgggctggatgtaaaggatttttttactgactacatgctggtaaaatggaaagtggaatatataaagacagaagctatagtgtgtgtcgagctgactagtcaagagaggcagtgtagtttaattgaagcaggcacaagatttaacctaggccctgtaacaataaccctatcagagccaagaaatgtccagcagaggcttcctcccgaaattgtaacactgcatcctaaaatagaggaaggtttttttgatttgatgcatgtacaaaaaatactgtctgcaagcacagtttgcaagctacagagctgcacacacggtgtgccgggcgattttcagatctaccatgtcggtaacctgctgaggggagacaaggttaatggacactcaattcacaagatagaaccacattttaatacttcatggatgtcatgggatggttgcgatctggactatttctgcaatatgggggactggccttcatgcacatacactggagtgacacagcataaccgtgctgcatttatcaacatgctcaacattgagactgactatacaaaaactttccactttcattcgaagagggtcacggcacatggagatactccccagctagacctaaaagcgagaccggcatatggtgctggcgaggtcactgttctagtggaggttgcagacttggagttgcacacaaagaaacttgaagtgtcaggtttgaaaattgcaagtttgacctgctctgggtgttatgcctgcagctctggcatctcctgcaaagttagaatccatgtaaatgaaccagatgaatttacagtacatgtaagaagtagcgacccagatgttgtagcagcaggatcaagtcttatggcaaggaaaatagagtttggggctgacagtacattcaaggccttttcatcaatgcccaaggactccttatgcttttacatagtagaaaaggattactgcagcagctgcaccgacgatgacacacaaaagtgtgtcaacacgaagcttgaccatccacagagcatactcattgagcacaaaggaacaataattggcaagcaaaatgacacttgttcgaccaagacaagctgctggctagaatcagttaagggttttttctatgggctaaaaaacatgctaagtggcatctttggaaatgtttttttaggcatcttcttattccttgctccttttgtgctactgatattttttttcttttttgggtggaggcttctgttttgtctcaaatgttgcagaagaactagaggactgttgaaatacaagcaccttaaggatgaagaggaggctggatacaaaaaaatcattgaaaggctaaatggcaaaaaaggtaaaagtcaattgtttgatggtgaaaggcttgcagacaggaagattgctgagcttttttctactaaaattcacataggt

SEQ ID NO: 3734 - RNA, 3495 nt, synthetic construct
  misc_feature 1..3495: note = derived and/or modified CDS sequence (wt) from CCHVF(CCHVF Afg09-2990)__HM452306.1__Gn-NSm-Gc
  source 1..3495: mol_type = other RNA
tccgaagaatctggtgatgactgcatatcaagaactcagctattgaggacagagactgcagaggtccatggcgataactatggtggtccaggtgataagataaccatctgtaatggttcaactgttgtagatcaaagactgggtagtgaactggggtgttacactatcaatagagtgaggtcattcaagctatgcgaaaacagtgccacagggaagagctgtgaaatagacagtatcccagtcaagtgtaagcagggttattgccttaaaatcactcaggaaggaaggggccatgtgaagttatctagaggctcagaagttgtcttggatgtatgtgattcaagctgtgaagtgatgatacctaagggcactggtgacattctagtagattgttcaggtgggcagcaacattatttaaaagacaacctggttgacctagggtgtcccaaaattccgttactgggcaaaatggctatttatatctgcaggatgtcgaatcaccccaagacaaccatggccttcctcttttggttcagctttggctatgtgataacttgtatactttgcaaggccatttttttcttattgataatttttggaacactagggaaaaggttcaagcagtacagagagttgaaaccccagacctgcaccatatgtgagacaacacctgtaaatgcaatagatgctgaaatgcatgatctcaactgcagttacaatatatgtccctattgtgcgtctagactgacttcagatgggcttgctaggcatgtaacacaatgtcctagacggaaggagaaagtggaggaaaccgaattatacctgaatttagagagaattccctgggttgtaagaaagctattgcaggtgtcagagtccactggtacagtattaaaaaggagcagctggctaattgtattacttgtgctgttcacagtttcattgtcaccagttcaatcagcacccattggtcacgggaaaacaattgaaacataccgggttagggaagaatacacaagtatttgcctctttgtactagggagtatcctgtttatagtctcttttctaatgaaaggactggttgacggtgttggcaacatcttctttcctgggctgtccgtctgtaagacatgctctataggtagcattaatggctttgaaattgagtctcataagtgctactgtagcttgttttgttgcccttactgtaggcactgctctgctgatggagaaatccatcagctgcacttgagcatctgcaaaaaaaggaagacaggaagtaatgttatgctggctgtttgcaaacgcatgtgtttcagggcaactatggaagtaagcaacaaagccctatttatccgtagcattatcaacaccacttttgttgtgtgcatactgatactagcggtttgtgttgttagcacctcagcagtagagatggaaagcttaccagctgggacctgggaaagagaagaagacctaacaaatttctgccatcaggaatgccaggtcacagagactgagtgcctctgcccttatgaagctctagtgctcagaaggcccctatttctagatagtatagtcaaaggtatgaaaaatctgctaaactcaacaagtctagaaacaagcttatcaatagaggcaccgtggggagcaattaatgttcagtcaacctacaaaccaactgtatcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagttatggacttgtctcagatgtactctcctgtcttcgagtacttatcaggtgacagacaagtggaagagtggcctaaagcaacctgtacaggtgactgcccagaaagatgtggctgcacatcatcaacctgcttacacaaagagtggccccactcaaggaattggagatgtaatcctacttggtgctggggtgtagggactggctgcacctgttgtggtttagatgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagaaccaaggaacattcaacaaaagctccctcctgaaataattacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacctgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacaactagatctgaaagcaaggccaacctatggtgcaggtgagatcaccgtgctggtggaagttgctgacatggagttacacacaaagaagattgaaatatcaggcttaaaatttgcaggcctaacttgcacaggttgttatgcttgtagttctggcatctcttgtaaagttagaattcatgtagatgaaccagatgaacttacagtacatgttaaaagtgatgacccagatgtagttgcagctagctcaagtctcatggcgaggaagcttgaatttggaacagacagtacatttaaagctttctcagccatgcctaaaacctccctatgtttctacattgtggaaagagaatactgtaagagctgcagtaaagaagatacacaaaaatgtgttaacacgaaactcgaacaaccacagagcattttgatcgaacataagggaactataattggaaagcaaaacaatacttgcacggctaaagcgagttgctggttagagtcagttaagagtttcttttatggtctgaagaatatgctcggtggcatatttggcaatgtttttataggcattttcacatttcttaccccctttatcttgttaatacttttctttatgtttgggtggaggatcctgttttgcttcaagtgttgcagaagaaccagaggcctattcaagtacagacacctcaaagacgatgaagaaactggttacagaaagatcattgaaagactgaacaacaaaaaaggaaaaaacaggctgcttgatggtgaaagacttgctgacagaaagattgctgaactgttctccacaaaaacacacattggc

SEQ ID NO: 3735 - RNA, 3495 nt, synthetic construct
  misc_feature 1..3495: note = derived and/or modified CDS sequence (wt) from CCHVF(CCHVF Sudan Al-Fulah 3-2008)__HQ378184.1__Gn-NSm-Gc
  source 1..3495: mol_type = other RNA
tccgaagaacccagtgatgactgcatatcaagaactcaactattgaggacagagactgcagaaatccacggcgacaactatggtggcccgggtgacaaaataaccatctgcaacggctcaactattgtagaccaaagactgggcagtgagttagggtgttacactatcaatagagtgaagtcattcaagctatgtgaaaatagtgccactgggaagagctgtgtgatagacagtgtcccagttaaatgcaggcagggttattgcctaaggattactcaagaaggaaggggccatgtaaaattatctaggggctcagaggttgtcttagatgcatgcgatacaagctgtgaaataatgatacctaagggcaccggtgacatcctagttgactgttcaggtgggcagcaacattttctaaaggacaatttggtagatctaggatgccccaaaatcccattactgggcaaaatggctatctacatttgcagaatgtcgaatcaccccaaaacaaccatggctttcctcttctggttcagctttggctatgtaataacttgtatactttgcaaggccatcttttacttgttaataattattggaacactagggaaaaggttcaggcagtatagagagttaaagcctcagacctgcaccatatgtgagacaactcctgtaaatgcaatagatgctgagatgcatgacctcaattgcagttacaacatttgtccctactgtgcatctagactaacctcggatgggcttgctaggcatgtgacacagtgccctaagcggaaggagaaagtggaagaaactgaactgtacttgaacttagaaagaattccttgggttgtgagaaagctgttgcaggtatcagagtccaccggtgtggcattgaaaagaagcagctggctgattgtgctgcttgtgctgttcacggtttcattgtcgccagttcaatcagcacccattggtcacgggaagacgattgaggcataccgtgccagggagggatacacaagtatatgtctctttgtactaggaagtatcctatttatagtctcttgcctaatgaaagggttggttgacagtgttggcaactccttcttccctggactgtccatttgcaaaacgtgctccataagcagcattaatggctttgaaattgagtcccataagtgctattgcagcttgttctgttgcccctattgtaggcactgctctgctgataaagaaattcacaagctgcacttgagcatctgcaaaaaaaggaaaacaggaagtaatgtcatgttggctgtttgcaagcgcatgtgtttcagggccaccatggaagtaagtaacagagccctgtttattcgtagcatcatcaataccacttttgttttgtgcatactgatactagcagtttgtgttgttagcacctcagcagtggagatggaaaacctaccagccgggacttgggaaagagaagaagacctaacaaatttctgtcatcaggaatgccaagttacagagactgaatgcctctgcccttatgaagctctagtactcagaaggcctctattcctagacagtatagttaaaggcatgaaaaatctgctaaactcaacaagtttagaaacaagtctgtcaattgaggcaccatggggggcaataaatgttcagtcaacctacaagccaactgtgtcgactgcaaatatagcactcagctggagctcagtggaacacagaggcaataagatcttggtttcaggcagatcagaatcaattatgaagctggaagaaaggacagggatcagctgggatctcggcgtagaagacgcctctgagtctaaactgcttacagtctctgttatggatttgtctcagatgtactctcctgtcttcgagtacttatcaggagacagacaggtggaggagtggcccaaagcaacttgcacaggtgactgcccagaaagatgtggctgcacatcatcaacatgtctgcacaaagaatggccccactcaagaaattggagatgcaatcccacttggtgctggggtgtagggactggctgcacctgctgtggattagatgtgaaagacctttttacagattatatgtttgtcaagtggaaagttgaatacatcaagacagaggccatagtgtgtgtagaactcaccagtcaggaaaggcagtgtagcttgattgaagcaggcacaaggttcaatttaggtcctgtgaccatcacactgtcagaaccaagaaacatccaacagaagctccctcctgaaataatcacactacatcctaggattgaagaaggtttttttgacctgatgcacgttcagaaagtgttatcagcaagcacagtgtgtaagttgcagagttgcacacatggtgtaccaggagacctacaggtctaccacatcggaaatttattaaaaggggacaaggtaaatggacatctaattcataaaattgagccacacttcaacacttcctggatgtcctgggatggttgtgacctagactactactgcaacatgggagattggccttcttgcacatacacaggagtcacccaacacaatcatgcttcatttgtaaacctgctcaacattgaaactgattacacaaaaaacttccactttcactctaaaagggtcactgcacacggagacacaccacaactggatcttaaggcaagaccaacctatggtgcaggtgagattactgtactggtagaagttgctgacatggagttacacacaaagaagattgaaatatcgggcttaaaatttgcaagcttgacttgcacaggttgttatgcctgtagctctggcatctcatgcaaagttagaattcatgtagacgaaccagatgaacttacagtgcatgttaaaagtgatgatccagatgtagttgcagctagctcaagcctcatggcaagaaagcttgaatttggaacagacagtacatttaaagctttttcagccatgcctaaaacttcgctatgtttctacattgttgaaaaagaatactgcaagagctgcagtgaagaagacacaaaaaaatgtgttaacacaaaacttgagcaaccacagagcattttgatcgaacacaagggaactataatcggaaagcaaaacagcacttgcacagccaaggtgagttgctggttagagtcagccaagagttttttttatggtctaaaggacatgcttagtggcatttttggcaatgtctttataggtattttcttattccttgcccccttcgtcctgttagtgctgttctttatgtttgggtggaggatcctactttgctttagatgttgtagaagaactagaggcctgttcaagtatagacacctcaaggacgatgaagaaactggttatagaaggattattgaaagactaaacaataaaaagggaaaaaacaaactgcttgatggtgaaagacttgctgatagaaaaattgctgaactgttctccacaaaaacacacattggt

SEQ ID NO: 3736 - RNA, 3495 nt, synthetic construct
  misc_feature 1..3495: note = derived and/or modified CDS sequence (wt) from CCHVF(CCHVF Sudan AB1-2009)__HQ378187.1__Gn-NSm-Gc
  source 1..3495: mol_type = other RNA
tctgaagaacccagtgatgactgtatatcaagaactcaactactgaggacagagactgcagagatccacggcgataactatggtggcccgggtgacaaaataaccatctgcaatggctcaactattgtagaccaaagactgggcagtgaactagggtgttacaccatcaatagagtaaagtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgacacaagctgtgaaataatgatacctaagggcactggtgacatcctagttgactgttcaggcgggcagcaacattttctaaaggacaatttgatagatctaggatgccccaaaattccattattgggcaaaatggctatttacatttgcagaatgtcgaaccaccccaaaacaaccatggctttcctcttctggttcagctttggctatttaataacctgcatactttgcaaggccattttttacttgttgataattattggaacactagggaaaaggctcaagcagtatagagagttgaaacctcagacctgcaccatatgtgagacaactcctgtaaatgcaatagatgctgagatgcatgacctcaattgcagttacaacatttgcccctactgtgcatctagactaacctcagatgggcttgctaggcatgtgatacaatgccctaagcggaaggagaaagtggaagaaactgaactgtacttgaacctagaaagaattccttgggttgtaagaaagctgttgcaggtgtcagagtcaactggtgtagcattgaaaagaagcagttggctgattgtgctgcttgtgctattcactgtttcattgtcaccagttcaatcagcacccattggtcaagggaagacaattgaagcataccgggccagggaggggtacacaagtatatgtctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgttctaccgataaagaaattcataagctgcacttgagcatctgcaaaaaaaggaaaacaggaagtaatgtcatgttggctgtctgcaagcgcatgtgtttcagggccaccatggaagtaagcaacagagccctgtttatccgtagcatcatcaacaccacttttgttttgtgcatactgatactagcagtttgtgttgttagtacctcagcagtggagatggaaaacctaccagcagggacctgggaaagagaagaagacctgacaaatttctgtcatcaggaatgtcaggttacagagactgaatgcctctgcccttatgaagctctagtactcagaaagcctttattcttagatagtatagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatcttggcgtagaagatgcctctgagtctaaactgcttacagtctctgtcatggacttgtctcagatgtactctcctgtcttcgagtacttatcaggtgacagacaggtggaagagtggcccaaagcaacctgtacaggtgactgcccagaaagatgtggctgcacatcatcaacctgtttgcacaaagaatggcctcactcaagaaattggagatgcaatcccacctggtgctggggtgtagggactggctgcacctgttgtggattagatgtgaaggacctttttacagattacatgtttgtcaagtggaaagttgaatacatcaagacagaggccatagtgtgtgtagaacttactagtcaggaaaggcagtgtagcttgattgaagcgggcacaaggttcaatttgggtcctgtgaccatcacactgtcagaaccaagaaacatccaacaaaaactccctcctgaaataatcacactacatcctaggatcgaagaaggtttttttgacctgatgcatgtacaaaaggtgttatcggcaagcacagtgtgtaagttgcagagttgcacacatggtgtgccaggagacctacaggtctaccacatcggaaatttattaaaaggggataaggtaaatgggcatctaattcataaaattgagccacacttcaacacctcctggatgtcctgggatggttgtgacctagactactactgcaacatgggagattggccttcctgcacatacacaggggtcacccaacacaatcatgcttcatttgtaaacttactcaacattgaaactgattacacaaagaatttccactttcactctaaaagggtcactgcacacggagatacaccacaactagatcttaaggcaagaccaacctatggtgcaggtgagatcactgttctggtagaagttgctgacatggagttacatacaaagaagattgagatatcaggcttaaaatttgcaagcttgacttgcacaggttgttatgcttgcagctctggtatctcatgcaaagttagaattcatgtggatgaaccagatgaacttacagtacatgttaaaagtgatgatccagatgtggttgcagctagctcaagtctcatggcaagaaagcttgaatttggaacagacagtacatttaaagctttctcggccatgcctaaaacttctttatgtttctacattgttgaaagggaacactgtaagagctgcaatgaagaagacacaaaaaaatgtgttaacacaaaacttgagcaaccacaaagcattttgatcgaacacaagggaaccataatcggaaagcagaacagcacttgcacggctagggcgagttgctggttggagtcagtcaagagtttcttttatggcctaaagaacatgcttagtggcatttttggcaatgtctttatgggcatcttcttattccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaagactaaacaataaaaaaggaaaaaacaaactgcttgatggtgaaagacttgctgatagaagaattgccgaactgttctctacaaaaacacacattggc

SEQ ID NO: 3737 - RNA, 3495 nt, synthetic construct
  misc_feature 1..3495: note = derived and/or modified CDS sequence (wt) from CCHVF(CCHVF NIVA 118595)__JN572083.1__Gn-NSm-Gc
  source 1..3495: mol_type = other RNA
tccgaagaatctggtgatgactgcatatcaagaactcagctattaaggacagagactgcagaggtccatggcgacaactatggtggtccgggtgataagataaccatctgcaatggttcaactgttgtagatcaaagactgggtagtgaactggggtgttacactatcaatagagtgaagtcctttaagctatgcgaaaacagtgccacagggaagagctgtgaaatagacagtatcccagttaagtgtaggcagggttattgcctaaaaatcactcaggaaggaaggggccatgttaaattatctaggggttcagaagttgtcttggatgcatgtgactcaagctgtgaagtgatgatacctaagggcactggtgacattctagtagattgttcaggtgggcagcaacattttttaaaggacaacctgattgatctaggatgtcccaaaattccattattgggcaaaatggctatttatatctgcagaatgtcgaatcaccccaaaacaaccatggcctttctcttttggttcagcttcggctatgtgataacttgtatactttgcaaggtaattttttacttattaataatttttggaacactagggaaaaggttcaagcagtacagagagttgaaaccccagacctgcaccatatgtgagacaacacctgtgaatgcaatagatgctgaaatgcatgatcttaactgcagttacaatatatgtccctattgtgcgtctaggctaacttcagatgggctcgctaggcatgtaacacaatgccctaagcggaaggagaaggtggaagagaccgaattgtacttgaacttagagagaattccttgggttgtaagaaagctattgcaggtgtcagagtccactggcatagcattaaaaaggagcagctggctaattgtgctgcttgtgttattcacagtatcaataacaccggttcaatcagcgcccattggtcacgggaagacaattgaagcgtaccgggctagggaggaatacacaagcatttgtctctttgtgctgggaagtgtcttgtttgtggtctcttgtctaatgaaaggactggttgacagtgttggcaatatcttctttcctgggctgttcatttgtaagacatgttctataggtagcattaatggctttgaaattgagtctcataagtgctattgtagcttgttttgttgcccttactgtaggcactgctctgctgatagagaaattcatcagctgcacttgagcatctgcaaaaaaaggaagacaggaagtaatgtcatgctggctgtttgcaaacgcatgtgtttcagaacaactatggaagtaagcaacaaagccctatttgtccgaagcatcatcaacaccacttttgttgtgtgcatactgatactagcagtctgtgttgttagcacttcagcagtagagatggaaagcctaccagctgggacctgggaaagagaagaagaccttacaaatttctgccatcaggaatgccaggtcacggagactgagtgcctctgcccctatgaagctctagtgctcagaaggcccctatttctagatagtatagtcaaaggtatgaaaaatctgctaaactcaacaagtctagaaacaagcttatcaattgaggcaccgtggggagcaattaatgttcagtcaacctacaaaccaactgtatcagcagcaaacatagcactcagttggagctcagtggaacacagaggcaataagattttggtctcaggcagatcagaatcaattatgaagctggaagaaaggacaggaatcagctgggatctcggcgtagaagatgcctctgagtctaagctacttacagtctcagtcatggacttgtctcagatgtactctcctgtcttcgagtatttatcaggtgacagacaagtggaagagtggcctaaagcgacctgtacaggtgactgcccagaaagatgtggctgcacatcatcaacctgcttacacaaagagtggccccactcaaggaattggagatgtaatcctacttggtgctggggtgtagggactggctgcacctgctgtggattggatgtgaaagaccttttcacagattacatgttcgtcaagtggaaagttgagtacattaagacagaggccatagtatgtgtagaactaaccagtcaggaaagacagtgtagcttgattgaggcgggcacaagatttaatttaggttctgtgaccattacattgtcagaaccaaggaacattcaacaaaagctccctcctgaaataatcacactgcatcctagaattgaggaaggtttttttgacctaatgcatgtgcaaaaagtgctatcagcaagcacagtgtgtaagttacaaagctgcacacatggtgtgccaggagatctacaggtctaccacattggaaacctattaaaaggggacagagtaaacggacacctaattcacaaaattgaacaacacctcaacacttcttggatgtcctgggatggttgtgatctagactactactgcaatatgggagactggccttcttgcacatatacaggagtcacccaacataatcatgcttcatttgtaaacctgctcaacattgaaactgattacacaaaaaccttccactttcactctaaaagggttactgcacatggagacacaccacagctagatctgaaggcaaggccaacctatggtgcaggtgagatcactgtactggtggaagttgccgatatggagttacacacaaagaagattgaaatatcaggcttgaagtttgcaagcctatcctgcacaggttgttatgcttgtagttctggcatctcctgcaaagtcagaattcatgtagatgaaccagatgaacttacagtacatgttaaaagtgatgatccagatgtagttgcagctagctcaagtctcatggcaaggaagcttgaatctggaacagacagtacatttaaagctttttcagccatgcctaaaacttccttgtgcttctacattgtagagagagaatactgtaagggctgcagtaaagaagacacacaaaaatgtgttaacacgaaactcgagcaaccacagagcattttgatcgaacacaagggaactataattggaaagcaaaacaatacttgcacagctaaggcaagttgctggttagagtcagttaagagttttttttatggtctgaagaatatgcttagtggcatttttggcaatgtttttttaggcattttctcatttcttgccccctttgtcctattaatacttttctttatgtttgggtggaggatcctgttttgcttcaagtgttgcagaagaaccagaggcctattcaagtacagacacctcaaagacgatgaagaaactggttacagaaagatcattgaaagactgaacaacaaaaaggggaaaaacaaactgcttgatggtgaaaggcttgctgacagaaaaattgccgaactgttctccacaaaaacacacattggc

SEQ ID NO: 3738 - RNA, 3495 nt, synthetic construct
  misc_feature 1..3495: note = derived and/or modified CDS sequence (wt) from CCHVF(CCHVF NIV 112143)__JN572085.1__Gn-NSm-Gc
  source 1..3495: mol_type = other RNA
tccgaagaatctggtgatgactgcatatcaagaactcagctattaaggacagagactgcagaggtccatggcgacaactatggtggtccgggtgataagataaccatctgcaatggttcaactgttgtagatcaaagactgggtagtgaactggggtgttacactatcaatagagtgaagtcctttaagctatgcgaaaacagtgccacagggaagagctgtgaaatagacagtatcccagttaagtgtaggcagggttattgcctaaaaattactcaggaaggaaggggccatgttaaattatctaggggctcagaagttgtcttggatgcatgtgactcaagctgtgaagtgatgatacctaagggcactggtgacattctagtagattgttcaggtgggcagcaacattttttaaaggacaacctgattgatctaggatgtcctaaaatcccattattgggcaaaatggctatttatatctgcagaatgtcgaatcaccccaaaacaaccatggcctttctcttttggttcagcttcggctatgtgataacttgtatactttgcaaggtaattttttacttattaataatttttgggacactagggaaaaggttcaagcagtacagagagttgaaaccccagacctgcaccatatgtgagacaacacctgtgaatgcaatagatgctgaaatgcatgatcttaactgcagttacaatatatgtccctattgtgcgtctaggctaacttcagatgggctcgctaggcatgtaacacaatgccctaagcggaaggagaaggtggaagagaccgaattgtacttgaacttagagagaattccttgggttgtaagaaagctattgcaggtgtcagagtccactggcatagcattaaaaaggagcagctggctaattgtgctgcttgtgttattcacagtatcaataacaccggttcaatcagcgcccattggtcacgggaagacaattgaagcgtaccgggctagggaggaatacacaagcatttgtctctttgtgctgggaagtgtcttgtttgtggtctcttgtctaatgaaaggactggttgacagtgttggcaatatcttctttcctgggctgttcatttgtaagacatgttctataggtagcattaatggctttgaaattgagtctcataagtgctattgtagcttgttttgttgcccttactgtaggcactgctctgctgatagagaaattcatcagctgcacttgagcatctgcaaaaaaaggaagacaggaagtaatgtcatgctggctgtttgcaaacgcatgtgtttcagagcaactatggaagtaagcaacaaagccctatttgtccgcagcatcatcaacaccacttttgttgtgtgcatactgatactagcaatctgtgttgttagcacttcagcagtagagatggaaagcctaccagctgggacctgggaaagagaagaagaccttacaaatttctgccatcaggaatgccaggtcacggagactgagtgcctctgcccctatgaagctctagtgctcagaaggcccctatttctagatagtatagtcaaaggtatgaaaaatctgctaaactcaacaagtctagaaacaagcttatcaattgaggcaccgtggggagcaattaatgttcagtcaacctacaaaccaactgtatcagcagcaaacatagcactcagttggagctcagtggaacacagaggcaataagattttggtctcaggcagatcagaatcaattatgaagctggaagaaaggacaggaatcagctgggatctcggcgtagaagatgcctctgagtctaagctacttacagtctcagtcatggacttgtctcagatgtactctcctgtcttcgagtatttatcaggtgacagacaagtggaagagtggcctaaagcgacctgtacaggtgactgcccagaaagatgtggctgcacatcatcaacctgcttacacaaagagtggccccactcaaggaattggagatgtaatcctacttggtgctggggtgtagggactggctgcacctgctgtggattggatgtgaaagaccttttcacagattacatgttcgtcaagtggaaagttgagtacattaagacagaggccatagtatgtgtagaactaaccagtcaggaaagacagtgtagcttgattgaggcgggcacaagatttaatttaggttctgtgactattacattgtcagaaccaaggaacattcaacaaaagctccctcctgaaataatcacactgcatcctagaattgaggaaggtttttttgacctaatgcatgtgcaaaaagtgctatcagcaagcacagtgtgtaagttacaaagctgcacacatggtgtgccaggagatctacaggtctaccacattggaaacctattaaaaggggacagagtaaacggacacctaattcacaaaattgaacaacacctcaacacttcttggatgtcctgggatggttgtgatctagactactactgcaatatgggagactggccttcttgcacatatacaggagtcacccaacataatcatgcttcatttgtaaacctgctcaacattgaaactgattacacaaaaaccttccactttcactctaaaagggttactgcacatggagacacaccacagctagatctgaaggcaaggccaacctatggtgcaggtgagatcactgtactggtggaagttgccgatatggagttacacacaaagaagattgaaatatcaggcttgaagtttgcaagcctatcctgcacaggttgttatgcttgtagttctggcatctcctgcaaagttagaattcatgtagatgaaccagatgaacttacagtacatgttaaaagtgatgatccagatgtagttgcagctagctcaagtctcatggcaaggaagcttgaatttggaacagacagtacatttaaagctttttcagccatgcctaaaacttccttgtgcttctacattgtagagagagaatactgtaagggctgcagtaaagaagacacacaaaaatgtgttaacacgaaactcgagcaaccacagagcattttgatcgaacacaagggaactataattggaaagcaaaataatacttgcacagctaaggcaagttgctggttagagtcagttaagagttttttttatggtctgaagaatatgcttagtggcatttttggcaatgtttttttaggcattttctcatttcttgccccctttgtcctattaatacttttctttatgtttgggtggaggatcctgttttgcttcaagtgttgcagaagaaccagaggcctattcaagtacagacacctcaaagacgatgaagaaactggttacagaaagatcattgaaagactgaacaacaaaaaggggaaaaacaaactgcttgatggtgaaaggcttgctgacagaaaaattgccgaactgttctccacaaaaacacacattggc

SEQ ID NO: 3739 - RNA, 3495 nt, synthetic construct
  misc_feature 1..3495: note = derived and/or modified CDS sequence (wt) from CCHVF(CCHVF SCT ex Afghanistan)__KC344856.1__Gn-NSm-Gc
  source 1..3495: mol_type = other RNA
tctgaagagtctggtgacgactgtatatcgaggactcagctattgaggacagagactgcagaggtccataatgataactatggtggtccaggtgacaaaattaccatctgcaacggttcaaccattgtagatcagagacttggcagtgaactggggtgttatactatcaacagagtgaagtcattcaagctatgcgaaaatagcgccacgggaaagtcctgtaaaatagacagcaccccggttaagtgcaggcaaggtttttgcttaaaaatcactcaggaaggaaggggccatgtgaagctatcgagaggctcagaagttgtcttagatgcctgcgattcaagctgtgaaataatgataccgaagggcactggagacatcctagtggactgttcaggtgggcagcaacatttcttaaaagataatttgattgatctaggatgccctaacattccactattaggtaaaatggctatctatatttgtagaatgtcaaatcatcccaaaacaactatggcttttctcttttggttcagttttggttatgtaataacatgtatattttgcaaagtcattttttatttattgatagttgtggggacattgggaaaaaagttcaaacagtatcgagagctgaaacctcagacttgtacaatatgtgaaacaactcctaccaatgcaatagatgctgaaatgcacgatcttaactgcagttacaatatatgtccttattgtgcatctagattaacctcggacgggcttgccaggcatgtgacacaatgccctaagcgaaaggaaaaagtagaagagactgagttgtacttgaacttggaaagaattccttggattgtcagaaaactactgcaggtgtcagagtctacaggtgtggcactgaagaggagcagttggctaattgtgttacttgtgctacttacagtttcattgtcaccggttcaatcggcacccatcgggcatggaaagacaattgagacatatcagaccagagaggggtatataagtgtttgcctgtttgtgctagggggcatactgtttgtagtctcctgcctgatcaaaggactggttgacagtgtcggcaacagtttttttcctgggttatctatttgcaagacatgttctatcggcagtgtaaatggctttgaaattgaatcccataaatgttactgtagcttactttgttgcccttattgtagacactgctctactgatagggagatccaccaattgcacttgagcatctgcaaaaaaagaaggacagggggcaatgtcatgttggctgtctgcaagcgcatgtgcttcagagcaactatggaagtaagcaacaaggtcctatttatccgaaacatcatcaataccacctttgttatatgcatactgatattagcagtctgtgtcgttagcacctctgcagtagagatggaaagcctacccgccggcacttgggaaagggaagaagacctaacaaacttctgccaccaagaatgccaagtcacagagactgaatgtctctgtccttacgaagctcttgtactcaggaaaccccttttcttaaacagtatagtcaagggcatgaaaaacctgctaaattcaactaacttggaaacaagcttatcaatcgaagcaccatggggagcaataaatgtccagtcaacctttaaacccactgtatcaactgcaaacatagcactcagctggagttcagtggaacacagaggtaataaaattctagtctcaggcagatcagagtcaattatgaagctagaagaaaggacaggaatcagctgggatttgggcgtagaagatgcctctgagtctaaatcgcttactgtttctgtcatggatttatcacagatgtattctcctgtcttcgagtatctgtcaggtgacagacaggtagaggagtggcctaaagcaacctgcacaggcgattgcccggagagatgtggctgcacatcatcaacctgcttacacaaggaatggccccattcaaggaattggagatgcaaccccacttggtgttggggagtcggcactggatgcacctgctgtgggctagatgtgaaagaccttttcacagattatatgtttgtcaagtggaaggttgaatacataaagacagaggccatagtgtgtgttgagctcactagccaagaaaggcagtgcagcttgattgaggcaggaacaaggttcaacttaggtcctgtgaccatcacgttgtcagagccaagaaacattcagcagaagcttcctcctgaaataatcacattgcatcctagaattgaggaaggctttttcgatctaatgcatgtacaaaaggtgctgtctgcaagtacagtgtgcaagctgcaaagctgcacacatggtgttccaggagacttgcaggtctaccacattggcaacttgttaaaaggggataagttaaacgggcatatgattcacaaaattgagccacacttcaatacctcttggatgtcctgggatggctgtgacctagactattactgtaatatgggggattggccctcttgcacatacactggggtgacccaacataaccatgctgcttttgttaacttacttaacatcgaaactgattacacaaagaacttccactttcactctaaaagagttactgcacatggagacacaccacaattggacttgaaagctagaccaacttacggtgcgggtgaaatcactgtactagtggaagttgctgacatggagttacacacaaaaaagattgatatatcaggtttgaaatttgcaagtctaacttgcgcgggttgctatgcttgtagctctggcatctcctgtaaagtcaggattcatgtagatgaacctgatgagcttacagtacatgtgaaaagtgaagatccggacattgttgcagctagcacaagcctcattgcaaggaagctcgaacttgggacagacagcacattcaaggccttctcagccatgcccaaaacctccttgtgcttctacattgtggagagagaatactgtaagagctgcagcaaagaggacacacagaaatgtgttaacacaaagcttgagcacccacaaggcattttaattgagcacaaaggaacaataatcggaaagcaaaatgacacctgcacagccaaagcaggctgctggttggagtcagtcaagagttttttttatggattgaagaacatgcttagtggcatcttcggcaacgtttttataggtattttcttattccttgctccttttgttctattgatactcttctttatgtttgggtggagactcctgttttgctttaagtgttgtagaagaaccagaggtttattcaagtacagacatctcaaggaagatgaagaatctggttatagaagaatcattgaaagattaaacaacaaaaaaggaaagaacaagctgcttgatggtgaaagactagctgatagaaggatcgctgagctgttctccacaaaaacacatattggt

SEQ ID NO: 3740 - RNA, 3495 nt, synthetic construct
  misc_feature 1..3495: note = derived and/or modified CDS sequence (wt) from CCHVF(CCHVF Zahedan 2007)__KC867273.1__Gn-NSm-Gc
  source 1..3495: mol_type = other RNA
tccgaagaatctggtgatgactgcatatcaagaactcagctattgaggacagagactgcagaggtccatggcgataactatggtggtccaggtgataagataaccatctgtaatggttcaactgttgtagatcaaagactgggtagtgaactggggtgttacactatcaatagagtgaggtcattcaagctatgcgaaaacagtgccacagggaagagctgtgaaatagacagtatcccagtcaagtgtaagcagggtttttgcctaaaaatcactcaggaaggaaggggccatgtgaagttatctagaggctcagaagttgtcttggatgtatgtgattcaagctgtgaagtgatgatacctaagggcactggtgacattctagtggattgttcaggtgggcagcaacattttttaaaagacaacctggttgacctagggtgtcccaaaattccgttactgggcaaaatggctatttatatctgcaggatgtcgaatcatcccaagacaaccatggccttcctcttttggttcagctttggctatgtgataacttgtatactttgcaaggccatttttttcttattaataatttttggaacactagggaaaaggttcaagcagtacagagagttgaaaccccagacctgcaccatatgtgagacaacacctgtaaatgcaatagatgctgaaatgcatgatctcaactgcagttacaatatatgtccctattgtgcgtctagactgacttcagatggacttgctaggcatgtgacacaatgtcctagacggaaggagaaagtggaggaaaccgaattatacctgaatttagaaagaattccctgggttgtaagaaagctattgcaggtgtcagagtccactggtacagtattaaaaaggagcagctggctaattgtattacttgtgctgttcacagtttcattgtcaccagttcaatcagcacccattggtcacgggaaaacaattgaaacataccgggttagggaagaatacacaagtatttgcctctttgtactaggaagtatcctgtttatagtctcttttctaatgaaaggactggttgacggtgttggcaacatcttctttcctgggctgtccgtctgtaagacatgctctataggtagcattaatggctttgaaattgagtctcataggtgctactgtagcttgttttgttgcccttactgtaggcactgctctgctgatggagaaatccatcagctgcacttgagcatctgcaaaaaaaggaagacaggaagtaacgttatgctggctgtttgcaaacgcatgtgtttcagggcaactatggaagtaagcaacaaagtcctatttatccgtagcattatcaacaccacttttgttgtgtgcatactgatactagcggtttgtgttgttagcacctcagcagtagagatggaaagcctaccagctgggacctgggaaagagaagaagacctaacaaatttctgccatcaggaatgccaggtcacagagactgagtgcctctgcccttatgaagctctagtgctcagaaggcccctatttctagatagtatagtcaaagatatgaaaaatctgctaaactcaacaagtctagaaacaagcttatcaattgaggcaccatggggagcaattaatgttcagtcaacctacaaaccaactgtatcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagtcatggacttgtctcagatgtactctcctgtcttcgagtacttatcaggtgacagacaagtggaagagtggcctaaagcaacctgcacaggtgactgcccagaaagatgtggctgcacatcatcaacctgcttacacaaagagtggccccactcaaggaattggagatgtaatcctacttggtgctggggtgtagggactggctgcacctgttgtggtttagacgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagagccaaggaacattcaacaaaagctccctcctgaaataatcacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacttgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacaactagatctgaaggcaaggccaacctatggtgcaggtgagatcaccgtgcttgtggaagttgctgacatggagttacacacaaagaagattgaaatatcaggcttaaaatttgcaggcctaacttgcacaggttgttatgcttgtagttctggcatctcttgtaaagttagaattcatgtagatgaaccagatgaacttacagtacatgttaaaagtgatgacccagatgtagttgcagctagctcaagtctcatggcgaggaagcttgaatttggaacagacagtacatttaaagctttctcagccatgcctaaaacctccctatgtttctacattgtggaaagagaatactgtaagagctgcagtaaagaagatacacaaaaatgtgttaacacgaaactcgaacaaccacagagcattttgatcgaacataagggaactataattggaaagcaaaacaatacttgcacggctaaagcgagttgctggttagagtcagttaagagttttttttatggtctgaagaatatgctcggtggcatatttggcaatgtttttataggcattttcacatttcttaccccctttatcttgttaatatttttctttatgtttgggtggaggatcctgttttgcttcaagtgttgcagaagaaccagaggcctattcaagtacagacacctcaaagacgatgaagaaactggttacagaaagatcattgaaagactgaacaacaaaaagggaaaaaacaggctgcttgatggtgaaagacttgctgacagaaagattgctgaactgttctccacgaaaacacacattggc

SEQ ID NO: 3741 - RNA, 3495 nt, synthetic construct
  misc_feature 1..3495: note = derived and/or modified CDS sequence (wt) from CCHVF(CCHVF SPU 44/08)__KJ682805.1__Gn-NSm-Gc
  source 1..3495: mol_type = other RNA
tctgaagagtctaatgatgactgtttatcaaggactcagctattgaggacagagaatgcggaaattcacagtgacaactatggtggtccaggtgacaagataactatctgcaacggttcaactattgtagatcagagattgggcagtgaactagggtgttacactatcaatagagtgaaatcatttaagctctgcgaaaacagtgctacaggtaaatcttgtgaaatagatagcaccccagtcagatgtaggcagggtttttgcttgaaaattactcaggagggaaggggccacgtgaagctatcaagaggctcagaagttgtcttggacgcctgtgactcaagctgtgaaataatgataccaaagggcactggggacatcctagttgactgctcaggtgggcagcaacatttcctaaaagataacctggttgatttaggatgccccaacatcccactgttaggcaaaatggccatctacatttgtagaatgtcaaatcatcccaagacaactatggctttccttttttggtttagctttggttatgtgataacctgtatactttgtaaagcaatcttctatctattaatagttgtagggacattaggaaaaaagttcaaacagtacagagagttaaaacctcagacctgtaccatatgtgaaacaaatcctgttaatgcaatagatgctgagatgcacgacctcaactgcagttacaatatatgtccttattgtgcatctaggttaacctcagatggtcttgccagacatgtaatgcaatgccccaaacggaaggaaaaaatagaagaaaccgaattatatttaaacttagaaagaatcccttgggttgttaggaaattactgcaggtgtcagaatccaccggtgtagcactaaagaggagtagttggctggttatactacttgtgctgctcacagtttcattgtcaccagtacaatcagcacccatcagccatggagagacagtcgaagtatatcaaaccagagaagggtacacaagtatttgcctttttgtactaggaagcatcctgtttttggtatcctgcctgatgagggggttggttgacagtgtcagcaatagctttttccctggcttgtccatttgtaagacatgttctattggcagtataaacggctttgaaattgaatctcacaaatgttactgtagcctattttgctgcccctactgtagacactgctctgccgacatagaaatacataagttgcacttgagcatctgcaagaaaaggaaaactgggagtaatgtcatgttagccgtctgtaagcgcatgtgctttagggcaactgtggaagttagcaataaagctttacttatccgaaacatcatcaacaccacttttgttgtgtgcatactgatattagcagtttgtgttgtcagcacctctgcagtggagatggaaaatctgccagcaggcacttgggaaaaagaggaagacctgacaaatttctgtcatcaggaatgccaagtcactgagactgaatgcctctgtccttatgaagctcttgtgctcaggaaacccttgtttttggacagtattgttaaaggcatgaagaacttgctaaattcaacaagcctagaaacaagcttatcaattgaggcaccatggggggcaataaatgtccaatcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaattgctcactgtctctgtaatggacttgtcacaaatgtattctcctgtctttgagtacctatcaggtgatagacaagtggaagaatggcccaaggcaacctgcacaggagattgcccagaaagatgcggctgcacgtcatcaacctgcctacacaaggaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgaccatcacattgtcagagccaagaaacattcagcagaagctccctccagaaatagttacattgcatcctaggattgaagaaggcttctttgacttaatgcatatacaaaaagtgctatcagcaagtacagtatgtaagctacagagttgcacacatggcgtgccaggagacctacagatctaccacattggaaacttgttaaaaggagacaaggtgaacgggcacctgattcacaaaattgaaccacacttcaacacctcctggatgtcttgggacggctgtgacctagactactactgtaatatgggggattggccgtcttgctcatatactggcgtaacccaacacaatcatgctgcatttgtaaacatgctcaacatcgaaactgattatacaaaaaacttccactttcactctaagagagttacagcacatggggacacaccacaattagatttaaaagctagaccaacttatggtgcaggtgaaatcactgtgctggtagaggttgctgacatggagttgcatacaaagaaaattgagatatcaggtttgaagtttgcaagcttaacttgcacaggctgttatgcttgtagttctggcatctcctgtaaggttaggatccatgtagatgaaccagatgagcttacagtacatgtgaagagcgaggatccagacatagttgctgctagttcaagtctcatggctaggaagcttgaatttgggacagatagcacatttaaagccttttcagccatgcccaaaacctccttgtgcttttacattgtggagagggaatactgcaaaagctgtagtaaagaagacacacaaaaatgtgtcaacacaaagcttgaacaaccacaaagcattttaatcgagcacaaagggacgataatcggaaagcagaacgacacttgtacagccaaagcaagttgctggttagagtcaattaagagttttttttatggactaaagaatatgcttagtggcatttttggcaatgttttcatagggattttcttattcctcgctccttttatcatgctaatacttttcttcatgtttggatggaggatcctgttctgcttcaagtgttgcagaagaactagaggcttatttaagtatagacacctcaaagacgatgaagaaatcggttacaggaaaatcattgagaggctaaacaacaaaaaagggaaaaacaaactacttgacggtgaaagactagctgataggaagatcgctgagctgttctctacaaaaacacacattggc

SEQ ID NO: 3742 - RNA, 3495 nt, synthetic construct
  misc_feature 1..3495: note = derived and/or modified CDS sequence (wt) from CCHVF(CCHVF SPU 383/87)__KJ682806.1__Gn-NSm-Gc
  source 1..3495: mol_type = other RNA
tctgaagagtctaatgatgactgtttatcaaggactcagctattgaggacagagaatgcggaaattcacagtgacaactatggtggtccaggtgacaagataactatctgcaacggttcaactattgtagatcagagattgggcagtgaactagggtgttacactatcaatagagtgaaatcatttaagctctgcgaaaacagtgctacaggtaaatcttgtgaaatagatagcaccccagtcagatgtaggcagggtttctgcttgaaaattactcaggagggaaggggccacgtgaagctatcaagaggctcagaagttgtcttggacgcctgcgactcaagctgtgaaataatgataccaaagggcactggggacatcctagttgactgttcaggtgggcagcaacatttcctaaaagataacctggttgatttaggatgccccaacatcccactgttaggcaaaatggcaatctacatttgtagaatgtcaaatcatcccaagacaactatggctttccttttttggtttagctttggttatgtgataacctgtatactttgtaaagtaatcttctatctattagtagttgtagggacattagggaaaaagttcaaacagtacagagagttaaaacctcagacctgtaccatatgtgaaacgaatcctgttaatgcaatagatgctgagatgcacgacctcaactgcagttacaatatatgtccttattgtgcatctaggttaacctcagatggtcttgccagacatgtaatacaatgccccaaacggaaggaaaaaatagaagaaaccgaattatatttaaacttggaaagaatcccttgggttgttaggaaattactgcaggtgtcagaatccaccggtgtagcactaaagaggagtagttggctggttatactacttgtgctactcacagtttcattgtcaccagtacaatcagcacctatcagccatggagagacagtcgaagtatatcaaaccagagaagggtacacaagtatttgcctttttgtactaggaagcatcctgtttttggtatcctgcctgatgaaggggttggttgacagtgtcggcaatagctttttccctggcttgtccatttgtaagacatgttctattggcagtataaacggctttgaaattgaatctcacaaatgttactgtagcctattttgctgcccctactgtagacactgctctgccgatatagaaatacataggttgcacttgagcatctgcaagaaaaggaaaactgggagtaatgtcatgttagccgtctgtaagcgcatgtgctttagggcaactgtggaagtaagcaataaagctttacttatccgaaacatcatcaacaccacttttgttgtgtgcatactgatattagcagtttgtgttgtcagcacctctgcagtggagatggaaaacctgccagcaggcacttgggaaaaagaggaagacctgacaaatttctgtcatcaggaatgccaggttactgagactgaatgcctctgtccttatgaagctcttgtgctcaggaaacccttgtttttggacagtattgttaagggcatgaagaacttgctaaattcaacaagcctagaaacaagcttatcaattgaggcaccatggggggcaataaatgtccagtcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaattgctcactgtctctgtaatggacttgtcacaaatgtattctcctgtctttgagtacctatcaggtgatagacaagtggaggaatggcccaaggcaacctgcacaggagattgcccagaaagatgcggctgcacgtcatcaacctgcctacacaaggaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgactatcacattgtcagagccaagaaacattcagcagaagctccctccagaaatagtcacattgcatcctaggattgaagaaggcttctttgacttaatgcatatacaaaaagtgctatcagcaagtacagtatgtaagctacagagttgcacacatggcgtgccaggagacctacagatctaccacattggaaacttgttaaaaggagacaaggtgaacgggcacctgattcacaaaattgaaccacacttcaacacctcctggatgtcttgggacggctgtgacctagactactactgtaatatgggggattggccatcttgctcatatactggcgtaacccaacacaatcatgctgcatttgtaaacatgctcaacatcgaaactgattatacaaaaaacttccactttcactctaagagagttacagcacatggagacacaccacaattagatttaaaagctagaccaacttatggtgcaggtgaaatcactgtgctggtagaggttgctgacatggagttgcatacaaagaaaattgagatatcaggtttgaagtttgcaagcttaacttgcacaggctgttatgcttgtagttctggtatctcctgtaaggttaggatccatgtagatgaaccagatgagcttacagtacatgtgaagagcgaggatccagacatagttgctgctagttcaagtctcatggctaggaagcttgaatttgggacagatagcacatttaaagccttttcagccatgcccaaaacctccttgtgcttttacattgtggagagggaatactgcaaaagctgtagtaaagaagacacacaaaaatgtgtcaacacaaagcttgaacaaccacaaagcattttaatcgagcacaaagggacgatatttggaaagcagaacgacacttgtacagccaaagcaagttgctggttagagtcagttaagagttttttttatggactaaagaatatgcttagtggcatttttggcaatgttttcataggggttttcttattcctcgctccttttatcatgctaatacttttcttcatgtttggatggaggatcctgttctgctttaagtgttgcagaagaactagaggcttatttaagtatagacacctcaaagacgatgaagaaatcggttacaggaaaatcattgagaggctaaacaacaaaaaagggaaaaacaaactgcttgacggtgaaagactagctgataggaagattgctgagctgttctctacaaaaacacacattggc

SEQ ID NO: 3743 - RNA, 3495 nt, synthetic construct
  misc_feature 1..3495: note = derived and/or modified CDS sequence (wt) from CCHVF(CCHVF SPU 130/89)__KJ682807.1__Gn-NSm-Gc
  source 1..3495: mol_type = other RNA
tctgaagagcctaattatgactgtttatcaaggactcagctattgaggacagagaatgcggaaattcacagtgacaactatggtggtccaggtgacaagataactatctgcaacggttcaactattgtagatcagagattgggcagtgaactagggtgttacactatcaatagggtgaaatcatttaagctctgcgaaaacagtgctacaggtaaatcttgtgaaatagatagcaccccagtcagatgtaggcagggtttttgcttgaaaattactcaggagggaaggggccacgtgaagctatcaagaggctcagaagttgtcttggacgcctgtgactcaagctgtgaaataatgataccaaagggcactggggacatcctagttgactgttcaggtgggcagcaacatttcctaaaagataacctggttgatttaggatgccccaacatcccactgttaggcaaaatggccatctacatttgtagaatgtcaaatcatcccaagacaaccatggctttccttttttggtttagctttggttatgtgataacctgcatactttgtaaagtaatcttctatctattaatagttgtagggacattaggaaaaaagttcaaacagtacagagagttaaaacctcagacctgtaccatatgtgaaacgaatcctgttaatgcaatagatgctgagatgcatgacctcaactgcagttacaatatatgtccttattgtgcatctaggttaacctcagatggtcttgccagacatgtaatgcaatgccccaaacggaaggaaaaaatagaagaaaccgaattatatttgaacttagaaagaatcccttgggttgttaggaaattactgcaggtgtcagaatccaccggtgtagcactaaagaggagtagttggctggttgtactacttgtgctactcacagtttcattgtcaccagtacaatcagcacctatcagccatggagagacagtcgaagtatatcaaaccagagaagggtacacaagtatttgcctttttgtactaggaagcatcctgtttctggtgtcctgcctgatgaaggggttggttgacagtgtcggcaatagttttttccctggcttgtccatttgtaagacatgttctattggcagtataaacggctttgaaattgaatctcacaaatgttactgtagcctattttgctgcccctactgtagacactgctctgccgatatagaaatacataagttgcacttgagcatctgcaagaaaaggaaaactgggagtaatgtcatgttagccgtctgtaagcgcatgtgctttagggcaactgtggaagtaagcaataaagctttacttatccgaaacatcatcaacaccacttttgttgtgtgcatactgatattagcagtttgtgttgtcagcacctctgcagtggagatggaaaacctgccagcaggcacttgggaaaaagaggaagacctgacaaatttctgtcatcaggaatgccaggtcactgagactgaatgcctctgcccttatgaagctcttgtgctcaggaaacccttgtctttggacagtattgttaaaggcatgaagaacttgctaaattcaacaagcctagaaacaagcttatcaattgaggcaccatggggggcaataaatgtccagtcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaattgctcactgtctctgtaatggacttgtcacaaatgtattctcctgtctttgagtacctatcaggtgatagacaagtggaggaatggcccaaggcaacctgtacaggagattgcccagaaagatgcggctgcacgtcatcaacctgcctacacaaagaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgaccatcacattgtcagagccaagaaacattcagcagaagctccctccagaaatagtcacattgcatcctaggattgaagaaggcttctttgacttaatgcatatacaaaaagtgctatcagcaagtacagtatgtaagctacagagttgcacacatggcgtgccaggagacctacagatctaccacattggaaacttgttaaaaggagacaaggtgaacgggcacctgattcacaaaattgaaccacacttcaacacctcctggatgtcttgggacggctgtgacctagactactactgtaatatgggggattggccatcttgctcatacactggcgtaacccaacacaaccatgctgcatttgtaaacatgctcaacatcgaaactgattatacaaaaaacttccactttcactctaagagagttacagcacatggggacacaccacaattagatttaaaagctagaccaacttatggtgcaggtgaaatcactgtgctggtagaggttgctgacatggagttgcatacaaagaaagttgagatatcaggtttgaagtttgcaagcttaacttgcacaggctgttatgcttgtagttctggtatctcctgtaaggtcaggatccatgtagatgaaccagatgagcttacagtacatgtgaagagcgaggatccagacatagttgctgctagttcaagtctcatggctaggaagcttgaatttgggacagatagcacatttaaagccttttcagccatgcccaaaacctccttgtgcttttacattgtggagagggaacactgcaaaagctgtagtaaagaagacacacaaagatgtgtcaacacaaagcttgaacaaccacaaagcattttaatcgagcacaaagggacgataattggaaagcagaacgacacttgtacagccaaagcaagttgctggttagagtcaattaagagttttttttatggactaaagaatatgcttagtggcatttttggcaatgttttcataggggttttcttattcctcgctccttttatcatactaatacttttcttcatgtttggatggaggatcctgttctgctttaagtgttgcagaagaactagaggcttacttaagtatagacacctcaaagacgatgaggaaatcggttacaggaaaatcattgagaggctaaacaacaaaaaagggaaaaacaaactgcttgacggtgaaagactagctgataggaagatcgctgagctgttctctacaaaaacacacattggc

SEQ ID NO: 3744 - RNA, 3495 nt, synthetic construct
  misc_feature 1..3495: note = derived and/or modified CDS sequence (wt) from CCHVF(CCHVF SPU 497/88)__KJ682808.1__Gn-NSm-Gc
  source 1..3495: mol_type = other RNA
tctgaagagtctaacgatgactgtttatcaaggactcagctattgaggacagagaatgcggaaattcacagtgacaactatggtggtccaggtgacaagataactatctgcaacggttcaactattgtagatcagagactgggcagtgaactagggtgttacaccatcaatagagtgaaatcatttaagctctgcgaaaacagtgctacaggtaaatcttgtgaaatagatagcaccccagtcagatgtaggcagggtttttgcttgaaaattactcaggagggaaagggccacgtgaagctatcaagaggctcagaggttgtcctggacgcctgtgattcaagctgtgaaataatgataccaaagggcacaggggacatcctagttgactgttcaggtgggcagcaacatttcctaaaagataacctggttgatctaggatgccccaacatcccactgttaggcaaaatggccatctacatttgtagaatgtcaaatcatcccaagacaactatggttttccttttttggtttagctttggctatgtgataacctgtatactttgtaaagtaatcttctatctattaatagttgtagggacgttaggaaaaaagttcaaacagtacagagagttaaaacctcagacctgtaccatatgtgaaacaaaccctgttaatgcaatagatgctgagatgcacgacctcaactgcagttacaatatatgtccttattgtgcatctaggttaacctcagatggtcttgccagacatgtaatgcaatgccccaaacggaaggaaaaaatagaagaaaccgaattatatttaaacttagaaagaatcccttgggttgttaggaaattactgcaggtgtcagaatccaccggtgtagcactaaagaggagtagttggctggttatactacttgtgctactcacagtttcattgtcaccagtacaatcagcacctatcagccatggagagacagtcgaagtatatcaaaccagagaagggtacacaagtatttgcctttttgtactaggaggcatcctgtttttggtatcctgcctgatgaaggggttggttgacagtgtcggcaatagttttttccctggcttgtccatttgtaagacatgctctattggcagtataaacggctttgaaattgaatctcacaaatgttactgtagcctattttgctgcccctactgtagacactgctctgccgatatagaaatacacaagttgcacttgagcatctgcaagaaaaggaaaacttggagtaatgtcatgttagccgtctgtaagcgcatgtgctttagggcaactgtggaagtaagcaataaagctttacttatccgaaacatcatcaacaccactttcgttgtgtgcatactgatattagcaatttgtgttgtcagcacctctgcagtggagatggaaaacctgccagcaggcacttgggaaaaggaggaagacctgacaaatttctgtcatcaggaatgccaggtcactgagactgaatgcctctgtccttatgaagctcttgtactcaggaaacccttgtttttggacagtattgttaaaggcatgaggaacttgctaaattcaacaagcctagaaacaagcttatcaattgaggcaccatggggggcaataaatgtccagtcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaactgctcactgtctctgttatggacttgtcacaaatgtattctcctgtctttgaatacctatcaggtgatagacaagtggaggaatggcccaaggcaacctgcacaggagattgcccagaaagatgcggctgcacgtcatcaacctgcctacacaaggaatggccccattcaagaaactggagatgcaaccctacttggtgttggggagtcggcactggatgcacctgttgtgggttggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgaccatcacattgtcagaaccaaggaacattcagcaaaagctccctccagaaatagtcacattgcatcctaggattgaagaaggcttctttgacttaatgcatatacaaaaagtactatcagcaagtacagtatgtaagctacagagttgcacacatggcgtgccaggagacctacagatctaccacattggaaacttgttaaaaggagacaaggtgaacgggcacctgattcacaaaattgaaccacacttcaacacctcctggatgtcttgggacggctgtgacctagactactactgtaacatgggggattggccatcttgctcatatactggcgtaacccaacacaatcatgctgcatttgtaaacatgctcaacatcgaaactgattatacaaaaaacttccactttcactctaagagagttacagcacatggagacacaccacaattagatttaaaagctagaccaacttatggtgcaggtgaaatcactgtgctggtagaggttgctgacatggagttgcatacaaagaaaattgagatatcaggtttgaagtttgcaagcttaacttgcacaggctgttatgcttgtagttctggtatctcctgtaaggttaggatccatgtagatgaaccagatgagcttacagtacatgtgaagagcgaggatccagacatagttgctgctagttcaagtctcatggctaggaagcttgaatttgggacagatagcacatttaaagccttttcagccatgcccaaaacctccttgtgcttttacattgtggagagggaatactgcaaaagctgtagtaaagaagacacacaaaaatgtgtcaacacaaagcttgaacaaccacaaagcattttaatcgagcacaaagggacgataattggaaaacagaacgacacttgtacagccagagcaagttgctggttagagtcaatcaagagttttttttatggactgaagaatatgcttagtggcatttttggcaatgttttcatagggattttcttattcttcgctccttttatcatgctaatacttttctttatgtttggatggaggatcctgttctgctttaagtgttgcagaagaactagaggcttgtttaagtatagacacctcaaagacgatgaagaagtcggttacaggaaaatcattgagaggctaaacaacaaaaaagggaaaaacaaactgcttgacggtgaaagactagctgataggaagatcgctgagctgttctctacaaaaacacacattggc

SEQ ID NO: 3745 - RNA, 3495 nt, synthetic construct
  misc_feature 1..3495: note = derived and/or modified CDS sequence (wt) from CCHVF(CCHVF SPU 18/88)__KJ682810.1__Gn-NSm-Gc
  source 1..3495: mol_type = other RNA
tctgaagagtctaatgatgactgtttatcaaggactcagctattgaggacagaaaatgcggaaattcacagtgacaactatggtggtccaggtgacaagataactatctgcaacggttcaactattgtagatcagagactgggcagtgaactaggatgttacactatcaatagagtgaaatcatttaagctctgtgaaaacagtgctacaggtaaatcttgtgaaatagatagcaccccagtcagatgtaggcagggtttttgcttgaaaattactcaggagggaaggggccacgtgaagctatcaagaggctcagaagttgtcttggacgcctgtgattcaagctgtgaaataatgataccaaagggcactggggacatcctagttgactgttcaggtgggcagcaacatttcctaaaagataacctggttgatctaggatgccccaacatcccactgttaggcaaaatggccatctacatttgtagaatgtcaaatcatcccaagacaactatgggtttccttttttggtttagctttggttatgtgataacctgtatactttgtaaagtaatcttctatctattaatagttgtagggacattagggaaaaagttcaaacagtacagagagttaaaacctcagacctgtaccatatgtgaaacgaatcctgttaatgcaatagatgctgagatgcacgacctcaactgtagttacaatatatgtccttattgtgcatctaggctgacctcagatggtcttgccagacatgtaatgcaatgccccaaacggaaggaaaaaatagaagaaaccgaattatatttaaacttagaaagaatcccctgggttgttaggaaattactgcaggtgtcagaatccaccggtgtagcactaaagaggagtagttggctggttatactacttgtgctactcacagtttcattgtcaccagtacaatcagcacctatcagccatggagagacagtcgaagtatatcaaaccagagaagggtacacaagtatttgcctttttgtactagggagcatcctgtttttggtatcctgcctgatgaaggggttggttgacagtgtcggcaatagtttttcccctggcttgtccatttgtaagacatgttctattggcagtataaacggctttgaaattgaatctcacaaatgttactgtagtctgttttgctgcccctactgtaggcactgctctgccgatatagaaatacataagttgcacttaagcatctgcaagaaaagaaaaactgggagtaatgtcatgttagccgtctgtaagcgcatgtgctttagggcaactgtggaagtaagcaataaagctttacttatccgaaacatcatcaacaccacttttgttgtgtgcatactgatattagcagtttgtgttgtcagcacctctgcagtggagatggaaaacctgccagcaggcacttgggaaaaagaggaagacctgacaaatttctgtcatcaggaatgccaggtaactgagactgaatgcctctgtccttatgaagctcttgtgctaaggaaacccttgtttttggacagtattgttaaaggcaagaagaacttgctaaattcaacaagcctagaaacaagcttatcaattgaggcaccatggggggcaataaatgtccagtcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaattgctcactgtctctgttatggacttgtcacaaatgtattctcctgtctttgagtacctatcaggtgatagacaagtggaggaatggcccaaggcaacctgcacaggagattgcccagagagatgcggctgcacgtcatcaacctgcctacacaaggaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgaccatcacattgtcagagccaagaaacattcagcaaaagctccctccagaaatagtcacattgcatcctaggattgaagaaggcttctttgacttaatgcatatacaaaaagtgctatcagcaagtacagtatgcaagctacagagttgcacacatggcgtgccaggagacctacagatctaccacattggaaacttgttaaaaggagacaaggtgaacgggcacctgattcacaaaattgaaccacacttcaacacttcctggatgtcttgggacggctgtgacctagactactactgtaatatgggggattggccatcttgctcatatactggcgtaacccaacacaatcatgctgcatttgtaaacatgctcaacatcgaaactgattatacaaaaaacttccactttcactctaagagagttacagcacatggagacacaccacaattagatttaaaagctagaccaacttatggtgcaggtgaaatcactgtgctggtagaggttgcagacatggagttgcatacaaagaaaattgagatatcaggtttgaagtttgcaagcttaacttgcacaggctgttatgcttgtagttctggtatctcctgtaaggttaggatccatgtagatgaaccagatgagcttacagtacatgtgaagagcgaggacccagacatagttgctgctagttcaagtctcatggctaggaagcttgaatttgggacagatagcacatttaaagccttttcagccatgcccaaaacctccttgtgcttttacattgtggagagggaatactgcaaaagctgtagtaaagaagacacacaaaaatgtgtcaacacaaagcttgaacaaccacaaagcattttaatcgagcacaaagggacgataattgggaagcagaacgacacttgtacaggcaaagcaggttgctggttagagtcaatcaagagttttttttatggactaaagaatatgcttagtggcatttttggcaatgttttcatagggattttcttattcctagctccttttatcatgctaatacttttcttcatgtttggatggaggatcctgttctgctttaagtgttgcagaagaactagaggcctatttaagtatagacacctcaaagacgatgaagaaatcggttacaggaaaatcattgagaggctaaaaaacaaaaaagggaaaaacaaactgcttgatggtgaaagactagctgataggaagatcgctgagctgttctctacaaaaacacacattggc

SEQ ID NO: 3746 - RNA, 3495 nt, synthetic construct
  misc_feature 1..3495: note = derived and/or modified CDS sequence (wt) from CCHVF(CCHVF SPU 556/87)__KJ682811.1__Gn-NSm-Gc
  source 1..3495: mol_type = other RNA
tccgaggagtctgatggtgactgtatatcaagaactcaactattgaggacagagactgcagaaatccacagtgacaactatggtggcccaggtgacaaaataactatctgcaatggttcaactattgtagatcaaagactaggcagtgaactggggtgttatactatcaatagggtaaagtcatttaagctttgcgaaaacagtgccacaggaaaatcttgtgaaatagatagcaccccagttaagtgcagacaaggtttttgcttgaaaatcactcaagaagggaggggccacgtgaagctgtcgagaggctcagaaattgtcttggacgcctgcgattcaagctgtgaaataatgataccaaagggcaccggagacatcttagttgactgttcaggtggacaacaacatttcttaaaagataatttgattgatcttggatgtcccaatatcccattattaggcagaatggccatctacatttgcagaatgtccaatcatcctaaaacaaccatggcctttctcttttggtttagctttggttatgtgataacctgtatcctttgtaaggtgatcttttacctattgatagttgcagggacagtagggaaaaagttcaaacagtatagagagttgagacctcagacctgcaccatatgtgaaacaactcctgtcaatgcaatagatgctgaaatgcatgacctcaactgcagttacaatatatgtccttattgcgcatctagattaacctcagatggtcttgccagacatgtaatgcaatgccccaagcggaaggaaaaaatagaggaaactgaattatacttaaacctagaaaggattccctgggttgttaggaaattattgcaagtttcagagtctaccggtgtggcattgaagaggagcagttggctgacagtgctgcttgtgttgcttatagtttcattgtcaccggtgcagtcagcacctattggtcatggaaagacaattgaaacatatcaggccagagaggggtatacaagcttctgcctttttatactaggaagcatcttgtttatagtctcttgcctagtaaagggtctgattgacagtgtcggtaacagcttcttccctggactgtccatttgcaagacatgctctattggcagtgtaaatggttttgagattgaatcccacaaatgttactgtagtctattttgttgcccttattgtagacactgctctgccgatagagaaatccataagttgcacttgagcatctgcaaaaaaagaaaaactgggagcaatgtcatgtcggccgtctgcaagcgcatgtgctttagagcaaccatagaagttagcaatagggctttacttatccggagtatcatcaataccacttttgctgtgtgtatactaacactagcagtttgtgttgtcagcacctctgcagtggagatggaaagtctaccagccggcacctgggagagagaggaagacctaacaaacttctgtcatcaggaatgccaagtcactgagactgaatgcctctgtccttacgaagcccttgtactcagaaaacccttatttttagacagtattgttaaaggcaagaagaacttgctaaactcaacaagcttggaaacaagcttatcaattgaagcaccatggggtgcaataaatgtccaatcaaccttcaaacctactgtgtcagctgcaaacatagcacttagctggagctcagtggaacacagaggcaacaagattttggtttcaggcaggtcagaatcaatcatgaagctggaggaaaggacaggaatcagctgggatctgggagtagaagacgcctctgagtccaaattgctcaccgtctctgtcatggacttgtcacagatgtattcccccgtctttgagtacctgtcaggtgatagacaggtagaagagtggcccaaggcgacctgtacaggcgattgcccagaaagatgtggctgcacatcatcaacctgtttgcacaaggaatggccccattcaaggaactggagatgcaaccccacttggtgttggggggtcggcactggatgcacctgttgtggactagatgtaaaagacctctttacagattacatgtttgtcaagtggaaagttgaatacataaaaacagaggccatagtgtgcgtcgaacttactagccaagaaagacaatgtagcttgattgaagcaggcacaagattcaatttaggtcctgtgactatcacattgtcagagccaagaaacattcagcaaaagctccctccagagataatcacattgcatcctagaattgaagaaggcttttttgacttaatgcatgtgcaaaaagtgctgtcagcaagcacagtgtgcaagctacagagttgcacacatggtgttccaggagacctacaggtctaccacatcggaaacttgttaaaaggagacaaggtaaacgggcatctgattcacaagattgaaccacatttcaacacttcctggatgtcttgggatggctgtgacctagactactactgcaatatgggggactggccttcttgcacatacactggagtaacccaacataaccatgctgcatttgtaaatttgctcaatatcgaaaccgattatacaaaaaactttcattttcactccaagagagttactgcacatggagacacaccacagttagacttgaaggccagaccaacttatggtgcaggggaggtcactgtactagtggaggttgctgacatggagttgcacacaaagaaaattgagatatcaggcttgaagtttgcaagcctatcttgcacaggctgctatgcttgtagctctggtatctcctgtaaggtcaggatccatgtagatgaaccagatgagcttacagtacatgtgaagagtgaagacccagacatagttgctgcaggctcaagtctcatggcaaggaagcttgaatttggggcagatagtacattcaaagccttttcagccatgcccaaaacctccttgtgcttttacattgtggagagagaatactgtaagagctgcagtagagaagacacacaaaaatgtgttaacactaaacttgagcgaccacagagcattttgatcgaacataaaggaacgattattggaaagcaaaacgacacttgcacagctaaagcaagctgctggctagagtcagtcaaaagttttttctacggattaaagagtatgcttagtggcatttttggcaacgttttcatagggattttcttattcattgctccttttgtcctgttaatacttttctttatgtttgggtggaggattctgttctgctttaagtgctgcagaagaaccaggggcctatttaagtacagacacctcaaggacgatgaagaaaccggttacaggaaaatcattgagaggctaaataacaaaaagggaaaaaacaaactacttgatggggaaaggctagctgacaggaaaatcgccgagttattctccacaaaatcacatatcggc

SEQ ID NO: 3747 - RNA, 3495 nt, synthetic construct
  misc_feature 1..3495: note = derived and/or modified CDS sequence (wt) from CCHVF(CCHVF SPU 431/85)__KJ682812.1__Gn-NSm-Gc
  source 1..3495: mol_type = other RNA
tccgaggagtctgatggtgactgtatatcaagaactcaactattgaggacagagactacagaaatccacagtgacaactatggtggcccaggtgacaaaataactatctgcaatggttcaactattgtagatcaaagactaggcagtgaactggggtgttatactatcaatagggtgaagtcatttaagctttgcgaaaacagtgccacaggaaaatcttgtgaaatagatagcaccccagttaagtgcagacaaggtttttgcttgaaaatcactcaagaagggaggggccacgtgaagctgtcgagaggctcggaaattgtcttggacgcttgcgattcaaactgtgaaataatgataccaaagggcaccggagacatcttagttgactgttcaggtggacaacaacatttcttaaaagataatttgattgatcttggatgtcccaatatcccattattaggcaaaatggccatctacatttgcagaatgtccaatcatcctaaaacaaccatggcctttctcttttggtttagctttggttatgtgataacctgtatactttgtaaggtgatcttttacctattgatagttgcagggacagtaggaaaaaagttcaaacagtatagagagttgagacctcagacctgcaccatatgtgaaacaattcctgtcaatgcaatagatgctgaaatgcatgacctcaactgcagttacaatatatgtccgtattgcgcatctagattaacctcagatggtcttgccagacatgtaatgcaatgccctaagcggaaggaaaaagtagaggaaactgaattatacttaaacctagaaaggattccctgggttgttaggaaattattgcaagtttcagagtctaccggtgtggcattgaagaggagcagttggctgacagtgctgcttgtgttgcttatagtctcattgtcaccggtgcagtcagcacctattggtcatggaaagacaattgaaacatatcaggccagagaagggtacacaagcttctgcctttttatactaggaagcatcttgtttgtagtctcttgcctagtaaagggtctaattgacagtgtcggtaacagctttttccctggattgtccatttgcaagacatgctcgattggcagtataaatggttttgagattgaatcccacaaatgttactgtagtctattttgttgcccttattgtagacactgccctgccgatagagaaatccataagttgcacttgagcatctgcaaaaaaagaaaaactgggagcaatgtcatgttggccgtctgcaagcgcatgtgctttagagcaaccatagaagttagcaatagggctctacttatccggaatatcatcaatactacttttgttgtgtgtatactgacactagcagtttgtgttgtcagcacctctgcagtggagatggaaagtctaccagccggcacttgggagaaagaggaagacctaacaaacttctgtcatcaggaatgccaagtcactgagactgaatgcctctgtccttacgaagcccttgtactcagaaaacccttatttttagacagtattgttaaaggcaggaagaacttgctaaactcaacaagcttggaaacaagcttatcaattgaggcaccatggggtgcaataaatgtccaatcaaccttcaaacccactgtgtcagctgcaaacatagcacttagctggagctcagtggaacacagaggcaacaagattttggtttcaggcaggtcagaatcaatcatgaagctggaggaaaggacaggaatcagctgggatctgggagtagaagacgcctctgagtccaaattgctcaccgtctctgtcatggacttgtcacaaatgtattcccccgtctttgagtacctgtcaggtgatagacaggtagaagagtggcccaaggcgacctgtacaggcgattgcccagaaagatgtggctgcacatcatcaacctgtttgcacaaggaatggccccattcaaggaactggagatgcaaccccacttggtgttggggggtcggcactggatgcacctgttgtgggctagatgtaaaagacctctttacagattacatgtttgtcaagtggaaagttgaatacataaaaacagaggccatagtgtgtgtcgaacttactagccaagaaaggcaatgtagcttgattgaagcaggcacaagattcaatttaggtcctgtgactatcacattatcggagccaagaaacattcagcaaaagctccctccagaaataattacattgcatcctagaattgaagaaggcttttttgacttaatgcatgtgcaaagagtgctgtcagcaagcacagtgtgcaagctacagagttgcacacatggtgtgccaggagacctacaggtctaccacatcggaaacttgttaaaaggagacaaggtaaacgggcatctgattcacaagattgaaccacatttcaacacttcctggatgtcttgggatggctgtgacctagattactactgcaatatgggggattggccttcttgcacatacactggagtaacccaacataaccatgctgcatttgtaaatttgctcaatatcgaaaccgattatacaaaaaactttcattttcactccaagagagttactgcacatggagacacaccacaattagacttgaaggccagaccaacttatggtgcaggggaggttactgtactagtggaggttgctgacatggagctgcacacaaagaaaattgagatatcaggcttgaagtttgcaagtctaacttgcacaggctgctatgcttgtagctctggtatctcctgtaaggtcaagatccatgtagatgaaccagatgagcttacagtacatgtgaagagtgaagacccagacatagttgctgcaggctcaagtctcatggcaaggaagcttgaatttggggcagatagtacattcaaagccttttcagccatgcccaaaacctccttgtgcttttatattgtggagagagaatactgtaagagctgcagtagagaggacacacgaaaatgtgttaacactaagcttgatcgaccacagagcattttgatcgaacataaaggaacgattattggaaagcaaaacaacacatgcacagctaaagcaagctgctggctagagtcagtcaaaagttttttctacggattgaagaatatgcttagtggcattttcggtaatgttttcatagggattttcttattcattgctccttttgtcctgttaatacttttctttatgtttgggtggaggatcctgttctgctttaagtgctgcagaagaaccagaggcctatttaagtacagacacctcaaggacgatgaagaaaccggttacaggaaaatcattgagaggctaaataacaaaaagggaaaaaacaaactacttgatggggaaaggctagctgataggaaaatcgccgagttattctccacaaaatcacatatcggc

SEQ ID NO: 3748 - RNA, 3495 nt, synthetic construct
  misc_feature 1..3495: note = derived and/or modified CDS sequence (wt) from CCHVF(CCHVF SPU 48/90)__KJ682813.1__Gn-NSm-Gc
  source 1..3495: mol_type = other RNA
tccgaagaacccagtgatgactgcatatcaagaactcagctattgaggacagagactgcagagatccacggcgacaactatggtggcccgggtgacaaaataactatctgcaatggctcaactattgtagaccaaagactgggcagtgagctagggtgttacactatcaacagagtgaagtcattcaagctatgcgaaaatagtgccacagggaagagctgtgtaatagacagtgtcccagttaaatgcaggcaaggttattgtctaagaatcactcaggaaggaaggggccatgtaaaattatctaggggctcagaggttgtcttagatgcatgcgatacaagctgtgaaataatgatacctaagggcaccggtgacatcctagttgactgttcaggtgggcagcaacattttctaaaggacaatttgatagatctaggatgccccaaaattccattattgggcaaaatggctatctacatttgcagaatgtcgaatcaccccacaacaaccatggctttcctcttctggttcagctttggctatgtaataacttgtatactttgcaaggccatcttttacttgttaataattattggaacactagggaaaaggttcaggcagtatagagagttaaaacctcagacctgcaccatatgtgagacaactcctgtaaatgcaatagatgctgagatgcatgacctcaattgcagttacaacatttgtccctactgtgcatctagactaacctcagatgggcttgctaggcatgtgacacagtgccctaagcggaaggagaaagtggaagaaactgaactgtacttgaacttagaaagaattccttgggttgtaagaaagctattgcaggtatcagagtccaccggtgtggcattgaaaagaagcagctggctgattgtgctgcttgtgctgttcacggtttcattgtcgccagttcaatcagcacccattggtcacgggaagacaattgaggcataccgtgccagggagggatacacaagtatatgtctctttgtactaggaagtatcctatttgtagtctcttgcctaatgaaaaggttggttgacagtgttggcaactccttcttccctggactgtccatttgcaaaacgtgctccataagcagcattaatggctttgaaattgagtcccataagtgctattgcagcttattctgctgcccctattgtaggcactgctctgctgataaagaaattcacaagctgcacttgagcatctgcaaaaaaagaaaaacaggaagtaatgtcatgttggctgtctgcaagcgcatgtgtttcagggccaccatggaagtaagtgacagagccctgtttattcgtagcatcatcaataccacttttgttttgtgcatactgatactagcagtttgtgttgttagcacctcagcagtggagatggaaaacctaccagccgggacttgggaaagagaagaagacctaacaaatttctgtcatcaggaatgccaggttacagagactgaatgcctctgcccttatgaagctctagtactcagaaagcctctattccgagacagtatagttaaaggcatgaaaaatctgctaaactcaacaagtttagaaacaagtctatcaattgaggcaccatggggggcaataaatgttcagtcaacctacaagccaactgtgtcgactgcaaacatagcactcagctggagctcagtggaacacagaggcaataagatcttggtttcaggcagatcagaatcaattatgaagctggaagaaaggacagggatcagctgggatctcggcgtagaagacgcctctgagtccaaactgcttacagtctctgtcatggacttgtctcagatgtactctcctgtcttcgagtacttatcaggagacagacaggtggaagagtggcccaaagcaacttgtacaggtgactgcccagaaagatgtggctgcacatcatcaacatgtttgcacaaagaatggccccactcaagaaattggagatgcaatcctacttggtgctggggtgtagggactggctgcacctgttgtggattagatgtgaaagacctttttacagattatatgtttgtcaagtggaaagttgaatacatcaagacagaggccatagtgtgtgtagaacttaccagtcaggaaaggcagtgtagcttgattgaagcgggcacaaggttcaatttaggtcctgtgaccatcacactgtcagaaccaagaaacatccaacagaagctccctcctgaaataatcacactacatcctaggattgaagaaggtttttttgacctgatgcacgttcagaaagtgttatcagcaagcacagtgtgtaagttgcagagttgcacacatggtgtaccaggagacctacaggtctaccacatcggaaatttattaaaaggggacaaggtaaatggacatctaattcataaaattgagccacacttcaacacttcctggatgtcctgggatggttgtgacctagactactactgcaacatgggagattggccttcttgcacatacacaggagtcacccaacacaatcgtgcttcatttgtaaacctgctcaacattgaaactgattacacaaaaaacttccattttcactctaaaagggtcactgcacacggagacacaccacaactggatcttaaggcaagaccaacctatggtgcaggtgagattactgtactggtagaagttgctgacatggagttacacacaaagaagattgaaatatcaggcttaaaatttgcaagcttgacttgcacaggttgttatgcttgtagctctggcatctcatgcaaagttagaattcatgtggacgaaccagatgaacttacagtgcatgttaaaagtgatgatccagatgtagttgcagctagctcaagcctcatggcaagaaagcttgaatttggaacagacagcacatttaaagctttctcagccatgcctaaaacttcgctatgtttctacattgttgaaaaagaatactgcaagagctgcagtgaagaagacacaaaaaaatgtgttaacacaaaacttgagcaaccacaaagcattttgatcgaacacaagggaactataatcggaaagcaaaacagcacttgcacagccaaagtgagttgctggttagagtcagccaagagttttttttatggtctaaaggacatgcttagtggcatttttggcaatgtctttataggtattttcttgttccttgcccccttcatcctgttaatactattctttatgtttgggtggaggatcctactttgctttaaatgttgtagaagaactagaggcctgttcaagtatagacacctcaaggacgatgaagaaactggttatagaaggattattgaaagactaaacaataaaaaaggaaaaaacaaattgcttgatggtgaaagacttgctgatagaagaattgctgaactgttctccacaaaaacacacattggc

SEQ ID NO: 3749 - RNA, 3495 nt, synthetic construct
  misc_feature 1..3495: note = derived and/or modified CDS sequence (wt) from CCHVF(CCHVF SPU 187/90)__KJ682814.1__Gn-NSm-Gc
  source 1..3495: mol_type = other RNA
tccgaagaacctagtgatgactgcatatcgagaactcaactattgaggacagagactgcagagatccacggcgacaactatggtggcccgggtgacaaaataaccatctgcaacggctcaactattgtagaccaaagactgggcagtgagctagggtgttacactatcaatagagtgaagtcattcaagctatgcgaaaatagtgccacagggaagagctgtgaaatagacagtgtcccagttaaatgcaggcagggttattgcctaagaatcactcaggaagggaggggccatgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcgaatcaccccaaaacaaccatggctttccttttctggttcagctttggctacgtaataacttgtatactttgcaaggccatcttttacttgttaataattattggaacgctagggaagaggttcaagcagtatagagagttaaaacctcagacctgcaccatatgtgagacaactcctgtaaatgcaatagatgctgagatgcatgacctcaactgcagttacaacatttgtccctactgtgcatctagactaacctcagatgggcttgctaggcatgtgacacaatgccctaagcggaaggagaaagtggaagaaactgaactatacttgaacttagaaagaattccttgggttgtaagaaagctgttgcaggtatcagagtccactggtgtggcattgaaaagaagcagctggctgattgtgctgcttgtgctgttcacggtttcattgtcaccagttcaatcagcacccattggtcacgggaagacaattgaggcataccgggccagggagggatacacaagtatatgtctctttgtactaggaagtatcctatttgtagtctcttgcctaatgaaagggctggttgacagtgttggcaactccttcttccctggactgtccatttgcaaaacgtgctccataggcagcattaatggctttgaaattgagtcccataagtgctattgcagcttattctgttgcccttattgtaggcactgctctgctgataaagaaattcataagctgcacttgagcatctgcaaaaaaagaaaaacaggaagtaatgtcatgttggctgtctgcaagcgcatgtgtttcagggccaccatggaagtaagtaacagagccctgtttatccgtagcatcatcaacaccacttttgttttatgtatactgatactagcagtttgtgttgttagtacctcagcagtggagatggaaaacctaccagccgggacctgggaaagagaagaggacctaacaaatttctgtcatcaggaatgccaggttacagagactgaatgcctctgcccttatgaagctctagtactcagaaggcctctattcctagatagtatagttaaaggtatgaaaaatctgctaaattcaacaagtttagaaacaagtttatcaattgaggcaccatggggggcaataaatgttcagtcaacctacaaaccaactgtgtcaactgcaaacatagcactcagttggagctctgtggaacacagaggcaataagatcttggtttcaggcagatcagaatcaattatgaagctggaagaaaggacaggaatcagctgggacctcggcgtggaagacgcctctgagtctaaactgcttacagtctctgtcatggacttgtctcagatgtactctcctgtcttcgagtacttatcaggagacagacaggtggaagagtggcccaaggcaacttgtacaggtgactgcccagaaagatgtggctgcacatcatcaacatgtttacacaaagaatggccccactcaagaaattggaggtgcaatcccacttggtgctggggtgtagggactggctgcacctgttgtggattagatgtgaaggacctttttacagattatatgtttgtcaagtggaaagttgaatatattaagacagaagccatagtgtgtgtagaacttaccagtcaggaaaggcagtgtagcttgattgaagcaggcacaaggttcaatttaggtcctgtaaccatcacactgtcagaaccacgaaacatccaacagaagctccctcctgaaataatcacactgcatcccaggatcgaagaaggtttttttgacctgatgcatgtacagaaagtgttatcggcaagcacagtgtgtaagttgcagagttgcacacatggtgtgccaggagacctacaggtctaccacatcgggaatttattaaaaggggataaggtgaatggacatctaattcataaaattgagccacacttcaacacttcctggatgtcctgggatggttgtgacctagactactactgcaacatgggagattggccttcttgcacatacacaggagtcacccaacacaatcatgcttcatttgtaaacctgctcaacattgaaactgattacacaaaaaacttccactttcactctaaaagggtcactgcacacggagacacaccacaactagatcttaaggcaagaccaacctatggtgcaggtgagatcactgtactggtagaagttgctgacatggagttacacacaaagaagattgaaatatcaggcttaaaatttgcaagcttgacttgcacaggctgttatgcttgtagctctggcatctcatgcaaagttagaattcatgtggatgaaccagatgaacttacagtacatgttaaaagtgatgatccagatgtagttgcagctagctcaagtctcatggcaagaaagcttgaatttggaacagacagtatatttaaagctttctcagccatgcctaaaacttctctatgtttctacattgttgaaagagaacactgtaagagctgcagcgaagaagacactaaaaaatgtgttaacacaaaacttgagcaaccacaaagcattttgatcgaacacaagggaactataatcggaaagcaaaacagcacttgcacagccaagacgagttgctggttagagtcagtcaaaagttttttttatggtctaaagaacatgcttagtggcatttttggaaatgtttttataggtattttcttgttccttgcccccttcatcctgttaatactgttctttatgtttgggtggaggatcctattttgctttaaatgttgcagaagaactagaggcctgttcaagtatagacacttaaaggacgatgaagaaactggttatagaaggattattgaaagattaaacaataaaaaaggaaaaaacaaactgcttgatggtgaaagacttgctgatagaagaattgccgaactgttctctacaaaaacacacattggc

SEQ ID NO: 3750 - RNA, 3495 nt, synthetic construct
  misc_feature 1..3495: note = derived and/or modified CDS sequence (wt) from CCHVF(CCHVF Haskovo-V46/13)__KR092379.1__Gn-NSm-Gc
  source 1..3495: mol_type = other RNA
tccgaagagctaggtgatgactgtatatcaagaactcagctattgaggacagaaacagcagagatacatgatgacaactatggtggtccaggtgataaaataactatctgcaatggttcaaccattgtagatcagagactgggcagtgaactaggatgttataccatcaacagggggaagtcattcaagctatgcgaaaacagcgctacagggaaaacctgtgagatagacagcactccggttaagtgcaggcaaggtttttgtttaaaaatcacccaagagggaaggggccacgtaaaattatctagaggctcagaggttgtcctggatgcttgcgactcaagctgtgaagtaatgatacctaaaggcactggagatatcctagtggactgttcaggtgggcagcaacatttcttaaaagacaacttaattgacctagggtgcccccatatcccgctattgggtaagatggctatttacatttgcagaatgtctaatcatcctagaacaaccatggcttttctcttctggtttagctttggctatgtgatcacttgtatattttgcaaggctcttttttattcattgataattattgggacactagggaaaaaaatcaagcaatatagggaactgaaacctcaaacctgcaccatatgtgagacaactcctgtcaatgcaatagatgctgaaatgcatgacctcaactgtagttacaatatatgcccttattgtgcatcaagattgacctccgatgggctagccaggcatgtaacacaatgccccaagcggaaagagaaagttgaggagactgaactgtacctgaacctggaaagaattccttggattgtcagaaagctattgcaggtgtcagagtccaccggtgtggcattgaaacgaagcagctggctgattgtactgcttgtgttactcccagtttcattgtcgccggttcaatcagcacctgttggtcatggaaagacaatcgaaacatatcagaccagagaaggattcacaagcatctgtctctttatgttaggaagcattctatttatagtttcttgcttggtgaaagggctggttgacagtgttggtgacagcttcttccccggcctgtctgtctgtaagacatgctctattggcagtataaatggctttgaaattgaatcgcataaatgctactgtagcctattttgctgcccctactgtaggcactgctctgctgacagagaaattcaccagctacacttgagtatctgcaaaaaaaggaaaacggggagcaatgtcatgctggctgtctgcaaacgcatgtgctttagggcaaccatagaagcaagcagaagagccttgctcatccgaagcattatcaataccacttttgcaatgtgcattctaacattgacaatctgtgttgttagcacctctgcagtagagatggaaaaccttccagcaggtacttgggagagagaggaagacctgacaaatttctgtcatcaggaatgccaggtaactgagacggagtgcctctgtccatacgaagctcttgtgctcagaaagccccttttcttagacagtatagttaaaggtatgaaaaatttgctaaactcaacaagcttggaaacaagcttatcaattgaggcaccatggggagcaataaatgtccagtcaacctttaaaccaacagtatcgactgcaaacatagcactcagttggagctcagtggagcacagaggcaacaagatcttagtcacaggcaggtctgaatcaatcatgaaactagaggaaaggacaggagtcagctgggatctaggcgtagaagatgcctcagaatccaaattacttaccgtttctatcatggatttatcacaaatgtattcccctgtttttgagtacttgtcaggggacagacaggttgaagaatggccaaaagcaacttgtacaggtgattgcccagaaaggtgtggctgcacatcatcaacctgcttacataaagaatggcctcactcaagaaactggagatgcaatcccacttggtgctggggagtaggaaccggctgcacctgttgcggggtggatgtaaaagacctttttacggatcacatgttcgtcaaatggaaagttgaatacataaaaactgaagccatagtatgtgttgagctcaccagccaagaaagacagtgcagtctgattgaggcaggtactagattcaacttgggccctgtgactattaccctgtctgagccaagaaacattcagcagaagcttccccctgaaattatcacgttgcatcccaaaattgaagaaggcttctttgacttgatgcatgtacaaaaagtgttgtctgcaagtacagtgtgtaaactgcagagttgcacacatggtataccaggagatctacaagtttaccacattggcaacttgttgaaaggggatagagtaaacgggcatctaattcacaaaattgaaccacatttcaacacctcttggatgtcctgggatggttgtgatttagattactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattggacttaaaagcaaggccgacctacggtgcaggtgagatcactgtgctggttgaggttgctgacatggagttgcataccaagaaagttgaaatatcaggcttgaaatttgcaagtttgacttgcacgggttgctatgcttgtagctctggcatctcctgcaaagttaggattcatgtagatgaaccagatgagcttacagtacatgtaaagagcagtgatcctgatgtggttgcagctggcacaagtcttatggcgaggaagcttgaatttggaacagacagcacattcaaggccttttcagctatgcccaaaacctctttatgtttttacattgtggagagagaatactgcaagagctgcagtgaagatgatacacaaaaatgtgttgacacaaaacttgagcagccacagagcatactaattgagcacaaaggaacaataattggaaagcagaatgatacttgcacagccagggcaagctgttggctagagtcagtcaagagttttttttatggattgaagaatatgcttggcagtgtttttggtaattttttaataggcattttgttattccttgccccttttgtcctgttggtgcttttctttatgtttgggtggaaaatcttgttttgctttaaatgttgcaggaggaccagaggcttattcaaatatagacacctcaaagacgatgaggaaacaggctacagaaggattattgaaagactgaacagcaaaaaagggaaaaacagactgcttgatggtgaaaggctggctgataggaaaattgctgagctgttctccacaaaaacacacattggc

SEQ ID NO: 3751 - RNA, 3495 nt, synthetic construct
  misc_feature 1..3495: note = derived and/or modified CDS sequence (wt) from CCHVF(CCHVF 24-R-2012)__KR814856.1__Gn-NSm-Gc
  source 1..3495: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgacacaagctgcgaagtaatgatacctaaaggcactggagatatcctggtggactgttcaggtggacagcaacatttcttaaaagacaatttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtgtctgtctctttatgttaggaagcatcctgtttttagtctcttgcttggtgaaggggctggttgacagtgtcagtgacagcttcttccctggcctgtctgtctgtaagacatgctctattggcagtataaatggctttgaaattgaatcgcataaatgctactgtagcctattttgctgcccctactgtaggcactgctctgctgacagagaaattcatcagttacacttgagtatctgcaaaaaaagaaaaatgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacttgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 3752 - RNA, 3495 nt, synthetic construct
  misc_feature 1..3495: note = derived and/or modified CDS sequence (wt) from CCHVF(CCHVF 36-ST-2014)__KR814857.1__Gn-NSm-Gc
  source 1..3495: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtaaagtcattcaagctatgcgaaaacagtgccacagggaaaacctgtgagatagacagcactccggtcaagtgcaggcaaggtttttgtttgaaaatcacccaagaggggaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaagctcttttttattcattgataattattgggacactaggaaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgaagcagctggctgattgtgctgcttgtgttactcacagtctcattgtcaccggttcaatcagcacctgttggtcatggtaagacaattgaaacatatcagaccagagaaggattcacaaatatctgtctctttatgttaggaagcatcctattcatagtttcttgcctggtaaaggggctggttgacagtgtcagtgacagctttttccccggcctgtctgtctgtaagacatgctctattggcagtataaatggctttgaaattgaatcgcataaatgctactgtagtttattttgctgcccctactgtaggcactgctctgctgacagagaaattcaccagttgcacttgggtatctgcaaaaaaagaaaaacggggagcaatgtcatgctggctgtctgcaagcgcatgtgctttaaggcaaccatagaagcaagcagaagagccttgctcatccgaagcattatcaataccacttttgtaatatgcatcctaacattagcaatctgtgttgttagcacttctgcagtagagatggaaaatcttccagcaggcacttgggagagagaggaagacctgacaaatttctgccatcaggaatgccaggtaagcgagacggaatgcctctgtccatacgaagctcttgtgctcaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccattctaaaagagtcacagcacatggagacacaccacaattagacttaaaagcaaggccgacttacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgatcagccacagagcatactaattgagcacaaagggaccataattggaaagcagaatgacacttgcacagccaaggcaagttgttggctagagtcagtcaagagttttttttatggattgaagaatatgcttggcagtgtttttggtaattttttcgtaggcattttgttattccttgccccctttgtcttgttggtgcttttctttatgtgtggatggaaattcttgttttgctttaagtgttgcaggaggaccagaggcttgtttaagtatagacacctcaaagatgatgaggaaacaggctacagaaggattattgaaagactgaacagcaaaaaaggaaagaacagactgcttgatggtgagaggttggctgataggaaaattgctgagctgttctctacaaaatcacacattggc

SEQ ID NO: 3753 - RNA, 3495 nt, synthetic construct
  misc_feature 1..3495: note = derived and/or modified CDS sequence (wt) from CCHVF(CCHVF 37-R-2013)__KR814858.1__Gn-NSm-Gc
  source 1..3495: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgacacaagctgcgaagtaatgatacctaaaggcactggagatatcctggtggactgttcaggtggacagcaacatttcttaaaagacaatttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtgtctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcatcagttacacttgagtatctgcaaaaaaagaaaaatgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagatgatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacttgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgttacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 3754 - RNA, 3495 nt, synthetic construct
  misc_feature 1..3495: note = derived and/or modified CDS sequence (wt) from CCHVF(CCHVF 44-ST-2010)__KR814859.1__Gn-NSm-Gc
  source 1..3495: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtaaagtcattcaagctatgcgaaaacagtgccacagggaaaacctgtgagatagacagcactccggtcaagtgcaggcaaggtttttgtttgaaaatcacccaagaggggaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaagatggccatttacatttgcagaatgtcaaatcatcccaggacaaccatggctttcctcctctggttcagttttggctatgtaatcacctgtatattttgcaaagctcttttttattcattgataattattgggacactaggaaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgaagcagctggctgattgtgctgcttgtgttactcacagtctcattgtcaccggttcaatcagcacctgttggtcatggtaagacaattgaaacatatcagaccagagaaggattcacaaatatctgtctctttatgttaggaagcatcctattcatagtttcttgcctggtaaaggggctggttgacagtgtcagtgacagctttttccccggcctgtctgtctgtaagacatgctcttttggcagtataaatggctttgaaattgaatcgcataaatgctactgtagtttattttgctgcccctactgtaggcactgctctgctgacagagaaattcaccagttgcacttgggtatctgcaaaaaaagaaaaacggggagcaatgtcatgctggctgtctgcaagcgcatgtgctttaaggcaaccatagaagcaagcagaagagccttgctcatccgaagcattatcaataccacttttgtaatatgcatcctaacattagcaatctgtgttgttagcacttctgcagtagagatggaaaatcttccagcaggcacttgggagagagaggaagacctgacaaatttctgccatcaggaatgccaggtaagcgagacggaatgcctctgtccatacgaagctcttgtgctcaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccattctaaaagagtcacagcacatggagacacaccacaattagacttaaaagcaaggccgacttacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgatcagccacagagcatactaattgagcacaaagggaccataattggaaagcagaatgacacttgcacagccaaggcaagttgttggctagagtcagtcaagagttttttttatggattgaagaatatgcttggcagtgtttttggtaattttttcgtaggcattttgttattccttgccccctttgtcttgttggtgcttttctttatgtgtggatggaaaatcttgttttgctttaagtgttgcaggaggaccagaggcttgtttaagtatagacacctcaaagatgatgaggaaacaggctacagaaggattattgaaagactgaacagcaaaaaaggaaagaacagactgcttgatggtgagaggttggctgataggaaaattgctgagctgttctctacaaaatcacacattggc

SEQ ID NO: 3755 - RNA, 3495 nt, synthetic construct
  misc_feature 1..3495: note = derived and/or modified CDS sequence (wt) from CCHVF(CCHVF 46-ST-2012)__KR814860.1__Gn-NSm-Gc
  source 1..3495: mol_type = other RNA
tccgaagagccaggtgatgactgcatatcaagaactcagctattgaggacagaaacagcggagatccatgatgacaactatggtggtccaggtgataaaataactatctgcaacggttcaaccattgtagatcagagactgggcagtgaactagggtgttataccatcaacagagtgaagtcattcaagctatgcgaaaacagcgccacagggaaaacctgtgagatagacagcactccggttaagtgcaggcaaggcttttgtttaaaaatcacccaagagggaaggggccacgtaaaattatctagaggctcagaggttgtcttggatgcctgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaactgaaacctcaaacttgtaccatatgtgagacagctcctgtcaatgcaatagatgctgaaatgcatgaccttaactgcagttacaatatatgcccttattgtgcatcaagattgacctccgatgggctagctaggcatgtgccacagtgccccaagcgaaaggaaaaagttgaggagactgagctgtacttgaacctggaaagaattccttggatcgtcagaaagctattgcaagtgtcagaatccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctatttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcaccagttacacttgagcatctgcaaaaaaagaaaaacgggtagcaatgtcatgctggctgtctgcaaacgcatgtgctttagagcaaccatagaggcaagcagaagagccctgctcatccgaagcattatcaatgccacttttgtaatatgcattctaacattgacaatctgtgttgttagcacctctgcagtagagatggaaagccttccagcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaaaaatttgctaaactcaacaagcttagaaacaagcttatcaatcgaggcaccatggggagcaataaatgtccagtcaacctttaaaccaacagtatcgactgcaaacatagcactcagttggagctcagtggagcacagaggcaacaagatcttagtcacaggcaggtctgaatcaattatgaaactggaggaaaggacaggagtcagctgggatctaggcgtagaggatgcctctgaatccaaattacttaccgtctctatcatggatctgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaagtggaaggttgaatatataaaaactgaagccatagtatgtgttgagctcaccagccaagaaagacagtgcagtctgattgaggcaggtaccagattcaacttgggccctgtgactattaccctgtctgagccaagaaacatacagcagaagcttccccctgagattatcacattgcatcccaaagttgaagagggcttctttgacttgatgcatgtgcaaaaagtgttgtctgcaagtacagtgtgtaaactgcagagttgcacacacggtataccaggagatctacaagtttaccacattggcaacttactgaaaggagataggataaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcacaccaaaaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagccagcacaagtctcatggcgaggaagcttgagtttgggacagacagtaccttcaaggccttttcagctatgcccaaaacctctttatgtttttacattgtggagagagaatactgtaagagctgcagtgaagaggacacacaaaaatgtgttgacacaagacttgagcagccgcagagcatactaattgagcacaaaggaacgataattggaaagcagaatgatacttgcacagccaaggcaagctgttggttagagtcagtcaagagttttttttatggattgaagaatatgcttggtagtgtctttggtaattttttcataggcattctgttattccttgccccttttgtcctgttggtgcttttctttatgtttgggtggaaaatcttgttttgctttaaatgttgcaggaggaccagaggcttacttaagtatagacacctcaaagacgatgaggaaacaggctacagaaggattattgaaagactgaacaacaaaaaagggaaaaacagactgcttgatggtgaaaggttggctgataggaagattgctgagctgttctccacaaaaacacacattggt

SEQ ID NO: 3756 - RNA, 3495 nt, synthetic construct
  misc_feature 1..3495: note = derived and/or modified CDS sequence (wt) from CCHVF(CCHVF 47-ST-2013)__KR814861.1__Gn-NSm-Gc
  source 1..3495: mol_type = other RNA
tccgaagagccaggtgacgactgcatatcaagaactcagctgttgaagacagaaacagcagagatccatgacgacaactatggtggtccaggtgacaaaataactatctgcaatggttcaaccattgtagatcagagactgggtagtgaactagggtgttataccatcaacagggtgaagtcattcaagctatgcaaaaacagtgccacagggaaaacctgtgagatagacagcactccggtcaagtgcaggcaaggtttttgtttgaaaatcacccaagagggaaggggccacgttaaattatccaggggctcagaggttgttttggatgcttgcgactcgagctgtgaaataatgatacctaaaggcactggagatatcctagtagactgctcaggtggacagcaacatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagattgacctctgatgggctagctagacatgtgacacaatgccctaagcgaaaggagaaagttgaggagactgaactgtatttgaacctggaaagaattccttggatagtcagaaagttattgcaagtgtcagagtccactggtgtggcattgaaacgaagcagttggctgattgtgctgcttgtgttactcacagtctcattgtcaccggttcaatcagcacctgttggtcatggtaagacaattgaaacatatcagaccagagaaggattcacaagtatctgtctctttatgttaggaagcatcctattcatagtttcctgcctggtaaaggggctggttgacagtgtcagtgacagcttcttccccggcctgtctgtctgtagaacatgctctattggcagtataaatggctttgaaattgaatcgcacaaatgctactgtagtttattttgctgcccctactgtaggcactgctctgctgacagagaaattcaccagttgcacttgagtatctgcaaaaaaagaaaaacggggagcaatgtcatgctggctgtctgcaagcgcatgtgctttaaggcaaccatagaagcaagcagaagagccctgttcatccggagcattatcaataccacttttgtaacatgcattctaacattagcaatctgtgttgttagcacctctgcagtagagatggaagaccttccagcaggcacttgggagagagaggaagacctgacaaatttctgccatcaggaatgccaggtgaccgagacggaatgcctctgtccatacgaagctcttgtgctcaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcctggtcacaggcaggtctgaatcaattatgaaactagaggaaaggacaggagtcagctgggatctaggtgtagaagatgcctctgaatccaaattacttaccgtctctatcatggatttgtcacaaatgtattcccctgtttttgagtacttatcaggagatagacaggttgaagaatggcccaaggcaacctgcacaggtgaatgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttaggtcctgtgactatcaccctgtctgagccaagaaacattcagcagaagcttccccctgagatcattacgctgcatcccaaaattgaagaaggcttctttgacttgatgcatgtacaaaaagtgttatctgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactactgcaacatgggggattggccttcttgcacatacacaggagtgacccaacataatcatgctgcatttgtaaacttgcttaacattgaaactgattacacaaaaaccttccacttccactctaaaagagtcacagcacatggagacacaccacaattagacttaaaagcaaggccgacctacggtgcaggtgagatcaccgtgctggttgaggttgctgacatggagttgcataccaagaaagttgaggtatcaggcttgaaatttgcaagtctggcttgcacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagtacattcaaggcattttcagctatgcctaaaacctctttatgcttttacattgtggagagggaatactgcaaaagctgcagtgaagatgatacaaaaaaatgtgttgacacaaaacttgaacagccacagagcatactaattgagcacaaagggacaataattggaaagcagaatgatacttgcacagccaaggcaagttgttggctagagtcagtcaagagttttttttatggattgaagaatatgcttggcagtgtttttggtaatttttttgtaggcattttgttattccttgccccttttgtcttgttggtgcttttctttatgtttggatggaaaatcttgttttgctttaagtgttgcaggaggaccagaggcttgtttaagtatagacacctcaaagatgatgaggaaacaggctacagaaggattattgaaagactgaacagcaaaaaagggaaaaacagactgcttgatggtgagaggttggctgataggaaaattgctgagctgttctctacgaaaacacacattggc

SEQ ID NO: 3757 - RNA, 3495 nt, synthetic construct
  misc_feature 1..3495: note = derived and/or modified CDS sequence (wt) from CCHVF(CCHVF 52-R-2014)__KR814862.1__Gn-NSm-Gc
  source 1..3495: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttatactatcaacagggtgaagtcattcaagctatgcgaaaacagcgccacagggaaaacctgtgagatagacagcactccggttaagtgcaggcaaggtttttgtttaaaaatcacccaagagggaagaggccacgtaaaattatctagaggctcagaggttgttttggatgcttgcgacacaagctgcgaagtaatgatacctaaaggcactggagatatcctggtggactgttcaggtggacagcaacatttcttaaaagacaatttaattgacctagggtgcccccatgtcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtgtctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcatcagttacacttgagtatctgcaaaaaaagaaaaatgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagatgatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacttgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaggctgttggctagagtcagtcaagagttttttttatggattgaaaaatatgcttggtagtgtatttggtaactttttcataggcattttgctattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgaactgttctccacaaaaacacacattggt

SEQ ID NO: 3758 - RNA, 3495 nt, synthetic construct
  misc_feature 1..3495: note = derived and/or modified CDS sequence (wt) from CCHVF(CCHVF 75-R-2012)__KR814863.1__Gn-NSm-Gc
  source 1..3495: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcgctccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaacttaattgacctagggtgcccacatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagcccctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctagaaagaattccttggattgtcagaaagctattgcaagtgtcagagtccactggtgtggcattgaagcgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttaacagtgtcagtgacagcttcttccccggcctgtctgtttgtaagacatgctctattggcagtataaatggctttgaaattgaatcgcataaatgctactgtagcctattttgctgcccctactgtaggcactgctctgctgacagagaaattcatcagttacacttgagtatttgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtccgaatcaattatgaaactggaggaaaggacaggagtcagctgggatctaggcgtagaagatgcctctgagtccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggtactggctgcacctgctgcggggtggatgtaaaagacctttttacagatcacatgtttgtcaaatggaaggttgaatatataaaaactgaagccatagtatgtgttgagctcaccagtcaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcaccgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttctttatggattgaaaaatatgcttggtagtgtatttggtaactttttcataggcattttgttattccttgccccttttgtcctgttggtgcttttctttatgtttggatggaaaatcttgttctgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 3759 - RNA, 3495 nt, synthetic construct
  misc_feature 1..3495: note = derived and/or modified CDS sequence (wt) from CCHVF(CCHVF 75-ST-2010)__KR814864.1__Gn-NSm-Gc
  source 1..3495: mol_type = other RNA
tccgaagagtcaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagaaggaaggggccacgtaaaattatctagaggctcagaggttgttttggatgcttgcgactcaagctgcgaagtaatgatacctaaaggcactggagatatcttggtggactgttcaggtggacagcaacatttcttaaaagacaacttaattgacctagggtgcccccatatcccgctattgggtaaaatggccatttacatctgcagaatgtcaaatcaccctagaacaactatggcttttctcttctggttcagctttggctatgtgatcacctgtttattttgcaaggctcttttttattcattgataatcattgggacactagggaaaaagatcaagcaatatagggaattgagacctcaaacctgtaccatatgtgagacagctcctgtcaatgcaatagatgctgaaatgcatgaccttaactgcagttacaatatatgtccttattgtgcatcaagattgacctccgatgggctagctaggcatgtgccacaatgccccaagcggaaggaaaaagttgaggagactgagctgtacttgaacctggaaagaataccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctccattggcagtataaatggctttgaaattgaatcgcataaatgctactgtagcctactttgctgcccctactgtaggcactgctctgctgacagagaaatccaccagttacacttgagtatctgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattaacaatctgtgttgttagcacctctgcagtagagatggaaaaccttccatcaggcacttgggagaaagaggaagacctgacaaatttctgtcatcaggaatgccaggtgaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaagtggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtacaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccaacctacggtgcaggtgagatcactgtgctggttgaggttgctgacatggagttgcataccaagaaagttgagatatcaggcctgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggcaactttttcataggcattttgttattccttgccccttttgtcctgttggtgcttttctttatgtttggatggaaaatcttgttttgcttcaaatgttgcaggagggccagaggcttgcttaagtatagacacctaaaagacgatgaggaaacaggctacagaaagattattgaaaggctgaacaacaaaaaaggaaaaaacagactgcttgatggtgaaaggttggctgataggaaaattgctgagctgttctccacaaaaacacacattggt

SEQ ID NO: 3760 - RNA, 3495 nt, synthetic construct
  misc_feature 1..3495: note = derived and/or modified CDS sequence (wt) from CCHVF(CCHVF 81-R-2014)__KR814865.1__Gn-NSm-Gc
  source 1..3495: mol_type = other RNA
tccgaagagccaggtgatgactgcatatcaagaactcagctattgaggacagaaacagcagagatccatgatgacaactatggtggtccaggtgataaaataactatctgcaacggttcaaccattgtagatcagagactgggcagtgaactagggtgttataccatcaacagagtgaagtcattcaagctatgcgaaaacagcgccacagggaaaacctgtgagatagacagcactccggttaagtgcaggcaaggcttttgtttaaaaatcacccaagagggaaggggccacgtaaaattatctagaggctcagaggttgtcttggatgcctgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaactgaaacctcaaacttgtaccatatgtgagacagctcctgtcaatgcaatagatgctgaaatgcatgaccttaactgcagttacaatatatgcccttattgtgcatcaagattgacctccgatgggctagctaggcatgtgccacagtgccccaagcgaaaggaaaaagttgaggagactgagctgtacttgaacctggaaagaattccttggatcgtcagaaagctattgcaagtgtcagaatccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctatttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcaccagttacacttgagcatctgcaaaaaaagaaaaacgggtagcaatgtcatgctggctgtctgcaaacgcatgtgctttagagcaaccatagaggcaagcagaagagccctgctcatccgaagcattatcaataccacttttgtaatatgcattctaacattgacaatctgtgttgttagcacctctgcagtagagatggaaaaccttccagcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaaaaatttgctaaactcaacaagcttagaaacaagcttatcaatcgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaggatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaagtggaaggttgaatatataaaaactgaagccatagtatgtgttgagctcaccagccaagaaagacagtgcagtctgattgaggcaggtaccagattcaacttgggccctgtgactattaccctgtctgagccaagaaacatacagcagaagcttccccctgagattatcacgttgcatcccaaagttgaagagggcttctttgacttgatgcatgtgcaaaaagtgttgtctgcaagtacagtgtgtaaactgcagagttgcacacacggcataccaggagatctacaagtttaccacattggcaacttgctgaaaggagataggataaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcacaccaaaaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagccagcacaagtctcatggcgaggaagcttgagtttgggacagacagtaccttcaaggccttttcagctatgcccaaaacctctttatgtttttacattgtggagagagaatactgtaagagctgcagtgaagaggacacacaaaaatgtgttgacacaagacttgagcagccgcagagcatactaattgagcacaaaggaacgataattgggaagcagaatgatacttgcacagccaaggcaagctgttggttagagtcagtcaagagttttttttatggattgaagaatatgcttggtagtgtctttggtaattttttcataggcattctgttattccttgccccttttgtcctgttggtgcttttctttatgtttgggtggaaaatcttgttttgctttaaatgttgcaggaggaccagaggcttacttaagtatagacacctcaaagacgatgaggaaacaggctacagaaggattattgaaagactgaacaacaaaaaagggaaaaacagactgcttgatggtgaaaggttggctgataggaaaattgctgagctgttctccacaaaaacacacattggt

SEQ ID NO: 3761 - RNA, 3495 nt, synthetic construct
  misc_feature 1..3495: note = derived and/or modified CDS sequence (wt) from CCHVF(CCHVF 3756-ST-2007)__KR814866.1__Gn-NSm-Gc
  source 1..3495: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccattaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccctggatagtcagaaagctattgcaagtgtcagagtccactggtgtggcattgaaacgaagcagttggctgattgtgctgcttgtgttactcacagtctcattgtcaccggtccaatcagcacctgttggtcatggtaagacaatcgaaacatatcagaccagagaaggattcacaagtatctgtctctttatgttaggaagcatcctattcatagtttcttgcctggtaaaggggctggttgacagtgtcagtgacagcttcttccccggcctgtctgtctgtaagacatgctctattggcagcataaatggctttgaaattgaatcgcataaatgctactgtagtttattttgctgcccctactgtaggcactgctctgctgacagagaaattcaccagttgcacttgagtatctgcaaaaaaagaaaaacggggagcaatgtcatgctggctgtctgcaagcgcatgtgctttaaggcaaccatagaagcaagcagaagagccctgctcatccgaagcattatcaataccacttttgtaatatgcattctaacattagcaatctgtgttgttagcacctctgcagtagagatggaagaccttccagcaggcacttgggagagagaggaagacctaacaaatttctgccatcaggaatgccaggtaaccgagacggaatgcctctgtccatacgaagctcttgtgctcaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgttttcgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacaatgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggcataccaggagatctacaaatttaccacattggcaacttgttgaaaggggatagagtaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcggtcaagagttttttttatggattgaagaatatgcttggcagtgtttttggtagttttttcgtaggcattttgttattccttaccccttttgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaaggaaaaaacagactgcttgatggtgagaggttggctgataggaaaattgctgagctgttctctacaaaaacacacattggc

SEQ ID NO: 3762 - RNA, 3495 nt, synthetic construct
  misc_feature 1..3495: note = derived and/or modified CDS sequence (wt) from CCHVF(CCHVF 3809-ST-2007)__KR814867.1__Gn-NSm-Gc
  source 1..3495: mol_type = other RNA
tccgaagagccaggtgatgactgcatatcaagaactcagttattgaggacagaaacagcagagatccatgatgacaactatggtggtccaggtgataaaataactatctgcaacggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgtcttggatgcctgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgtaaggctcttttttattcattgataattattgggacactagggaaaaagatcaagcaatatagggaattgaaacctcaaacttgtaccatatgtgagacagctcctgtcaatgcaatagatgctgaaatgcatgaccttaactgcagttacaatatatgcccttattgtgcatcaagattgacctccgatgggctggctaggcatgtgccacaatgccccaagcggaaggaaaaagttgaggagactgagctgtacttgaacctggaaagaatcccttggattgtcagaaagctattgcaagtgtcagagtccactggtgtggcattgaaacgaagcagctggctgattgtactgcttgtgttactcacagtttcattgtcaccggttcaatcagcacctgttggtcatggtaaaacaatcgaaacatatcagaccagagaaggattcacaagtatctgcctctttatgttaggaagcatcctgtttttagtctcttgcttggtgaaggggctggttgacagtgtcagtgacagcttcttccccggcctgtctgtctgtaagacatgctctattggcagtgtaaatggctttgagattgaatcgcataaatgctactgtagcctattttgctgcccctactgtaggcactgctctgctgacagagaaattcaccagttacacttgagtgtctgcaaaaaaagaaaaacgggtagcaatgtcatgctggctgtctgcaaacgcatgtgctttagggcaaccatagaagcaagcagaagagccctgctcatccgaagcattatcaataccacttttgtaatatgcattttaacattgacaatctgtgttgttagcacctctgcagtagagatggaaaaccttccagcaggcacttgggagagagaggaagacctgacaaatttctgtcatcaggaatgccaggtaaccgagacggagtgcctctgtccatacgaagctcttgtgctcagaaaacctctgttcttagacagtatagtcaaaggcatgaagaatttgctaaactcaacaagcttagaaacaagcttatcaattgaagcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtggaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgtacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactatcaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatcttcaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagaaagaatactgcaggagctgcagtgaagaggacacacaaaaatgtgttgacacaaaacttgagcagccacagagcatactaattgagcacaaaggaacgataattggaaagcagaatgatacttgcacagccaaagcaagctgttggctagagtcagtcaagagttttttttatggattgaagaatatgcttggtagtgtctttggtaactttttcataggcattttgttattccttaccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaagggaaaaacagactgcttgatggtgaaaggttggctgataggaaaattgctgagctgttttccacaaaaacacacattggt

SEQ ID NO: 3763 - RNA, 3495 nt, synthetic construct
  misc_feature 1..3495: note = derived and/or modified CDS sequence (wt) from CCHVF(CCHVF 3820-ST-2007)__KR814868.1__Gn-NSm-Gc
  source 1..3495: mol_type = other RNA
tccgaagagccaggtgacgactgcatatcaagaactcagctattgaagacagaaacagcagagatccatgacgacaactatggtagtccaggtgacaaaatcactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcactgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctggctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcgcagtctcattgtcaccggtccaatcagcacctgttggtcatggtaagacaatcgaaacatatcagaccagagagggattcacaagcatctgtctctttatgttaggaagcatcctattcatagtttcttgcctggtaaaggggctggttgacagtgtcagtgacagcttcttccccggcctgtctgtctgtaagacatgctctattggcagtataaatggctttgaaattgaatcgcataaatgctactgtagtttattttgctgcccctactgtaggcactgctctgctgacagagaaattcaccagttgcacttgagtatctgcaaaaaaagaaaaacggggagcaatgtcatgctggctgtctgcaagcgcatgtgctttaaggcaaccatagaagcaagcagaagagccctgctcatccgaagcattatcaataccacttttgtaatgtgcattctaacattagcaatctgtgttgttagcacctctgcagtagagatggaagaccttccagcaggcacttgggagagagaggaagacctaacaaatttctgccatcaggaatgccaggtgaccgagacggaatgcctctgtccatacgaagctcttgtgctcaggaaaccccttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggacctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagagtaaacggccatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaaaaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtagttttttcgtaggcattttgttattccttgcccctttcgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaaggaaaaaacagactgcttgatggtgagaggttggctgataggaaaattgctgagctgttctctacaaaaacacacattggc

SEQ ID NO: 3764 - RNA, 3495 nt, synthetic construct
  misc_feature 1..3495: note = derived and/or modified CDS sequence (wt) from CCHVF(CCHVF 4495-ST-2008)__KR814869.1__Gn-NSm-Gc
  source 1..3495: mol_type = other RNA
tccgaagagtcaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagaaggaaggggccacgtaaaattatctagaggctcagaggttgttttggatgcttgcgactcaagctgcgaagtaatgatacctaaaggcactggagatatcttggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtaatcacctgtttattttgcaaggctcttttttattcattgataatcattgggacactagggaaaaagatcaagcaatatagggaattgagacctcaaacttgtaccatatgtgagacagctcctgtcaatgcaatagatgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctactttgctgcccctactgtaggcactgctctgctgacagagaaatccaccagttacacttgagtatctgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattaacaatctgtgttgttagcacctctgcagtagagatggaaaaccttccatcaggcacttgggagaaagaggaagacctgacaaatttctgtcatcaggaatgccaggtgaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggaatcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaagtggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtacaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccaacctacggtgcaggtgagatcactgtgctggttgaggttgctgacatggagttgcataccaagaaagttgagatatcaggcctgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagggaatactgcaagagctgcagtgaagaggacacacaaagatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggcaactttttcataggcattttgttattccttgccccttttgtcctgttggtgcttttctttatgtttggatggaaaatcttgttttgcttcaaatgttgcaggagggccagaggcttgcttaagtatagacacctaaaagacgatgaggaaacaggctacagaaagattattgaaaggctgaacaacaaaaaaggaaaaaacagactgcttgatggtgaaaggttggctgataggaaaattgctgagctgttctccacaaaaacacacattggt

SEQ ID NO: 3765 - RNA, 3495 nt, synthetic construct
  misc_feature 1..3495: note = derived and/or modified CDS sequence (wt) from CCHVF(CCHVF 4691-ST-2009)__KR814871.1__Gn-NSm-Gc
  source 1..3495: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcagggtttttgtttgaaaatcacccaagagggaaggggccacgtaaaattatccaggggctcagaggttgttttagatgcttgcgactcgagctgtgaaataatgatacctaaaggcactggagatatcctagtagactgttcaggtggacagcaacatttcttaaaagacaacttgattgacctagggtgccctcatatcccgcttttgggtaagatggccatttacatttgcagaatgtcaaatcatcccaggacaaccatggctttcctcttctggttcagttttggctatgtaatcacctgtatattttgcaaggctcttttttattcattgataattattggaacactaggaaaaaaaatcaagcaatatagggagctaaagcctcaaacttgcaccatatgtgagacagctcctgtcaatgcaatagatgctgaaatgcatgacctcaactgtagttataatatatgcccttattgtgcatcaagactgacctctgatgggctagctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggttcaatcagcacctgttggtcatggtaagacaatcgaaacatatcaggctagagaaggattcacaagtatctgtctctttatgttaggaagcatcctattcatagtttcttgcctggtaaaggggctggttgacagtgtcagtgacagcttcttccccggcctgtctgtctgtaagacatgctctattggcagtataaatggctttgaaattgagtcgcataaatgctactgtagtttattttgctgcccctactgtaggcactgctctgctgacagagaaattcaccagttgcacttgagtatctgcaaaaaaagaagaacggggagcaatgtcatgctggctgtctgcaagcgcatgtgctttaaggcaaccatagaagcaagcagaagagccctgctcatccgaagcattatcaataccacttttgtaatatgcattctaacattagcaatctgtgttgttagcacttctgcagtagagatggaaaaccttccagcaggcacttgggagagagaggaagacttgacaaatttctgccatcaggaatgccaggtgaccgagacggaatgcctctgtccatacgaagctcttgtgctcaggaaacctcttttcttagacagtatcgttaaaggtatgaaaaatttgctaaactcaacaagcttagaaacaagcttatcaattgaggcaccatggggagcaataaatgtccagtcaacctttaaaccagcagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacattggcaacctgttgaaaggggatagagtaaacgggcatctaattcacaaaattgaaccacattttaacacctcttggatgtcctgggatggttgtgacctagactactattgcaacatgggggattggccttcttgcacatacacaggagtgacccaacacaatcatgctgcatttgtaaacttgcttaacattgaaactgattacacgaaaaccttccacttccactctaaaagagtcacagcgcatggagacacaccacaattggacttaaaagcaaggccgacctacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcataaagggacgataattggaaagcagaatgatacttgcacagccaaggcaagttgttggctagagtcagtcaagagttttttttatggattaaagaatatgcttggcagtgtttttggtaattttttcgtaggcattttgttattccttgccccttttgtcttgttggtgctcttctttatgtttggatggaaaatcttgttttgctttaagtgttgcaggaggaccagaggcttgtttaagtatagacacctcaaagatgatgaggaaacaggctacagaaggattattgaaagactgaacagcaaaaaaggaaaaaacagactgcttgacggtgagaggttggctgataggaaaattgctgagctgttctctacaaaaacacacattggc

SEQ ID NO: 3766 - RNA, 3495 nt, synthetic construct
  misc_feature 1..3495: note = derived and/or modified CDS sequence (wt) from CCHVF(CCHVF 4701-ST-2009)__KR814872.1__Gn-NSm-Gc
  source 1..3495: mol_type = other RNA
tccgaagagccaggtgacgactgcatatcaagaactcagctattgaagacagaaacagcagagatccatgacgacaactatggtggtccaggtgacaaaataactatctgcaatggttcaaccgttgtagatcagagactgggcagtgaactagggtgttataccatcaacagggtgaagtcattcaagctatgcgaaaacagtgccacagggaaaacctgtgagatagacagcactccggttaagtgcaggcaagggttttgtttgaaaatcacccaagagggaaggggccacgtaaaattatccaggggctcagaggttgttttggatgcttgcgactcaagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctggctaggcatgtgacacaatgccctaagcgaaaagagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggtcatggtaagacaatcgaaacatatcagaccagagagggattcacaagtatctgtctctttatgttaggaagcatcctattcatagtttcttgcctggtaaaggggctggttgacagtgtcagtgacagcttcttccccggcctgtctgtctgtaagacatgctctattggcagtataaatggctttgaaattgaatcgcataaatgctactgtagtttattttgctgcccctactgtaggcactgctctgctgacagagaaattcaccagttgcacttgagtatctgcaaaaaaagaaaaacggggagcaatgtcatgctggctgtctgcaagcgcatgtgctttaaggcaaccatagaagcaagcagaagagccctgctcatccgaagcattatcaataccacttttgtaatgtgcattctaacattagcaatctgtgttgttagcacctctgcagtagagatggaagaccttccggcaggcacttgggagagagaggaagacctaacaaatttctgccatcaggaatgccaggtgaccgagacggaatgcctctgtccatacgaagctcttgtgctcaggaaaccccttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgtacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagagtaaacggccatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaatattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaaaaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtggttttttcgtaggcattttgttattccttgcccctttcgtcttgttggtacttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaaggaaaaaacagactgcttgatggtgagaggttggctgataggaaaattgctgagctgttctctacaaaaacacacattggc

SEQ ID NO: 3767 - RNA, 3495 nt, synthetic construct
  misc_feature 1..3495: note = derived and/or modified CDS sequence (wt) from CCHVF(CCHVF 5170-R-2011)__KR814873.1__Gn-NSm-Gc
  source 1..3495: mol_type = other RNA
tccgaagagccaggtgacgactgcatatcaagaactcagctattgaagacagaaacagcagaaatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgtttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgaagggctagctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggtcatggtaagacaatcgaaacatatcagaccagagaaggattcacaagtatctgtctctttatgttaggaagcatcctattcatagtttcttgcctggtaaaggggctggttgacagtgtcagtgacagcttcttccccggcctgtctgtctgtaagacatgctctattggcagtataaatggctttgaaattgaatcgcataaatgctactgtagtttattttgctgcccctactgtaggcactgctctgctgacagagaaattcaccagttgcacttgagtatctgcaaaaaaagaaaaacagggagcaatgtcatgctggctgtctgcaagcgcatgtgctttaaggcaaccatagaagcaagcagaagagccctgctcatccgaagcattatcaataccacttttgtaatatgcattctaacattagcaatctgtgttgttagcacctctgcagtagagatggaagaccttccagcaggcacttgggagagagaggaagacctaacaaatttctgccatcaggaatgccaggtgaccgagacggaatgcctctgtccatacgaagctcttgtgctcaggaaacctcttttcttagacagtatagttaaaggtatgaaaaatttgctaaactcaacaagcttagaaacaagcttatcaattgaggcaccatggggagcaataaatgtccagtcaacctttaaaccaacagtatctactgcaaacatagcactcagttggagctcagtagagcacagaggcaacaagatcttggtcacaggcaggtctgaatcaattatgaaactagaggaaaggacaggagtcagctgggatctaggcgtggaagatgcctctgaatccaaattacttaccgtctctatcatggacttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacatcggtaacttgttgaaaggggatagagtaaacgggcatctgattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcctgtagctctggcatctcttgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagccatgcccaaaacctctttatgcttttacattgtagagagggaatactgcaagagctgcagtgaagatgatacaaaaaaatgtgttgacacaaaacttgagcagccacagagcatactaattgagcacaaggggacgataattggaaagcagaatgatacttgcacagccaaggcaagttgttggctagagtcagtcaagagttttttttatggactgaagaatatgcttggcagtgtttttggtagttttttcgtaggcattttgttattccttgccccttttgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaagggaaaaacagactgcttgatggtgagaggttggctgataggaaaattgctgagctgttctctacaaaaacacacattggc

SEQ ID NO: 3768 - RNA, 3495 nt, synthetic construct
  misc_feature 1..3495: note = derived and/or modified CDS sequence (wt) from CCHVF(CCHVF Oman-199809166)__KR864901.1__Gn-NSm-Gc
  source 1..3495: mol_type = other RNA
tccgaagagtctggtgaagactgtatatcaaggactcagctgttgaggacagaaactgcagaaatccatggtgataactatggtggtccaggtgacaaaataaccatctgcaatggttcaaccattgtagatcaaaggctgggtagtgaactggggtgttacactatcaatagggtgaagtcatttaagctatgcgaaaacagtgccacaggtaagtcctgtgaaatagataacactccagtaaaatgcaagcaaggtttttgcttgaaaataacccaagaaggaaggggccacgtgaagctttcaagagactcagaagttgtcctggacgcctgcgattcaagctgtgaaataatgataccaaagggcactggagacatcctggttgactgctcaggtgggcagcagcacttcttaaaagacaacctgattgatctgggatgccccaacatcccattattaggcaaaatggcaatctacatttgtagaatgtcaaatcatcctaaaacaactatggcttttcttttttggtttagctttggttatgtgataacctgcatactttgtaaagtcattttttatctattgatagttgttggaactttagggaaaaagtttaaacagtatagagagttaaaacctcagacctgcacaatatgtgaaacaactcctgtcaatgcaatagatgctgagatgcacgatctcaattgtagttacaatatatgtccttattgtgcatctaggttaacttcagatggtcttgccagacatgtaatgcagtgtcctaagcggaaggaaaaaatagaagaaaccgaattatacctgaacttagaaagaatcccttgggttgtcagaaaactactgcaggtatcagaatccactggtgtagcactaaagaggagcagttggctgattgtgctacttgtgcttctcacagtttcattgtcaccagtacaatcagcacctatcggtcatgggaagaccatagaaacgtatcaaactagagaagggtacacaagtatttgtctttttgtgctaggaagcattttgtttatagtttctcacctaatgaaggggctggttgacagtgttggtaacagttttttccctgggttatctatctgcaagacatgctctattggcagtataaatggctttgaaattgaatctcacaaatgttactgtagcctattttgttgcccctactgtagacactgctctgccgataaagaaatccataagttgcatttgagcatctgcaaaaaaagaaaagctgggagtaatgtcatgttggccgtctgtaagcgcatgtgttttagggcaactatggaagtgagcaacaaggctctactcatccgaagtgtcatcaacactacttttgttgtatgcatactaatattagcagtttgtgttgttagcacctccgcagtagagatggaaagcctgccagctggcacttgggagagagaggaagacctaacaaacttctgccatcaagaatgccaggtcactgaaactgaatgtctctgtccctatgaagctcttgtactcagaaagcccttatttttagacagtattgctaagggtatgaagaacctgctgaattcaacaagcttagaaacaagcttatcaattgaggcaccatggggagcaataaacgtccaatctactttcaaacctactgtgtcaactgcaaacatagcacttagttggagctcagtggaacacagaggtaataagatcttggtttcaggcagatcagagtcaatcatgaagctagaagaaagaacaggaatcagctgggatttgggagtagaagatgcctctgagtccaaattacttactgtttccgtcatggacttatcacagatgtactctcctgtctttgagtacctatcaggtgacagacaagtagaggaatggccaaaggcaacctgtacaggcgattgcccggaaagatgtggctgcacatcatcaacctgcctacacaaggaatggcctcactcaagaaactggagatgcaaccccacttggtgttggggagtcggcaccggatgcacctgttgtggactagatgtaaaggacctttttacagattacatgtttgttaaatggaaggtcgaatatataaaaacagaggctatagtgtgtgttgagcttactagccaagaaagacaatgtagcttgattgaggcaggcacaagattcaacttaggtcctgtgactatcacattatcagagccaagaaacattcagcaaaagctccctccagaaattgtcacattacatcctagaattgaagaaggtttttttgacttaatgcatgtacagaaggtactatcagcaagcacagtgtgcaagctacagagttgcacacatggcgtaccaggagacttacaggtctaccacatcggaaacttactaaaaggagacaaagtgaatgggcatctgatacataaagttgaaccacatttcaacacctcctggatgtcttgggacggctgtgacctagattactactgcaatatgggggattggccctcttgcacgtatactggagttacccaacataatcatgctgcatttgtaaacctacttaacattgaaactgattacacaaagaacttccactttcactctaagagagtcactgcacatggggacactccacaattagatttaaaagccagaccaaattatggtgcaggtgaaatcactgtgctggtggaagttgctgacatggagttacacacaaagaaaattgagatatcaggtttgaagtttgcaagcctaacctgcacaggttgttatgcttgtagctctggcatctcatgtaaggttaggatccatgtagatgaaccagatgagcttacagtacatgtgaagagtgaagacccagacatagttgctgctagctcaagtctcatggcaagaaagcttgaattcgggacggatagtacattcaaagccttctcagccatgcctaaaacctccttgtgcttttacattgttgagagagaatactgtaaaagctgcagtaaagaagacacacaaaagtgtgttaacgcaaagcttgagcgaccacagagcattttaattgagcacaaaggaacgataattggaaagcagaacgacacttgcacagctaaagcaagctgctggctagagtcagtcaagagtttcttttatggactaaagaacatgcttagtggcatttttggcaatgttttcatagggattttcttattccttgctccttttatcctgttaatacttttctttatgtttgggtggagaatcctattctgctttaagtgctgcaggagaactagaggcctatttaagtacagacacctcaaagatgatgaagaaaccggttataggaaaatcattgagagactaaacaacaaaaaaggtaaaaacaagctgcttgacggtgaaagattagctgatagaaagatcgctgagctgttctctacaaaaacacacattggc

SEQ ID NO: 3769 - RNA, 3495 nt, synthetic construct
  misc_feature 1..3495: note = derived and/or modified CDS sequence (wt) from CCHVF(CCHVF 200406546-Turkey)__KR864902.1__Gn-NSm-Gc
  source 1..3495: mol_type = other RNA
tccgaagagccaggtgatgactgcatatcaagaactcagctattgaggacagaaacagcagagattcatgatgataactatggtggcccaggtgataaaataactatctgcaacggttcaactattgtagatcagagactgggcagtgaactagggtgttatactatcaacagggtgaagtcattcaagctatgcgaaaacagcgccacagggaaaacctgtgagatagacagcactccagttaagtgcaggcaaggtttttgtttaaaaatcacccaagagggaaggggccacgtaaaattatctagaggctcagaggttgtcttggacgtttgcgactcaagctgtgaagtaatgatacctaaaggcactggagatatcctggtggactgttcaggtggacagcaacatttcttaaaagacaacctaattgacctagggtgcccccatgtcccgctattgggtaggatggccatttacatttgcagaatgtcaaatcatcctagaacaactatggcttttctcttctggttcagctttggctatgtgatcacctgtatattttgcaaggctcttttttattcattgataattattgggacactagggaaaaagttcaagcagtatagggaactgaaacctcaaacttgtaccatatgtgagacggctcctgtcaatgcaatagatgctgaaatgcatgaccttaactgcagttacaatatatgcccttattgtgcatcaagattgacctccgacgggctagctaggcatgtgccacaatgccccaagcggaaagaaaaagttgaggagactgaactgtacttgaacctggagagaattccttggattgtcagaaagctattgcaggtgtcagagtccactggtgtggcattgaaacgaagcagctggctgattgtactgcttgtgttactcacagtttcgttgtcaccggttcaatcggcacctgttggtcatggtaagacaatcgaaacatatcagaccagagagggattcacaagtatctgtctctttatgttaggaagcatcctattcatagtctcttgcttggtgaaggggctagttgacagtgtcagtgacagcttcttccccggcctgtctgtctgtaagacatgctctattggcagtataaatggctttgaaatcgaatcgcataaatgctactgtagcctattttgctgcccctactgtaggcactgctctgctgacagagaaattcaccagttacacttgagtatctgcaaaaaaagaaaaacggggagcaatgtcatgctggctgtctgcaaacgcatgtgctttagggcaaccatagaagcaagcagaagagccctactcatccgaagcattatcaatactacttttgtaatatgcattctaacattgacaatctgtgttgttagcacctctgcagtagagatggaaaaccttccagcaggcacctgggagagagaggaagacctgacaaatttctgtcatcaggaatgccaggtgaccgagacggagtgcctctgtccatacgaagctcttgtgctcagaaaacctctgttcttagacagtatagttaaaggcatgaaaaatttgctaaactcaacaagcttagaaacaagtttatcaattgaggcaccatggggagcaataaatgtccagtcaacctttaaaccaacagtatcgactgcaaatatagcactcagttggagctcaatagagcacaggggcaacaagatcttagtcacaggcaggtctgaatcaattatgaagctggaggaaaggacaggggtcagctgggatctaggcgtagaagatgcctctgaatctaaattactcactgtctctattatggatttgtcacaaatgtactcccctgtttttgagtacttgtcaggagacagacaggttgaggaatggcccaaagcaacgtgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtgaaagacctttttacagatcacatgtttgtcaaatggaaggttgaatatataaaaactgaagccatagtatgtgttgagctcaccagccaagaaagacagtgcagtctgattgaggcaggtactagattcaacttgggccctgtgactattaccctgtctgagccaagaaacattcagcagaagcttccccctgagattatcacgttgcatcccaaagttgaagaaggcttctttgacttgatgcatgtacaaaaagtgttgtctgcaagtacagtgtgtaaactgcaaagctgcacacatggtataccaggagatctacaagtttaccacattggcaacttgctgaaaggtgatagagtaaacgggcatctaattcacaaaattgaaccacatttcaacacctcttggatgtcctgggatggttgtgacttagactactactgcaacatgggggattggccttcttgcacatacacaggagtgacccagcataaccatgctgcatttgtaaacttgcttaacattgaaactgattacacgaaaaccttccacttccactctaaaagagtcacagcacatggtgacacaccacaattagacttaaaagcaaggccgacctacggtgcaggtgagatcactgtgctggttgaagttgctgatatggagctgcataccaagaaagttgagatatcaggcttgaaatttgcaagtctagcttgcacgggttgctatgcttgtagctctggcatctcctgtaaagtcaggattcatgtagatgagccagatgagctcacagtacatgtaaagagcagtgatcctgatgtggttgcagctagcacaagtctcacggcgaggaagcttgaatttgggacagacagcacattcaaggccttttcagctatgcccaagacctctttatgtttttacattgtggagaaagaatactgcaagagctgcaatgaagatgacacacaaaaatgtgttgacacaaagcttgagcagccacagagcatactaattgagcacaaaggaacgataattggaaagcagaatgatacttgcacagccaaggcaagctgttggctggagtcagtcaagagttttttttatggattaaagaatatgcttggtagtgtctttggtaattttttcataggcattttgttattccttgccccttttgtcctgttggtgcttttctttatgtttggatggaaaatcttgttttgctttaaatgttgcaggaggaccagaggcttatttaagtatagacacctcaaagacgatgaggaaacaggctacaaaaggattattgaaagattgaacaacaaaaaagggaaaaacagactgcttgatggtgaaaggttggctgataggaaaattgctgagctgttctccacaaaaacacacattggt

SEQ ID NO: 3770 - RNA, 3495 nt, synthetic construct
  misc_feature 1..3495: note = derived and/or modified CDS sequence (wt) from CCHVF(CCHVF 1-CR/HU-2015)__KU161584.1__Gn-NSm-Gc
  source 1..3495: mol_type = other RNA
tccgaagagccaggtgatgactgcatatcaagaactcagctattgaggacagaaacagcagagatccatgacgacaactacggcggtccaggtgacaaaataactatctgcaatggttcaaccatcgtagatcagagactgggcagtgaactagggtgttataccatcaacagggtgaagtcattcaagctatgcgaaaacagcgctacagggaaaacctgtgagatagacagcactccggtcaagtgcaggcaaggtttctgtttaaaaatcacccaagagggaaggggccacgtaaaattatctagaggctcagaggttgtcttggatgcttgcgactcaagctgtgaagtgatgatacctaaaggcaccggagatatcctagtagactgttcaggtggacagcagcattttttaaaagacaacttgattgacctagggtgcccccacatcccgctattgggtaagatggccatttacatttgcagaatgtcaaatcatcctaggacaaccatggcttttctcttctggttcagctttggctatgtgatcacctgtatattttgcaaggctcttttttattcattaataattattgggacactagggaaaaagatcaagcagtatagagaactaaaacctcaaacttgtactatatgtgagacagctcctgtcaatgcaatagatgctgaaatgcatgacctcaactgtagttacaatatatgcccttattgtgcatcaagactgacctctgatgggctagctaggcatgtaacgcaatgccctaagcgaaaggagaaagttgaggagactgaactgtacttgaacctagaaagaattccttggatcgtcagaaagctattgcaagtgtcagagtccactggtgtggccttgaaacgaagcagttggttgattgtgctgcttgtgttactcacagtttcattgtcaccggttcaatcagcacctgttggtcatggtaagacaatcgaaacatatcagaccagagaaggattcacaagtatctgtctctttatgttaggaagcatcctattcatagtctcttgcttggtgaaggggctggttgacagcgtcagtgacagcttcttccccggcctgtctgtctgtaggacatgctctattggcagcataaatggctttgaaattgagtcgcataagtgctactgtagcttattttgctgcccctactgtaggcactgttctgctgacagagaaattcaccagttacacttgagtatctgcaaaaaaagaaaaacggggagcaatgtcatgctggctgtctgcaaacgcatgtgttttagggcaaccatggaggcaagcagaagagccctgctcatccgaagcattatcaataccacttttgtaatatgcattctaacattaacaatctgtgttgtcagcacctctgcagtagagatggaaaaccttccagcaggcacttgggagagagaggaagacctgacaaatttctgtcatcaggaatgccaggtaaccgagacggagtgcctctgtccatacgaagctcttgtgctcaggaaaccccttttcctagacagtatagttaaaggtatgaaaaatttgctaaactcgacaagcttagaaacaagcttatcaattgaggcaccatggggagcaataaatgtccagtcaacctttaaaccaacagtatcaactgcaaacatagcactcagttggagctcagtggagcacagaggcaacaagatcttagtcacaggcaggtctgaatcaattatgaaactagaggaaaggacaggagtcagctgggatctaggcgtagaagatgcctctgaatccaaattacttaccgtctctataatggatttatcacaaatgtattcccctgtttttgagtacttgtcaggagacagacaggttgaagagtggcccaaagcaacttgtacaggtgattgcccagaaaggtgtggctgcacatcatcaacctgcttgcataaagaatggcctcactcaagaaactggagatgtaatcccacttggtgctggggagtaggaaccggctgcacctgttgcggggtggatgtaaaagacctttttacagatcacatgtttgtcaaatggaaggttgaatatataaaaactgaagccatagtatgtgttgagctcaccagccaggaaagacagtgcagtcttattgaggcaggtacaagattcaacttaggccctgtgactatcaccctgtctgagccaagaaacattcagcagaagcttccccctgagatcattacgttgcatcccaaaattgaagaaggcttctttgacttgatgcatgtacaaaaagtgttgtctgcaagtacagtgtgtaaactgcagagttgcacacatggtataccaggagacctacaagtttaccacattggcaacttgttgaaaggggatagagtaaacgggcatctaattcacaaaattgaaccacattttaacacctcttggatgtcctgggatggttgtgatctagactactactgcaacatgggggactggccttcttgcacatacacaggagtgacccagcataatcatgctgcatttgtaaacttgcttaacattgaaactgattacacgaaaaccttccacttccactctaaaagagtcacagcacatggtgacacaccacaattagacttaaaagcaaggccgacctacggtgcaggtgagatcactgtgctggttgaggttgctgacatggagttgcataccaaaaaagttgagatatcaggcttgaaatttgcaagcctggcatgcacgggttgctatgcttgtagctctggcatctcctgtaaagtcagaattcatgtagatgaaccagatgagctcacagtgcatgtaaagagcagtgatccagacgtggttgcagctagcacaagtcttatggcaaggaagcttgaatttgggacagacagcacattcaaggccttttcagctatgcctaaaacctctttatgtttttacattgtggagagagaatactgcaagagctgcagtgaagatgataccaaaaaatgtgttgacacaaaacttgagcagccacagagcatactaattgagcacaaagggacgataattggaaagcagaatgatacttgcacagccaaggcaagctgttggctagagtcagtcaagagttttttttatggattgaagaatatgctcggcagtgtttttggcaatttttttataggcattttgttattccttgccccttttgtcctgttggtgcttttctttatgtttggatggaaaatcttgttttgctttaaatgttgcaggaggaccagaggcttgtttaagtatagacacctcaaagacgatgaggaaacaggctacagaaggattattgaaagactgaacaacaaaaaggggaaaaacagactgcttgatggtgaaaggttggctgataggaaaattgctgagctgttctccacaaaaacacacattggc

SEQ ID NO: 3771 - RNA, 3495 nt, synthetic construct
  misc_feature 1..3495: note = derived and/or modified CDS sequence (wt) from CCHVF(CCHVF 1231-CR/TI-2015)__KU161585.1__Gn-NSm-Gc
  source 1..3495: mol_type = other RNA
tccgaagagccaggtgatgactgcatatcaagaactcagctattgaggacagaaacagcagagatccatgacgacaactacggcggtccaggtgacaaaataactatctgcaatggttcaaccatcgtagatcagagactgggcagtgaactagggtgttataccatcaacagggtgaagtcattcaagctatgcgaaaacagcgctacagggaaaacctgtgagatagacagcactccggtcaagtgcaggcaaggtttctgtttaaaaatcacccaagagggaaggggccacgtaaaattatctagaggctcagaggttgtcttggatgcttgcgactcaagctgtgaagtaatgatacctaaaggcaccggagatatcctagtagactgttcaggtggacagcagcattttttaaaagacaacttgattgatctagggtgcccccacatcccgctattgggtaagatggccatttacatttgcagaatgtcaaatcatcctagaacaaccatggcttttctcttctggttcagctttggctatgtgatcacctgtatattttgcaaggctcttttttattcattaataattattgggacactagggaaaaagatcaagcaatatagagaactgaaacctcaaacttgtactatatgtgagacagctcctgtcaatgcaatagatgctgaaatgcatgacctcaactgtagttacaatatatgcccctattgtgcatcaagactgacctctgatgggctagctaggcatgtaacgcaatgccctaagagaaaggagaaagttgaggagactgaactgtacttgaacctagaaagaattccttggatcgtcagaaagctattgcaagtgtcagagtccactggtgtggccttgaaacgaagcagttggttgattgtgctgcttgtgttactcacagtttcattgtcaccggttcaatcagcacctgttggtcatggtaagacaatcgaaacatatcagaccagagaaggattcacaagtatctgtctctttatgttaggaagcatcctattcatagtctcttgcttggtgaaggggctggttgaaagtgtcagtgatagcttcttccccggcctgtctgtctgtaggacatgctctattggcagcataaatggctttgaaattgagtcgcataagtgctactgtagcttattttgctgcccctactgtaggcactgttctgctgacagagaaattcaccagttacacttgagtatctgcaaaaaaagaaaaacggggagcaatgtcatgctggctgtctgcaaacgcatgtgttttagggcaaccatggaagcaagcagaagagccctgcttatccgaagcattatcaataccacttttgtaatatgcattctaacattaacaatctgtgttgtcagcacctctgcagtagagatggaaaaccttccagcaggcacttgggagagagaggaagacctgacaaatttctgtcatcaagaatgccaggtaaccgagacggagtgcctctgtccatatgaagctcttgtgctcaggaaaccccttttcctagacagtatagttaaaggtatgaaaaatttgctaaactcgacaagcttagaaacgagcttatcaattgaggcaccatggggagcaataaatgtccagtcaacctttaaaccaacagtatcaactgcaaacatagcactcagttggagctcagtggagcacagaggcaacaagatcttagtcacaggcaggtctgaatcaattatgaaactagaggaaaggacaggagtcagctgggatctaggtgtagaagatgcctctgaatccaaattacttaccgtctctataatggatttatcacaaatgtattcccctgtttttgagtacttgtcaggagacagacaggttgaagagtggcccaaagcaacttgtacaggtgattgcccagaaaggtgtggctgcacatcatcaacctgcttgcataaagaatggcctcactcaagaaactggagatgtaatcccacttggtgctggggagtaggaaccggctgcacctgttgcggggtggatgtaaaagacctttttacagatcacatgtttgtcaaatggaaggttgaatatataaaaactgaagccatagtatgtgttgagctcaccagccaggaaagacagtgcagtcttattgaggcaggtacaagattcaacttaggccctgtgactatcaccctgtctgagccaagaaacattcagcagaagcttccccctgagatcattacgttgcatcccaaaattgaagaaggcttctttgacttgatgcatgtacaaaaagtgttgtctgcaagtacagtgtgtaaactgcagagttgcacacatggtataccaggagacctacaagtttaccacattggcaacttgttgaaaggggatagagtaaacgggcatctaattcacaaaattgaaccacattttaacacctcttggatgtcctgggatggttgtgatctagactactactgcaacatgggggactggccttcttgcacatacacaggagtgacccagcataatcatgctgcatttgtaaacttgcttaacattgaaactgattacacgaaaaccttccacttccactctaaaagagtcacagcacatggtgacacaccacaattagacttaaaagcaaggccgacctacggtgcaggtgagatcactgtgctggttgaggttgctgacatggagttgcatacaaaaaaagttgagatatcaggcttgaaatttgcaagcctggcatgcacgggttgctatgcttgtagctctggcatctcctgcaaagtcagaattcatgtagatgaaccagatgagctcacagtgcatgtaaagagcagtgatccagatgtggttgcggctagcacaagccttatggcaaggaagcttgaatttgggacagacagcacattcaaggccttttcagctatgcctaaaacctctttatgtttttacattgtggagagagaatactgcaagagctgcagtgaagatgatacaaaaaaatgtgttgacacaaaacttgagcagccacagagcatactaattgagcacaaagggacgataattggaaagcagaatgatacttgcacagccaaggcaagctgttggttagagtcagtcaagagttttttttatggattgaagaatatgctcggcagtgtttttggcaatttttttataggcattttgttattccttgccccttttgtcctgttggtgcttttctttatgtttggatggaaaatcttgttttgctttaaatgttgcaggaggaccagaggcttgtttaagtatagacacctcaaagacgatgaggaaacaggctacagaaggattattgaaagactgaacaacaaaaaggggaaaaacagactgcttgatggtgaaaggttggctgataggaaaattgctgagctgttctccacaaaaacacacattggc

SEQ ID NO: 3772 - RNA, 3495 nt, synthetic construct
  misc_feature 1..3495: note = derived and/or modified CDS sequence (wt) from CCHVF(CCHVF Gaib)__KX013445.1__Gn-NSm-Gc
  source 1..3495: mol_type = other RNA
tccgaagaatccagtgatgactgcatatcaagaactcagctattaaggacagagactgcagaaatccataatgataattatggagggccaggtgacaaaataactatttgtaatggttcaactattgtagatcaaaggctaggcagtgaactgggatgttacactatcaatagagtaaagtcatttaagctatgcgaaaacagtgctacagggaaatcctgtgaaatagatagcatccctgtaaagtgcaggcaagggttttgtttaaaaattactcaggagggaagaggccatgtgaagttgtcaagaggttcagaagttgtcttagatgcctgtgattcaagctgtgaaataatgataccaaaaggcaccggagacatcctagtggactgttcaggtgggcaacaacattttttaaaggataacttgattgacttagggtgtcccaatatcccactgttaggcaaaatggctatctacatttgtagaatgtctaatcatcccaaaacaaccatggcctttctcttttggtttagttttggttatgtgataacctgtatattttgcaaagccatcttttatttgttgataatcgtggggacacttggaaaaaagttcaaacagtatagagagttaaaacctcagacctgtaccatatgtgaaacaactcctgtcaacgcaatagacgctgaaatgcatgatcttaactgcagttacaatatatgcccttattgtgcatctagattaacctcagatggacttgccagacacgttgtgcactgccctaagcggaaggagaaaatagaagagactgaactgtacttaaacttagaaagagttccttgggttgttagaaaactacttcaggtgtctgaatcaactggtgtggcactgaagaggagcagttggctaattgtgctacttgtgctacttacagtctcattgtcaccagttcaatcagcacccatcggtcatggaaagacgattgagacttatcaaactagagaagggtacacaagcatttgtctatttgtactaggtggcatcttgtttatcgtctcttgcctaatgaaggggctggttgacagtgtcggcaataattttttccctgggttaactatctgcaaaacatgttccatcagcagtataaacggctttgaaattgaatcccacaaatgctactgtagtttactttgctgcccttattgtagacactgctctgctgacagagagatacatcagttgcacctaagtatctgcaaaaaaagaaaaacagggagtaatgtcatgttagccgtctgcaagcgcatgtgcttaagggtaactacagaagtaagcaacagggctctattcatccgaagcatcatcaacaccacatttgttatatgcatacttatactagcagtctgcgttatcagcacctccgcagtagagatggaaaacctgccagcaggcacctgggagagagaagaagacctaacaaacttctgtcaccaagaatgtcaagtaacggagactgaatgtctatgtccttacgaagctcttgtgctcaggaaacccctgttctcagacagcatagttaagggcatgaaaaacctgctgaactcaacaagtttagagacaagtttatcaattgaggcaccatggggagcgataaatgtccaatcaacctttaaacctactgtatcaactgcaaatatagcactcagttggagctcaatagagcacagaggcaacaagattctggtctcaggcagatcagagtcaatcatgaagctagaagagaggacaggaatcagctgggacctaggcgtggaagatgcttccgagtctaggttacttactgtttctgttatggatttgtcacaaatgtactctcccgtttttgaatacctgtcaggtgacagacaggtggaggaatggcctaaagcaacctgcacaggcgactgtcctgaaagatgtggatgcacatcgtcaacctgcttacacaaagaatggcctcattcaagaaattggagatgcaatcccacttggtgctggggagttggtaccgggtgcacctgctgtggactagatgtaaaagacctttttacagactatatgtttgtcaaatggaaagtcgagtacataaagacagaggctatagtgtgtgttgaacttacaagccaagaaaggcaatgcagtttgattgaggcaggcacaagattcaacttaggtccagtgaccatcacattgtcagaaccgagaaacattcagcaaaagcttcctcctgaaataatcacattgcaccctagaattgaagaaggcttctttgacctaatgcacgtgcagaaagtgctgtctgctagtacggtgtgtaaactacagagttgcacacacggtgtgccgggggatctacaggtctaccacattggcaatttgttaaaaggggataaggtgaacggacatctgattcacaagattgaaccacacttcaacacttcttggatgtcctgggatggttgtgacctggactactactgcaatatgggggattggccttcctgcacgtatactggagtaacccaacataaccacgccgcatttgtgaacctgctcaacattgaaactgattataccaaaaacttccacttccactctaagagagttactgcacatggagacacaccgcaattggatttgaaggctagaccaacctatggtgcaggcgagatcactgtgctggtagaagttgctgacatggagctacacacaaaaaagattgagatatcaggcctgaaatttgcgagtctaacttgcacaggttgctatgcttgcagctctggcatctcctgtaaagttaggatccatgtagatgaaccagatgagcttacagtgcatgtgaaaagtgaagatccagacatagttgcagctagctcaagtctcatggcaaggaagcttgaatttggtacagacagtacctttaaagccttttcagctatgcccaaaacctctttatgcttttacattgtagagagagaatattgcaagagctgcagtagagaagacacacaaaaatgtgtcagcacaaaacttgagcaaccacagagcattttaattgaacacaaaggaacgataatcggaaaacagaataacacctgcacaactaaaacaacctgttggttggaatcagtaaagagtttcttttatggactaaagaacatgcttagcagtatttttggcaatgttttcgtgggcattttctcattccttgcccctttcatcttactgatacttttcttcatgtttgggtggagaatcctattttgctttaagtgttgcagaaggactagaggcttatttaagtacagacatctcaaagacgatgaagagaccggttataggaggatcattgaaagattaaacaacaaaaaaggaaagagcaagttgcttgatggtgaaaggttggctgataggaagattgctgagctgttctccacaaaaacacacattgga

SEQ ID NO: 3773 - RNA, 3495 nt, synthetic construct
  misc_feature 1..3495: note = derived and/or modified CDS sequence (wt) from CCHVF(CCHVF Hodzha)__KX013448.1__Gn-NSm-Gc
  source 1..3495: mol_type = other RNA
tctgaagaatctggtgacgactgcatatcaagaactcagctactgaggacagagactgcagagatccatggtgatgattatggtggtccgggcgacaagattaccatttgcaatggttcaactattgtagatcaaagactaggtagtgaactggggtgttacactatcaatagagtgaagtcattcaagctgtgcgaaaacagtgcaacagggaagagctgtgaaatagacagcaccccagttaaatgcaggcagggttattgcctaaaaatcactcaggaaggaaggggccatgtgaaattatccaggggctcggaggttgtcttggatgcatgcgattcaagctgtgaagtaatgatacctaagggcacaggtgacatcctagtagactgttcaggtgggcagcaacattttttgaaagacaacttaattgatctaggatgtcccagaattccattattaggtaaaatggctatttatatttgcagaatgtcgaatcaccctgagacaaccatggctttcctcttttggttcagtttcggctatgtgataacctgtatactctgcaaggccattttctacttattaataattgttggaacactagggaagaggttcaagcagtatagagagttaaaaccccagacctgtaccatatgtgagacaactcctgcaaatgcaatagatgctgaaatgcatgaccttaactgcagttacaacatatgtccctattgtgcatctagactaacctcagatgggcttgctaggcatgtgacacaatgccctaagcggaaggagaaggtagaagaaactgaattgtacttgaacttagagagaattccctggattgtaagaaagctgttgcaggtgtcggagtccactggtgttgcattaaaaagaagcagctggctgattgtgctgcttgtgctgttcgcagtttcattatcacctgttcaatcagcacccattggtcatgggaagacaattgaaacataccaggccagggaagaatacacaagtatttgcctctttgtactgggaagcatcttgtttatagtctcttgtctgatgaaagggctggttgacagtattggcaacatcttcttccctgggctgaccatctgcaagacatgctctataggtagtatcaatggctttgaaattgagtctcacaagtgctattgtagcttactttgttgcccctactgtaggcactgccctgctgatagagaaattcatcagctgcacttgagcatctgcaaaaaaaggaaaacaggaagtaatgtcatgctcgcagtctgcaagcgcatgtgcttcagagcaactatggaagtgagcaataaggccctacttatccgtagcatcatcaacaccacttttgttgtgtgcatattgatattagcagtctgtgttgttagcacctcagcggtagagatggaaagcctaccagctgggacctgggaaagagaagaagacctaacaaatttctgtcatcaggaatgccaggttacagagactgagtgcctctgcccttatgaagcccttgtgctcagaaggcccctgttcctggatagtatagttaaaggcaagaaaaatctgttaaactccacaagtttagaaacaagcttgtcgattgaggcaccatggggggcaataaatgttcagtcaacctacaaaccaactgtatcaactgcaaacatagcacttagttggagttcagttgaacacagaggtaataagattttggtttcaggcagatcagaatcaattatgaagctggaagaaagaacaggaatcagctgggatcttggcgttgaagatgcctctgaatctaagctacttactgtctctgtcatggacttgtctcagatgtactcccctgtcttcgagtacttatcgggtgacagacaagtagaagagtggcccaaggcaacctgcacaggtgactgctcagaaagatgtggctgcacatcatcaacctgcttacataaagaatggccccattcacgaaactggagatgcaatcccacttggtgctggggggtggggactggctgcacctgttgtggattagatgtgaaagacctatttacagattatatgttcgtcaagtggaaagttgattacattaaaacagaggccatagtgtgtgtagaactcaccagtcaggaaaggcagtgtagcttggttgaggcgggcacaaggttcaatttaggtcctgtaaccatcacattgtcagaaccgaggaacatacaacaaaagctccctcctgaaataatcacattgcatcctaggattgaagaaggtttttttgacctgatgcatgtacaaaaagtgctgtcagcaagcacagtgtgtaaattgcagagttgcacacatggtgtgccaggagatctacaggtctaccacatcggaaatttattaaaaggagataaagtgaacggacacctaattcataaaattgagccgcacttcaatacttcctggatgtcctgggatggctgtgacctagactactactgcaacatgggagactggccttcttgcacatataccggagttactcaacacaatcatgcttcatttgtaaacctgctcaacattgaaactgactatacaaaaagcttccactttcactctaaaagggttactgcacatggagacacaccacaattggatctgaaggcaagaccaacctacggcgcaggagaaatcactgtactggtagaagttgctgatatggagttacacacaaagaagatcgaaataacaggcctcaaatttgcaagcctgacttgcacaggttgttatgcttgtagttcaggcatctcctgcaaagttaggattcacgtggatgaaccagatgagctaacagtacatgttaaaagtgatgatccagatgtagttgcagccagctcaagtctcatggcaaggaaacttgagtttggaacagacagtacattcaaagctttctcagccatgcctaaaacttccttatgcttctacattgtcgaaagggagtactgtaagagctgcagtaaagaagacacacagaaatgtgttaacacaaaacttgagcaaccacagagcattttgatcgaacaaaagggaactataatcggaaagcaaaacaatacttgcacagccaaggcaagttgctggttagagtcagttaaaagtttcttttatggtctaaagaacatgcttagtggcatttttggcaatgtttttgtaggcattttcttatttcttgccccctttatcttgttaatacttttcttcatgtttggatggaggatcctgttttgcttcaagtgttgcagaagaaccaggggcctgtttaagtataaacatctcaaagacgatgaagaaactggttacagaaggatcattgaaagactgaacaacaagaaggggaaaaacaagctgcttgacggtgaaagacttgccgatagaaggattgccgaactattctccacaaaaacacacattggc

SEQ ID NO: 3774 - RNA, 3495 nt, synthetic construct
  misc_feature 1..3495: note = derived and/or modified CDS sequence (wt) from CCHVF(CCHVF IbAn7620)__KX013451.1__Gn-NSm-Gc
  source 1..3495: mol_type = other RNA
tccgaagaacccagtgatgactgtatatcaagaactcaactattgaggacagagactgcagagatccacggcgacaactatggtggcccgggtgataaaataaccatctgcaatggctcaactattgtagaccaaagactgggcagtgaactagggtgttacaccatcaatagagtgaagtcattcaagctatgcgaaaacagtgccacagggaagaattgtgaaatagacagtgtcccagttaaatgcaggcagggttattgcctaagaatcactcaagaagggaggggccacgtaaaattatctaggggctcagagattgtcttagatgcatgcgatacaagctgtgaaataatgatacctaagggcactggtgacatcctagttgactgttcaggtgggcagcaacattttctaaaggacaatttgatagatctaggatgccctaaaattccattattgggcaaaatggctatttacatttgcagaatgtcgaaccaccccaaaacaaccatggctttcctcttctggttcagctttggttatgtaataacctgtatactttgcaaggccattttttacttgttaataattattggaacactagggaaaaggctcaagcagtatagagagttgaaacctcagacctgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtcaagggaagacaactgaggcataccgggccagggaagggtacacaagtatatgtctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaagaggaaaacaggaagtaatgtcatgttggctgtctgcaagcgcatgtgtttcagggccaccatggaagtgagtaacagagccctgtttatccgtagcatcatcaacaccacttttgtcttgtgcatactgatactagcagtttgtgttgttagcacctcagcagtggagatggaaaacctaccagcagggacctgggaaagagaagaagatctgacaaatttctgtcatcaggaatgccaggttacagagactgaatgcctctgcccttatgaagctctagtactcagaaagcctttgttcctagatagtatagctaaaggcatgaaaaatccgctaaattcaacaagtttagaaacgagtttatcaattgaggcaccatggggagcaatagatgttcagtcaacctacaaaccaactgtgtcaactgcaaacatagcactcagttggagctcagtggaacacagaggtaataagatcttggtttcaggcagatcagaatcaattatgaagctagaagaaaggacgggaatcagctgggatctcggcgtagaagatgcctctgagtctaaactgcttacagtctctgtcatggacctgtctcagatgtactctcctgtcttcgagtacttatcaggggacagacaggtggaagagtggcccaaagcaacttgtacaggtgattgcccagaaagatgtggttgcacatcatcaacctgtttgcacaaagaatggcctcactcaagaaattggagatgcaatcccacttggtgctggggagtagggactggctgcacctgttgtggattagatgtgaaagacctttttacagattatatgtttgtcaagtggaaagttgaatacatcaagacagaggccatagtgtgtgtagaacttaccagtcaggaaaggcagtgtagcttgattgaagcgggcacgaggttcaatttaggtcctgtgaccatcacactgtcagaaccaagaaacatccaacaaaaactccctcctgaaataatcacactgcatcctaggatcgaagaaggtttttttgatctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacttcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagacacaccacaactagatcttaaggcaagaccaacctatggtgcaggcgagatcactgttctggtagaagttgctaacatggagttacatacaaagaagattgaaatatcaggcttaaaatttgcaagcttgacttgtacaggttgttatgcttgtagctctggcatctcatgcaaagttagaattcatgtggatgaaccagatgaacttacagtacatgttaaaagtgatgatccagatgtggttgcagctagctcaagtctcatggcaagaaagcttgaatttggaacagacagtacatttaaagctttctcggccatgcccaaaacttctctatgtttctacattgttgaaagagaacactgtaagagctgcagtgaagaagatacaaaaaaatgtgttaacacaaagcttgagcaaccacaaagcattttgatcgaacacaagggaactataataggaaagcaaaacagcacttgcacggctaaggcgagttgctggttggagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtacagacacctcaaagacgatgaagaaactggttatagaaggattattgaaagactaaacaataaaaaaggaaaaaacaagctgcttgatggtgaaagacttgctgatagaagaattgccgaactgttctctacaaaaacacacattggc

SEQ ID NO: 3775 - RNA, 3495 nt, synthetic construct
  misc_feature 1..3495: note = derived and/or modified CDS sequence (wt) from CCHVF(CCHVF K128_76)__KX013454.1__Gn-NSm-Gc
  source 1..3495: mol_type = other RNA
tctgatgaatctggtgatgactgcatatcaaggactcagctgttgagaacagagactgcagagatccatggtgacaattatggtggtccgggtgacaagattaccatttgcaatggttcaactattgtagaccaaagactgggtagtgaactggggtgttacactatcaatagagtgaagtcattcaagctgtgcgaaaacagtgccacagggaagagctgtgaaatagacagtatcccagttaagtgcaggcagggttattgcctaaaaatcactcaagaaggaaggggccatgtgaaattatccaggggctcagaggttgtcttggatgcatgcgactcaagctgtgaagtaatgatacctaagggcacaggtgacattctagtagactgttcaggtgggcagcaacattttttgaaggacaacttgattgacctaggatgtcccaaaattccattgttgggcaaaatggctatttatatttgtagaatgtcgaatcaccccaaaacgaccatggctttcctcttttggttcagttttggctatgtgataacttgtatagtctgcaaagccattttttacttattaataattgttggaacactagggaagaggtttaagcagtatagagagttaaaaccccagacctgtaccatctgtgagacaactcctacaaatgcaatagatgctgaaatgcatgaccttaactgcagttacaacatatgtccctattgtgcatctagactaacctcagatgggcttgctaggcatgtaactcattgccctaagcggaaggagaaagtagaagaaactgaattgtacttgaacttagaaagaattccatgggttgtaagaaagctattgcaggtatcagagtccaccggtgtagcattaaaaagaagcagctggctgattgtgctgcttgtgctgtttgcagtttcattatcaccagttcaatcagcacccattagtcatgggaagacaattgaaacataccaggtcagggaggaatacacaagtatttgcctctttgtactgggaagcattttgtttattgtctcttgtctaatgaaagggctggttaacagtgttggcaacatcttcttccctgggctgtccatttgcaagacgtgctctataggtagtattaatggctttgaaattgagtctcataagtgctattgtagcttactttgttgcccttactgtaggcactgctctgctgatagagaaattcatcaactgcacttgagcatctgcaaaaaaagaaaaacaggaagtaatgtcatgcttgctgtttgcaagcgcatgtgtttcagagcaacaatggaagtgagcaacaaggccctatttatccgtagcatcatcaacaccacttttgttgtgtgcattttgatactagcagtctgtgttgttagcacttcagcagtagagatggaaagcctgccagctgggacctgggaaagagaagaagacctaacaaatttctgtcatcaggaatgccaggttactgagactgagtgcctctgcccttatgaagctctagtactcagaaggcccctgtttcaggacagtatagtcaaaggcatgaaaaacctgctaaactcaacaagtttagaaacaagcttgtcgattgaggcaccatggggggcaataaatgttcagtcaacctacaaaccagctgtgtcagctgcaaacatagcacttagttggagttcagttgaacacagaggtagtaagattttggtttcaggcagatcagaatcaattatgaagctggaagaaaggacaggaatcagctgggatcttggcgtagaagatgcctctgaatctaagctacttacagtctctgtcatggacttgtctcagatgtactcccctgtcttcgagtacttgtcaggtgacagacaagtagaagagtggcccaaggcaacctgtacaggtgactgcccagagagatgtggttgtacatcatcaacctgtttgcataaagaatggccccattcaagaaactggaggtgtaatcccacttggtgctggggggtagggactggctgcacctgttgtggtttagatgtgaaagacctttttacagactatatgttcgtcaagtggaaagttgaatatattaagacagaggccatagtgtgtgtagaacttaccagtcaggaaaggcagtgtagtttaattgaggcaggtacaaggttcaatttaggtcctgtgaccatcacattgtcagaaccgaggaacatccaacaaaagctccctcctgaaataatcacactgcatcctaggattgaagaaggtttttttgacctgatgcatgtgcaaaaggtgctgtcagcaagcacagtgtgtaagttgcagagttgcacacatggtgtgccaggagatctacaagtctaccacatcgggaatttactaaaaggagatagagttaacggacacctaattcataaaattgagccacactttaacacttcttggatgtcctgggatggctgtgacctagactattactgcaacatgggagactggccttcttgcacatataccggagttacccagcacaatcatgcttcatttgtgaacctgctcaacattgaaactgactatacaaaaagcttccattttcactctaaaagggttactgcacatggagacacaccacaattagatctgaaggcaaggccaaactatggcgcaggagagatcaccgtactggtagaggttgccgatatggagttacacacaaagaagattgaaatatcaggcctaaagtttgcaagcttgacttgtacaggttgttatgcttgtagttccggtatctcctgtaaagttaggattcatgtggatgaaccagatgaacttacagtacatgttaaaagtgatgatccagatgtagttgcagctagctcaagtctcatggcaaggaagcttgaatttggaacagacagtacatttaaggctttctcagccatgcccaaaacctccttatgtttctacattgtcgaaagggagtactgcaagagctgcagtaaagaagacacacaaaaatgtgttaacacaaaacttgagcagccacagagcattttaatcgaacataagggaactataatcggaaagcaaaacaatacctgcacagcaaagacaagttgctggttagagtcagttaaaagtttcttttatggtttaaagaacatgcttagtggcatttttggcaatgtttttgtgggtattttcttatttcttgcccccttcatcttgctaatacttttctttatgtttgggtggaggatcctgttttgcttcaagtgctgtagaagaaccagaggcctgttcagatataagcatctcgaaaacgatgaagaaactggttacagaagaatcattgaaagactgaacaacaaaaaaggaaaaaacaagctgcttgatggtgaaagacttgctgatagaagaatcgccgaactattctccacaaaaacacacattggc

SEQ ID NO: 3776 - RNA, 3495 nt, synthetic construct
  misc_feature 1..3495: note = derived and/or modified CDS sequence (wt) from CCHVF(CCHVF K168_40)__KX013457.1__Gn-NSm-Gc
  source 1..3495: mol_type = other RNA
tctgatgagtctggtgatgactgcatatcaaggactcagctactgagaacagagactgcagagatccatggtgacaattatggtggtccgggtgacaagattaccatttgcaatggttcaactattgtagaccaaagactgggcagtgaactggggtgttacactatcaatagagtgaagtcattcaagctgtgcgaaaacagtgccacagggaagagctgtgaagtagacagtatcccagtaaaatgcaggcagggttattgcctaaaaatcactcaggaaggaaggggccacgtgaaattatccagaggttcagaggttgtcttggatgcatgcgattcaagctgtgaagtaatgatacctaagggcacaggtgacatcctagtggactgttcaggtgggcagcaacatttcttgaaggacaacttaattgacctaggatgtcccaaaattccattgttgggcaaaatggctatttatatttgcagaatgtcgaatcaccccaagacaaccatggctttcctcttttggttcagttttggctatgtgataacttgtatagtctgcaaggccattttttacttattaataattgttggaacactagggaagaggtttaagcagtatagagagttaaaaccccagacctgcaccatctgtgagacaactcctacaaatgcaatagatgctgaaatgcatgaccttaactgcagttacaacatatgtccctattgtgcatctagactaacctcagatgggcttgctaggcatgtaactcattgccctaagcggaaagagaaagtagaagaaactgaattgtacttgaacttagagagaattccctgggttgtaagaaagctgttgcaggtatcagagtccaccggtgtagcattaaaaagaagcagctggctgattgtgctgcttgtgctgtttgcagtttcattatcaccagttcaatcagcacctattggtcatgggaagacaattgaaacataccaggtcagggaggaatacacaagtatttgcctctttgtactgggaagtatcttgttcatagtctcttgtctaatgaaagggctggttaacagtgttggcaacatcttcttccctgggctgtccatttgcaagacgtgctctataggtagtattaatggctttgaaattgagtctcataagtgctattgtagcttactttgttgcccttactgtaggcactgctctgctgacagggaaattcatcaattgcacttgagcatctgcaagaaaagaaaaacaggaagtaatgtcatgcttgctgtttgcaagcgcatgtgtttcagagcaactgtggaagtgagcaacaaggccctatctatccgtagcatcatcaacaccacttttgttgtgtgcattttaatactagcagtctgtgttgttagcacttcagcagtagagatggaaagcctaccagctgggacctgggaaagagaagaagatctaacaaatttctgtcatcaggaatgccaggtcacggagactgagtgcctctgcccttatgaggctctagtactcagaaggcccctgtttctggacggtatagtcaaaggcatgaaaaacctgctaaactcaacaagtttggaaacaagcttgtcgattgaggcaccatggggggcaataaatgttcagtcaacctacaaaccaactgtatcagctgcaaacatagcacttagttggagttcagttgaacacagaggtaataagattttggtttcaggcagatcagaatcaattatgaagctggaagaaaggacaggaatcagctgggatcttggcgtagaagatgcctctgaatctaagctactcacagtctctgtcatggacttgtctcagatgtactctcctgtcttcgagtacttgtcaggtgacagacaagtagaagagtggcccaaggcaacctgtacaggtgactgcccagagagatgtggctgtacatcatcaacctgtttgcataaagaatggccccattcaagaaactggaggtgtaatcccacttggtgctggggggtagggactggctgcacctgttgtggtttagatgtgaaagacctttttacagactatatgtttgtcaagtggaaagtcgaatacattaagacagaggccatagtgtgtgtagaacttaccagtcaggaaaggcagtgtagcttaattgaggcgggtacaaggttcaatttaggtcccgtgaccatcacattgtcagaaccgaggaacatccaacaaaaactccctcctgaaataatcacactgcatcctaggattgaagaaggtttttttgacctgatgcatgtacaaaaggtgctgtcagcaagcacagtgtgtaagttgcagagttgcacacatggtgtgccaggagatctacaggtctaccacatcggaaatttactaaaaggagataaagttaacggacacctaattcataaaattgaaccacacttcaacacttcttggatgtcttgggatggctgtgacctagactactactgcaacatgggagattggccttcttgcacatataccggggttacccagcacaatcatgcttcatttataaacctgctcaacattgaaactgactatacaaaaagcttccattttcactctaaaagggttactgcacatggagacacaccacaattagatctgaaggcaaggccaaactatggcgcaggagagatcaccgtactggtagaggttgccgatatggagttacacacaaagaagattgaaatatcaggactaaagtttgcaagcttgacttgtacaggttgttatgcttgtagttccggtatctcctgtaaagttaggattcatgtggatgaaccagatgaacttacagtacatgttaaaagtgatgatccagatgtagttgctgctagctcaagtctcatggcaaggaagcttgaatttggaacagacagtacatttaaggctttctcagccatgccaaaaacctccttatgtttctatattgtcgaaagggaatactgcaagagctgcagtaaagaagacacacaaaaatgtgttaacacgaagcttgagcatccacagagcattttgatcgaacataagggaactataatcggaaagcagaacaatacctgcacagcaaagacaagttgctggttagagtcagttaagagtttcttttatggtttaaagaacatgcttagtggcattttcggcaacgtttttgtaggcattttcttatttcttgcccccttcatcttgctaatacttttctttatgtttgggtggaggatcctattttgcttcaagtgctgtagaagaaccagaggcctgtttagatataaacatctcgaagacgatgaagaaactggttacagaagaatcattgaaagactgaacaacaaaaaaggaaaaaacaagctgcttgatggtgaaagacttgctgatagaagaattgccgaactattctccacaaaaacacacattggc

SEQ ID NO: 3777 - RNA, 3495 nt, synthetic construct
  misc_feature 1..3495: note = derived and/or modified CDS sequence (wt) from CCHVF(CCHVF K168_125)__KX013460.1__Gn-NSm-Gc
  source 1..3495: mol_type = other RNA
tctgatgagtctggtgatgactgcatatcaaggactcagctactgagaacagagactgcagagatccatggtgacaattatggtggtccgggtgacaagattaccatttgcaatggttcaactattgtagaccaaagactgggcagtgaactggggtgttacactatcaatagagtgaagtcattcaagctgtgcgaaaacagtgccacagggaagagctgtgaagtagacagtatcccagtaaaatgcaggcagggttattgcctaaaaatcactcaggaaggaaggggccacgtgaaattatccagaggttcagaggttgtcttggatgcatgcgattcaagctgtgaagtaatgatacctaagggcacaggtgacatcctagtggactgttcaggtgggcagcaacatttcttgaaggacaacttaattgacctaggatgtcccaaagttccattgttgggcaaaatggctatttatatttgcagaatgtcgaatcaccccaagacaaccatggctttcctcttttggttcagttttggctatgtgataacttgtatagtctgcaaggccattttttacttattaataattgttggaacactagggaagaggtttaagcagtatagagagttaaaaccccagacctgcaccatctgtgagacaactcctacaaatgcaatagatgctgaaatgcatgaccttaactgcagttacaacatatgtccctattgtgcatctagactaacctcagatgggcttgctaggcatgtaactcattgccctaagcggaaagagaaagtagaagaaactgaattgtacttgaacttagagagaattccctgggttgtaagaaagctgttgcaggtatcagagtccaccggtgtagcattaaaaagaagcagctggctgattgtgctgcttgtgctgtttgcagtttcattatcaccagttcaatcagcacctattggtcatgggaagacaattgaaacataccaggtcagggaggaatacacaagtatttgcctctttgtactgggaagtatcttgttcatagtctcttgtctaatgaaagggctggttaacagtgttggcaacatcttcttccctgggctgtccatttgcaagacgtgctctataggtagtattaatggctttgaaattgagtctcataagtgctattgtagcttactttgttgcccttactgtaggcactgctctgctgacagggaaattcatcaattgcacttgagcatctgcaagaaaagaaaaacaggaagtaatgtcatgcttgctgtttgcaagcgcatgtgtttcagagcaactgtggaagtgagcaacaaggccctatctatccgtagcatcatcaacaccacttttgttgtgtgcattttaatactagcagtctgtgttgttagcacttcagcagtagagatggaaagcctaccagctgggacctgggaaagagaagaagatctaacaaatttctgtcatcaggaatgccaggtcacggagactgagtgcctctgcccttatgaggctctagtactcagaaggcccctgtttctggacagtatagtcaaaggcaagaaaaacctgctaaactcaacaagtttggaaacaagcttgtcgattgaggcaccatggggggcaataaatgttcagtcaacctacaaaccaactgtatcagctgcaaacatagcacttagttggagttcagttgaacacagaggtaataagattttggtttcaggcagatcagaatcaattatgaagctggaagaaaggacaggaatcagctgggatcttggcgtagaagatgcctctgaatctaagctactcacagtctctgtcatggacttgtctcagatgtactctcctgtcttcgagtacttgtcaggtgacagacaagtagaagagtggcccaaggcaacctgtacaggtgactgcccagagagatgtggctgtacatcatcaacctgtttgcataaagaatggccccattcaagaaactggaggtgtaatcccacttggtgctggggggtagggactggctgcacctgttgtggtttagatgtgaaagacctttttacagactatatgtttgtcaagtggaaagtcgaatacattaagacagaggccatagtgtgtgtagaacttaccagtcaggaaaggcagtgtagcttaattgaggcgggtacaaggttcaatttaggtcccgtgaccatcacattgtcagaaccgaggaacatccaacaaaaactccctcctgaaataatcacactgcatcctaggattgaagaaggtttttttgacctgatgcatgtacaaaaggtgctgtcagcaagcacagtgtgtaagttgcagagttgcacacatggtgtgccaggagatctacaggtctaccacatcggaaatttactaaaaggagataaagttaacggacacctaattcataaaattgaaccacacttcaacacttcttggatgtcttgggatggctgtgacctagactactactgcaacatgggagattggccttcttgcacatataccggggttacccagcacaatcatgcttcatttataaacctgctcaacattgaaactgactatacaaaaagcttccattttcactctaaaagggttactgcacatggagacacaccacaattagatctgaaggcaaggccaaactatggcgcaggagagatcaccgtactggtagaggttgccgatatggagttacacacaaagaagattgaaatatcaggcctaaagtttgcaagcttgacttgtacaggttgttatgcttgtagttccggtatctcctgtaaagttaggattcatgtggatgaaccagatgaacttacagtacatgttaaaagtgatgatccagatgtagttgctgctagctcaagtctcatggcaaggaagcttgaatttggaacagacagtacatttaaggctttctcagccatgccaaaaacctccttatgtttctatattgtcgaaagggaatactgcaagagctgcagtaaagaagacacacaaaaatgtgttaacacgaagcttgagcatccacagagcattttgatcgaacataagggaactataatcggaaagcagaacaatacctgcacagcaaagacaagttgctggttagagtcagttaagagtttcttttatggtttaaagaacatgcttagtggcattttcggcaacgtttttgtaggcattttcttatttcttgcccccttcatcttgctaatacttttctttatgtttgggtggaggatcctattttgcttcaagtgctgtagaagaaccagaggcctgtttagatataaacatctcgaagacgatgaagaaactggttacagaagaatcattgaaagactgaacaacaaaaaaggaaaaaacaagctgcttgatggtgaaagacttgctgatagaagaattgccgaactattctccacaaaaacacacattggc

SEQ ID NO: 3778 - RNA, 3495 nt, synthetic construct
  misc_feature 1..3495: note = derived and/or modified CDS sequence (wt) from CCHVF(CCHVF K229_194)__KX013463.1__Gn-NSm-Gc
  source 1..3495: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaaggcaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtatcagagtccactggtgtggcattgaaacgaagcagctggctgattgtgctgcttgtgttactcacagtctcattgtcaccggttcaatcagcacctgttggtcatggtaagacaatcgaaacatatcagaccagagaaggattcacaaatatctgtctctttatgttaggaagcatcctattcatagtttcttgcctggtgaaggggctggttgacagtgtcagtgacagcttcttccccggcctgtctgtctgtaagacatgctctattggcagtataaatggctttgaaattgaatcgcataaatgctactgtagtttattttgctgcccctactgtaggcactgctctgctgacagagaaattcaccagttgcacttgggtatctgcaaaaaaagaaaaacggggagcaatgtcatgctggctgtctgcaagcgcatgtgctttaaggcaaccatagaagcaagcagaagagccctgctcatccgaagcattatcaataccacttttgtaatatgcatcctaacattagcaatctgtgttgttagcacctctgcagtagagatggaaaatcttccagcaggcacttgggagagagaggaagacctgacaagtttctgccatcaggaatgccaggtaaccgagacggaatgcctctgtccatacgaagctcttgtgctcaggaaacctctttttttagacagtatagttaaaggtaagaaaaatctgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggacctgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacctgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctattcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttatgtttttacattgtggagagggaatactgcaagagctgcagtgaagatgatacaaaaaaatgtgttgacacaaaacttgagcagccacagagcatactaattgagcacaaagggacgataattggaaagcaaaatgacacttgcacagccaaggcaagttgttggctagagtcagtcaagagttttttttatggattgaagaatatgcttggcagtgtttttggtaattttttcgtaggcattttgttattccttgccccctttgtcttgttggtgcttttctttatgtttggatggaaaatcttgttttgctttaagtgttgcaggaggaccagaggcttgtttaagtatagacacctcaaagatgatgaggaaacaggctacagaaagattattgaaagactgaacagcaaaaaaggaaaaaacagactgcttgatggtgagaggttggctgataggaaaattgctgagctgttctctacaaaaacacacattggc

SEQ ID NO: 3779 - RNA, 3495 nt, synthetic construct
  misc_feature 1..3495: note = derived and/or modified CDS sequence (wt) from CCHVF(CCHVF K229_243)__KX013466.1__Gn-NSm-Gc
  source 1..3495: mol_type = other RNA
tccgaagagccaggtgatgactgcatatcaagaactcagctattgaggacagaaacagcagagatccatgatgacaactatggtggtccaggtgataaaataactatctgcaacggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgtcttggatgcctgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgtaaggctcttttttattcattgataattattgggacactagggaaaaagatcaagcaatatagggaattgaaacctcaaacttgtaccatatgtgagacagctcctgtcaatgcaatagatgctgaaatgcatgaccttaactgcagttacaatatatgcccttattgtgcatcaagattgacctccgatgggctggctaggcatgtgccacaatgccccaagcggaaggaaaaagttgaggagactgagctgtacttgaacctggaaagaatcccttggattgtcagaaagctattgcaagtgtcagagtccactggtgtggcattgaaacgaagcagctggctgattgtactgcttgtgttactcacagtttcattgtcaccggttcaatcagcacctgttggtcatggtaaaacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcaccagttacacttgagtatctgcaaaaaaagaaaaacgggtagcaatgtcatgctggctgtctgcaaacgcatgtgctttagggcaaccatagaagcaagcagaagagccctgctcatccgaagcattatcaataccacttttgtaatatgcattttaacattgacaatctgtgttgttagcacctctgcagtagagatggaaaaccttccagcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtggaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgtacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactatcaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatcttcaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagaaagaatactgcaagagctgcagtgaagaggacacacaaaaatgtgttgacacaaaacttgagcagccacagagcatactaattgagcacaaaggaacgataattggaaagcagaatgatacttgcacagccaaagcaagctgttggctagagtcagtcaagagttttttttatggattgaagaatatgcttggtagtgtctttggtaactttttcataggcattttgttattccttaccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaagggaaaaacagactgcttgatggtgaaaggttggctgataggaaaattgctgagctgttctccacaaaaacacacattggt

SEQ ID NO: 3780 - RNA, 3495 nt, synthetic construct
  misc_feature 1..3495: note = derived and/or modified CDS sequence (wt) from CCHVF(CCHVF K315_14)__KX013469.1__Gn-NSm-Gc
  source 1..3495: mol_type = other RNA
tccgaagagccaggtgacgactgcatatcaagaactcagctattgaagacagaaacagcagaaatccatgacgacaactatggtggtccaggtgacaaaataactatctgcaatggttcaaccgttgtggatcagagactgggcagtgaactagggtgttataccatcaacagggtgaagtcattcaagctatgcaaaaacagtgccacagggaaaacctgtgagatagacagcactccggtcaagtgcaggcaaggtttttgtttgaaaatcacccaagagggaaggggccacgtaaaattatccaggggctcagaggttgttttggatgtttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgaagggctagctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggtcatggtaagacaatcgaaacatatcagaccagagaaggattcacaagtatctgtctctttatgttaggaagcatcctattcatagtttcttgcctggtaaaggggctggtttacagtgtcagtgacagcttcttccccggcctgtctgtctgtaagacatgctctattggcagtataaatggctttgaaattgaatcgcataaatgctactgtagtttattttgctgcccctactgtaggcactgctctgctgacagagaaattcaccagttgcacttgagtatctgcaaaaaaagaaaaacagggagcaatgtcatgctggctgtctgcaagcgcatgtgctttaaggcaaccatagaagcaagcagaagagccctgctcatccgaagcattatcaataccacttttgtaatatgcattctaacattagcaatctgtgttgttagcacctctgcagtagagatggaagaccttccagcaggcacttgggagagagaggaagacctaacaaatttctgccatcaggaatgccaggtgaccgagacggaatgcctctgtccatacgaagctcttgtgctcaggaaacctcttttcttagacagtatagttaaaggtatgaaaaaattgctaaactcaacaagcttagaaacaagcttatcaattgaggcaccatggggagcaataaatgtccagtcaacctttaaaccaacagtatctactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggacttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacatcggtaacttgttgaaaggggatagagtaaacgggcatctgattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcctgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagccatgcccaaaacctctttatgcttttacattgtagagagggaatactgcaagagctgcagtgaagatgatacaaaaaaatgtgttgacacaaaacttgagcagccacagagcatactaattgagcacaaggggacaataattggaaagcagaatgatacttgcacagccaaggcaagttgttggctagagtcagtcaagagttttttttatggactgaagaatatgcttggcagtgtttttggtagttttttcgtaggcattttgttattccttgccccttttgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaagggaaaaacagactgcttgatggtgagaggttggctgataggaaaattgctgagctgttctctacaaaaacacacattggc

SEQ ID NO: 3781 - RNA, 3495 nt, synthetic construct
  misc_feature 1..3495: note = derived and/or modified CDS sequence (wt) from CCHVF(CCHVF K323_27)__KX013472.1__Gn-NSm-Gc
  source 1..3495: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaagctcttttttatttattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgactgtgctgcttgtgttactcacagtctcattgtcaccggtccaatcagcacctgttggccatggtaatacaatcgaaacatatcagaccagagagggattcacaagtatctgtctctttatgttaggaagcatcctattcatagtttcttgcctggtaaaggggctggttgacagtgtcagtgacagcttcttccccggcctgtctgtctgtaagacatgctctattggcagtataaatggctttgaaattgaatcgcataaatgctactgtagtttattttgctgcccccactgtaggcaccgctctgctgacagagaaattcaccagttgcacttgagtatctgcaaaaaaagaaaaacggggagcaatgtcatgctggctgtctgcaagcgcatgtgccccaaggcaaccatagaagcaagcagaagagccctgcccatccgaagcatcatcaacaccactcttgtaatgtgcattctaacattagcaatctgtgttgttagcacctctgcagtagagatggaagaccttccagcaggcacctgggagagagaggaagacctaacaaatttctgccatcaggaatgccaggtgaccgagacggaatgcctctgtccatacgaagctcttgtgctcaggaaacctcttttcttagacagtatagccaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatacataaaaaccgaagccatagtatgtgttgagctcaccggccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgttgttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctggagtcagtcaagagttttttttatggattgaagaatatgcttggcagtgtttttggtagttttttcgtaggcattttgttattccttgccccttttgtcttgttggtgcttttctttatgtttggatggaaaatcttgttttgctttaagtgttgcaggaggaccagaggcttgtttaagtatagacacctcaatgatgacgaggaaacaggctacagaaggatcattgaaagactgaacagcaaaaaaggaaaaaacagactgcttgatggtgagaggttggctgataggaaaattgctgagctgttctctacaaaaacacacattggc

SEQ ID NO: 3782 - RNA, 3495 nt, synthetic construct
  misc_feature 1..3495: note = derived and/or modified CDS sequence (wt) from CCHVF(CCHVF K340_6)__KX013475.1__Gn-NSm-Gc
  source 1..3495: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtctttcaagctatgcgaaaacagtaccacagggaaaacctgtgagatagacagcactccggtcaagtgcaggcaaggcttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgccattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctggctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggtcatggtaagacaatcgaaacatatcagaccagagagggattcacaagtatctgtctctttatgttaggaagcatcctattcatagtttcttgcctggtaaaggggctggttgacagtgtcagtgacagcttcttccccggcctgtctgtctgtaagacatgctctattggcagtataaatggctttgaaattgaatcgcataaatgctactgtagtttattttgttgcccctactgtaggcactgctctgctgacagagaaattcaccagttgcacttgagtatctgcaaaaaaagaaaaacggggagcaatgtcatgctggctgtctgcaagcgcatgtgctttaaggcaaccatagaagcaagcagaagagccctgctcatccgaagcattatcaataccacttttgtaatgtgcattctaacattagcaatctgtgttgttagcacctctgcagtagagatggaagaccttccagcaggcacttgggagagagaggaagacctaacaaatttctgccatcaggaatgccaggtgaccgagacggaatgcctctgtccatacgaagctcttgtgctcaggaaacccctttccttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagagtaaacggccatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttactgacatggagttgcataccaaaaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtagttttttcgtaggcattttgttattccttgcccctttcgtcttgttggtgcttttctttatgtttggatggaaaatcttgttttgctttaagtgttgcaggaggaccagaggcttgtttaagtatagacacttcaaagatgacgaggaaacaggctacagaaggattattgaaagactgaacagcaaaaaaggaaaaaacagactgcttgatggtgagaggttggctgataggaaaattgctgagctgttctctacaaaaacacacattggc

SEQ ID NO: 3783 - RNA, 3495 nt, synthetic construct
  misc_feature 1..3495: note = derived and/or modified CDS sequence (wt) from CCHVF(CCHVF Mamon)__KX013478.1__Gn-NSm-Gc
  source 1..3495: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgtttcggatgcttgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactgtggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattaaaacgaagcagctggctgattgtactgcttgtgttactcacagtttcattgtcaccggttcaatcagcacctgttggtcacggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcaccagttacacttgagtatctgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtgtgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggtgatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctcgttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaagacaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 3784 - RNA, 3495 nt, synthetic construct
  misc_feature 1..3495: note = derived and/or modified CDS sequence (wt) from CCHVF(CCHVF Min)__KX013481.1__Gn-NSm-Gc
  source 1..3495: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcgttcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtactatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgcactattggcagtataaatggctttgaaattgaatcgcataaatgctactgtagcctattttgctgcccctactgtaggcactgctctgctgacagagaaattcaccagttacacttgagtatctgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcacgaagaatttgctaaactcaacaagcttagaaacaagcttatcaattgaggcaccatggggagcaataaatgtccagtcaacctttaaaccaacagtgtcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcctacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggataggataaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 3785 - RNA, 3495 nt, synthetic construct
  misc_feature 1..3495: note = derived and/or modified CDS sequence (wt) from CCHVF(CCHVF Nakiwogo)__KX013484.1__Gn-NSm-Gc
  source 1..3495: mol_type = other RNA
gcagaaggagtgagcaatgactgcgtttcaaggacccagctaatcaaaacagaagttgcagagattcacgaagatagctacggtgggcctggagaaaaaataacaatctgcaacggctccacaatcgtggaccaaaggcttggtagcgaactaggttgctacacaattaaccgcgtgaagacttataagctttgtgagaacagtgccacagaaaagggttgtgagatcgatagtgttccagtcaaatgcaaacaagggttctgcctcaaagtaacccaagagggcaggggccatgtgaaactatctagaggaacggaaattgtcctggatgtgtgtgacaccagttgtgagttgatgatacctaaaggcactggagacatattggtggattgctcaggaggacagcagcacttcttgcaggacaacttgattgacttaggttgcccaaatgtaccattactaggcaagatggcaatatatatctgcaggatgtcgaaccatcctaagaccaccatggcttttttgttctggttcagttttggctatgtcatcacatgcgtagtatgcaaagtgctcttctatctgctaattgtcattgggacactaggaaagaaacttaaacagtatagggaactaaaacctcagacatgcattgtctgtgaatcaatccctgtcaatgtaatagatgctgaaatgcacgagctcaattgcaattacaatatatgcccatactgtgcgtccagactgacttcagatggactagttagacatgtgactcaatgtcccaaaaggaaggaaaaggtcgaggagactgagctgtacttgaacctggagaggataccttggttggtaagaagactactgcaagtgtcagagtcaacagggatggctctaaagagaagttgctggatgaccacactcctcattctgctagtagtttcattgtctccagttcaatctgctccagttggtcaggagaaagcaatcgaagtctaccaggtgagagaaagttacacaagcatgtgcctctttgtattaggaagtgttctctttgcagtctcctggctggtaaagggtttgattgacggtatcggcaacagttttttccctgggctttctgtctgcaaaacatgctctattggcagcataaatggatttgaaatagagtcccacaaatgctattgtagtctgttctgttgtccttactgcagagcttgctcatctgataaaatcactcaccgaatgcatttgaatatctgcaagaggaggaaagtgggtagcaatgttatgctggctgtctgtaagcgtatgtgctttaaggcgactgttgaagcaagcaactcagccctgctcatcagaagcatcataaactccacctttgtgatatgcgtgctgattctagttatctgtgtggtaagcacatctgctgtcgacatggagaatctaccagcaggcatctgggagagagaagaagaccttacaaacttctgccatcaagaatgccaagtgacagagactgagtgtctttgcccgtatgaagccttaattctcagaaagcccctttacctggatagcatagccaaggggatgaaaagtctgttaaattctacgaacttagagacaagcctgtcgattgaggccccatggggagcaatcaatgttcagtcaacttttaaaccaacagtttcagctgccaacatagcacttagctggagttcagttgaacacaggggcaacaaaatcctagtttcgggcaggtcagagtcaattatgaaactggaagaacggaccggcatcagctggagcctaggtgtagaggatgcttctgagtcaaagacgcttactgtttctgtcatggatctgtctcaaatgtattctcctgtctttgagtatctgtcaggtgatagacaagtagaagagtggccaaaggccacttgcacaggcgactgcccagagagatgtggctgcacctcctcaacctgcttgcataaagaatggccgcactcgagaaactggcgatgcaaccccacttggtgttggggagtagggactggctgcacctgctgcggactggatgttagagaccttttcacggactacatgatggtcaagtggaaagtggaatatgtaaaaacagaagctataatgtgtgttgagctaactagtcaggaaaggcagtgtagtttaattgaggcaggtacaaggtttaacctgggccctgtgacaataaccctgtcagagccaagaaatgtccagcaaaggctcccttccgaaatcgttacactgcaccctaagatagaggaaggattctttgatttgatgcatgtgcaaaaagtactattctgcaagcacagtttgcaagctacaagctgcacacacggtgtcccaggcgatttgcaggtctaccatgttggcaacctactgaaaggagacaaggttaatgggcactcaattcacaagatagagtctcatttcaacacttcatggatgtcatgggatggatgtgacctagactacttttgcaacatgggtgactggccttcatgtacatatactggagtgacacagcacaaccgtgcggcattcgtcaacatgctcaatattgagactgattacacaaagacttttcacttccattccaagagggttacggcacacggtgacacccctcaactggatctgaaggcaagaccaacatatggtgcaggcgaggtcactgttctagtggaggttgcagatctggagctacacactaagaaaatagaagtgtcagggttgaagtttgcaagtctgacctgctctggttgttatgcctgcagttccggcatctcctgcaaagttagaattcatgtgaatgaaccagatgagttcacagtacacgtgaaaagcaatgatccagacgttgtggcagcaggatcaagtctgatggcaaggaaaatagagttaggggctgacagcacctttaaagccttttcatcaatgcctaaaaactctttgtgcttttatatagtggaaagagactactgcagcagctgcaccgatgatgacactcagaagtgtgttaacacaaagctcgaacatccacaaagcatattaattgagcataagggaacaataattggtaagcaaaatgacacctgtccgaccaaaacaagctgctggctagaatcagtcaagagttttttttatggactgaaaaacatgctgggtggcatcttcggtaatgtcttcttaggcatcttcctattccttgctccttttgcactgctgatactcttcttcttcttcgggtggaggcttctgttctgtctgaagtgttgcagaaggaccaggggtctgctaaagtataaacaacttaaggatgaagaagaagccgggtacaagaaaatcatcgagaggctgaatgacaaaaagggcaaaagtcgactttttgacggagagaggctcgctgacaggaagattgctgaactcttttcaaccaaaactcatataggg

SEQ ID NO: 3786 - RNA, 3495 nt, synthetic construct
  misc_feature 1..3495: note = derived and/or modified CDS sequence (wt) from CCHVF(CCHVF Saf)__KX013487.1__Gn-NSm-Gc
  source 1..3495: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacattacttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacggctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcaccagttacacttgagtatctgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttctcagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgagactgattacatgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgtaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 3787 - RNA, 3495 nt, synthetic construct
  misc_feature 1..3495: note = derived and/or modified CDS sequence (wt) from CCHVF(CCHVF Ast199)__KX056051.1__Gn-NSm-Gc
  source 1..3495: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttacaccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgcgaaataatgatacctaaaggcactggagatatcctagtagactgttcaggtggacagcaacatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgatgcagctggctgattgtgctgcttgtgttactcacagtctcattgtcaccggttcaatcagcacctgttggtcatggtaagacaatcgaaacatatcagaccagagaaggattcacaaatatctgtctctttatgttaggaagcatcctattcatagtttcttgcctggtaaaggggctggttgacagtgtcagtgacagcttcttccccggcctatctgtctgtaagacatgctctattggcagtataaatggctttgaaattgaatcgcacaaatgctactgtagtttattttgctgcccctactgtaggcactgctctgctgacagagaaattcaccagctgcacttgggtatctgcaaaaaaagaaaaacggggagcaatgtcatgctggctgtctgcaagcgcatgtgctttaaggcaaccatagaagcaagcagaagagccctactcatccgaagcattatcaataccacttttgtaatatgcatcctaacattagcaatctgtgttgttagcacctctgcagtagagatggaaaatcttccagcaggcacttgggagagagaggaagacctgacaaatttctgccatcaggaatgccaggtaaccgagacggaatgcctctgtccatacgaagctcttgtgctcaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaaggaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgaggtatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttgtgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggtgcttttctttatatttggatggaaaatcttgttttgctttaagtgttgcaggaggaccagaggcttgtttaagtatagacacctcaaagatgatgaggaaacaggctacagaaagattattgaaagactgaacagcaaaaaaggaaaaaacagactgcttgatggtgagaggttggctgataggaaaattgctgagctgttctctacaaaaacacacattggc

SEQ ID NO: 3788 - RNA, 3495 nt, synthetic construct
  misc_feature 1..3495: note = derived and/or modified CDS sequence (wt) from CCHVF(CCHVF Ast149)__KX056054.1__Gn-NSm-Gc
  source 1..3495: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttattcgttgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgaagcagctggctgattgtgctacttgtgttactcacagtctcattgtcaccggttcaatcagcacctgttggtcatggtaagacaatcgaaacatatcagaccagagaaggattcacaaatatctgtctctttatgttaggaagcatcctattcatagtttcttgcctggtaaaggggctggttgacagtgtcagtgacagcttcttccccggcctatctgtctgtaagacatgctctattggcagtataaatggctttgaaattgaatcgcacaaatgctactgtagtttattttgctgcccctactgtaggcactgctctgctgacagagaaattcaccagctgcacttgggtatctgcaaaaaaagaaaaacggggagcaatgtcatgctggctgtctgcaagcgcatgtgctttaaggcaaccatagaagcaagcagaagagccctacccatccgaagcattatcaataccacttttgtaatatgcatactaacattagcaatctgtgttgttagcacctctgcagtagagatggaaaatcttccagcaggcacttgggagagagaggaagacctgacaaatttctgccatcaggaatgccaggtaaccgagacggaatgcctctgtccatacgaagctcttgtgctcaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaaggaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgaggtatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttgtgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggcgcttttctttatatttggatggaaaatcttgttttgctttaagtgttgcaggaggaccagaggcttgtttaagtatagacacctcaaagatgatgaggaaacaggctacagaaagattattgaaagactgaacagcaaaaaaggaaaaaacagactgcttgatggtgagaggttggctgataggaaaattgctgagctgttctctacaaaaacacacattggc

SEQ ID NO: 3789 - RNA, 3495 nt, synthetic construct
  misc_feature 1..3495: note = derived and/or modified CDS sequence (wt) from CCHVF(CCHVF Ast137)__KX056057.1__Gn-NSm-Gc
  source 1..3495: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtggatcagagactgggcagtgaactagggtgttataccatcaacagggtgaagtcattcaagctatgcgaaaacagtgccacagggaaaacctgtgagatagacagcactccggtcaagtgcaggcaagggttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaagatggccattcacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgaagcagctggctgattgtgctgcttgtgttactcacagtctcattgtcaccggttcaatcagcacctgttggtcatggtaagacaatcgaaacatatcagaccagagaaggattcacaaatatctgtctctttatgttaggaagcatcctattcatagtttcttacctggtaaaggggctggttgacagtgtcagtgacagcttcttccccggcctatctgtctgtaagacatgctctattggcagtataaatggctttgaaattgaatcgcacaaatgctactgtagtttattttgctgcccctactgtaggcactgctctgctgacagagaaattcaccagctgcacttgggtatctgcaaaaaaagaaaaacggggagcaatgtcatgctggctgtctgcaagcgcatgtgctttaaggcaaccatagaagcaagcagaagagccctactcatccgaagcattatcaataccacttttgtaatatgcatcctaacattagcaatctgtgttgttagcacctctgcagtagagatggaaaatcttccagcaggcacttgggagagagaggaagacctgacaaatttctgccatcaggaatgccaggtaaccgagacggaatgcctctgtccatacgaagctcttgtgctcaggaaacctcttttcttagacagtatagttaaaggtacgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaaggaacattcagcagaagcttccccctgagatcattacgctgcatcctaaaattgaagaaggcttctttgacttaatgcatgtgcaaaaagtgttatctgcaagtacagtgtgtaaactgcagagttgcacacatggtataccgggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagggtcacagcacatggagacacaccacaattagacttaaaagcaaggccgacctacggtgcaggtgagatcactgtgctggttgaggttgctgacatggagttgcataccaagaaagttgaggtatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttgtgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggtgcttttctttatatttggatggaaaatcttgttttgctttaagtgttgcaggaggaccagaggcttgtttaagtatagacacctcaaagatgatgaggaaacaggctacagaaagattattgaaagactgaacagcaaaaaaggaaaaaacagactgcttgatggtgagaggttggctgataggaaaattgctgagctgttctctacaaaaacacacattggc

SEQ ID NO: 3790 - RNA, 3495 nt, synthetic construct
  misc_feature 1..3495: note = derived and/or modified CDS sequence (wt) from CCHVF(CCHVF Ast133)__KX056060.1__Gn-NSm-Gc
  source 1..3495: mol_type = other RNA
tccgaagagccagatgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacttgtgagatagacagcactccggtcaagtgcagacaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttatttattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggtcatggtaagacaatcgaaacatatcagaccagagagggattcacaagtatctgtctctttatgttaggaagcatcctattcatagtttcttgcctggtaaaggggctggttgacagtgtcagtgacagcttcttccccggcctgtctgtctgtaagacatgctctattggcagtataaatggatttgaaattgaatcgcataaatgctactgtagtttattttgctgcccctactgtaggcactgctctgctgacagagaaattcaccagctgcacttgagtatctgcaaaaaaagaaaaacggggagcaatgtcatgctggctgtctgcaagcgcatgtgctttaaggcaaccatagaagcaagcagaagagccctgctcatccgaagcattatcaataccacttttgtaatgtgcattctaacattagcaatctgtgttgttagcacctctgcagtagagatggaagaccttccagcaggcacttgggagagagaggaagacctaacaaatttctgccatcaggaatgccaggtgaccgagacggaatgcctctgtccatacgaagctcttgtgctcaggaaacctcttttctcagacagtatagttaaaggtatgaaaaatttgctaaactcaacaagcttagaaacaagcttatcaattgaggcaccatggggagcaataaatgtccaatcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactattaccctgtctgagccaagaaacattcagcagaagcttccccctgagatcattacgctgcatcccaaaattgaagaaggcttctttgacttgatgcatgtgcaaaaagtgttatccgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaagaaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtagtttttttgtaggcattttgttattccttgccccttttgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaaggaaaaaacagactgcttgatggtgagaggttggctgataggaaaattgctgagctgttctcttcaaaaacacacattggc

SEQ ID NO: 3791 - RNA, 3495 nt, synthetic construct
  misc_feature 1..3495: note = derived and/or modified CDS sequence (wt) from CCHVF(CCHVF SK/2015/human)__KX458183.1__Gn-NSm-Gc
  source 1..3495: mol_type = other RNA
tctgaagaatctggtgatgactgcatatcaagaactcgcctattgagaacagagactgcagagatccatggtgatagctatggtggtccaggtgacaagattactatttgcaatggttcaactattgtagatcaaagactgggtagtgagatggggtgttacactatcaatagagtgaagtcattcaagctgtgcgaaaacagtgcaacagggaagagctgtgaaatagacagtatcccagttaggtgcaggcagggttattgcctaaaaatcactcaggagggaaggggccatgtgaaattatccaggggctcagaggttgtcttggatgcatgcgactcaagctgtgaagtaatgatacctaagggcacaggtgacatccttgtagactgttcaggtgggcagcaacattttttgaaggacaacttaattgatctaggatgtcccaatattccattattaggtaaaatggctatttatatttgcagaatgtcgaatcaccctaagacaaccatggcttttctcttttggttcagttttggctatgtgataacctgtatactctgcaaggctattttctacttattaataattgttggaacactagggaagaggtttaagcagtacagagagttaaaaccccagacctgcaccatatgtgagacaactcctgcaaatgcaatagatgctgaaatgcatgaccttaactgcagttacaccatatgcccctattgtgcatctagactaacctcagatgggcttgctaggcatgtgacacaatgccctaagcggaaggagaaagtagaagaaactgaattgtacctgaacttagagagaattccctgggttgtaagaaagctgttgcaggtatcggagtccactggtgttgcattaaaaagaagtagctggctgattgtgctgcttgtgttgttcacagtttcattatcaccagttcaatcagcacccatcggtcatgggaagacaattgagacataccaggccagggaggaatacacaggcatttgcctctttgtactaggaagtatcctgtttatagtctcttgtctagtgaaagggctggttgacggtgttggcaacatcttctttcctgggctgtccatttgcaaaacgtgctctataggtagtatcaatggctttgaaattgagtctcataagtgctattgtagcttgctttgttgcccctactgtaggcattgctctgcggatagagaaattcaccagctgcacttgagcatctgcaaaaaaagaaaaacaggaagtaatgtcatgcttgcagtctgcaagcgcatgtgcttcagagcaactatggaagtgagcaataaggccctacttatccgtagcattatcaacaccacttttgttgtgtgcatattgatactagcagtctgtgttgttagcacctcagcagtagagatggaaagcctaccggctgggacctgggaaagagaagaagacctaacaaatttctgtcatcaggaatgccaggttacggagactgagtgcctctgcccttatgaagccctagtactcagaaggcccttgttcctggatagtatagtaagaggcatgaaaaatctgctaaactcaacaagtttggagacaagcttatcgattgaggcaccatggggagcaataaatgttcagtcaacctacaagccaactgtgtcaactgcaaacatagcacttagttggagttcagttgaacacagaggtaataagattttggtttcaggcagatcagaatcaattatgaagctagaagaaaggacaggagtcagctgggaccttggcgtagaagatgcctctgaatctaagctacttacagtctctgtcatggacttatctcagatgtactctcctgtcttcgagtacttatcaggtgacagacaagtagaagagtggcccaaggcaacctgtacaggtgactgcccagaaagatgtggctgcacaacgtcaacctgcttgcataaagaatggcctcattcaagaaactggagatgtaatcccacttggtgctggggagtggggactggctgcacttgttgtggattagatgtgaaagacctttttactgattatatgttcgtcaagtggaaagttgaatacattaaaacagaggccatagtgtgtgtggaactcaccagtcaaggaaggcaatgcagcttgattgaggcgggcacaaggttcaatttaggttctgtgaccatcacattgtcggaaccgaggaacattcaacataagctccctcctgaaataatcacattgcatcctaggattgaagaaggtttctttgacctgatgcatgtacaaaaagtgttgtcagctagcacagtgtgtaagttgcagagttgcacacacggtgtgccaggtgatctacaggtctatcatatcggaaatttattaaaaggggataaagtgaatggacacctaattcataaaattgagccacacttcaacacttcctggatgtcctgggatggctgtgacttagactactactgcaacatgggagactggccttcttgtacatataccggagttacccaacacaatcatgcttcatttgtaaacctactcaacattgaaactgactatacaaaaaacttccactttcactctaaaagggttactgcgcatggagacacaccacaattagatctgaaagcaagaccaacttacggcgcaggagaaatcactgtactggtagaagttgctgacatggagttacacacgaagaaaattgaaatatcaggcctaaaatttgcaagcctgacttgcacaggctgttatgcttgtagttctggcatttcctgcaaagttaggattcatgtggatgaaccagatgaacttacagtacacgttaagagtgatgatccagatgtagtggcagctagctcaagtctcatggcaaggaagcttgagtttggaacagacagtacgtttaaagctttctcagccatgcccaaaacctccttatgtttctacattgtagaaagggagtactgtaagagctgcagtaaagaagacacacaaaaatgtgttaacacaaaacttgagcaaccacagagcatcttgatcgaacataggggaactataatcggaaagcagaacaatacctgcatagccaaagcaagttgctggttagagtcagttaaaagtttcttttatggtctaaagaacatgcttagtggcatttttggcaatctctttctgggcatcttcttatttcttgccccctttatcttgttaatactttttttcatgtttggatggaggatcctgttttgctttaagtgttgcagaagaaccaggggcctgttcaagtatagacatctcaaagacgatgaagaaactggttacagaaggatcattgaaagactgaacaacaagaaagggaagaacaagctgcttgatggtgaaagacttgccgatagaagaattgccgaactattctccacaaagacacacattggc

SEQ ID NO: 3792 - RNA, 3495 nt, synthetic construct
  misc_feature 1..3495: note = derived and/or modified CDS sequence (wt) from CCHVF(CCHVF YL16070)__KY354081.1__Gn-NSm-Gc
  source 1..3495: mol_type = other RNA
gcagaaggaggaagcagtgactgcatttcaagaactcagctagttaaaacagaggttgcagaaattcatgaggacagttacggtgggcctggtgagaaaataacaatctgcaatggttccacaattgtagatcaaaggcttggtagtgaattgggctgctatacaatcaacagagtaaaatcctacaagctatgcgagaacagtgcctcagggaaaagctgtgaaatagatagcatcccagtcaaatgcaaacaagggttttgcctcaaaataacccaagaaggaagaggtcatgtaaaactgtccagagggacagaaattgttctagatgtctgtgattccagctgtgagctgatgatacctaagggcactggagacattttagtggattgctcaggagggcaacagcattttttacaaaacaatctgattgacttgggatgccccaatgtcccattactgggtaaaatggccatatatgtctgcaggatgtcaaaccacccaaaaactaccatggcatttctgttctggttcagctttggctatgtcattacatgtatagtatgcagggtactcttctacttgctgattgccatcggaacagtagggaaaaagctaaaacagtatagagagctgaaaccacaaacatgcattgtttgtgaatctgtccctgttaatgcaatagatgctgaaatgcatgagcttaattgcagttacaacatatgcccatactgtgcttctagactgtctacagacgggctcatcaggcacgtaactcagtgtcccaaacggagggagaaggtggaagagactgagctattcttgaacttggaaagaataccttggctggtgagaaagctccttcaagtatcagagtcaacaggaatggctctaaagagaagctgttggatgatcacactcctcattctactattggtttcgatgtcaccagtccaatctgcaccggtaggcaaagaaagggcaatcgagacctatcaagcaagagaagcctacacaggcatatgcctctttgtgttaggaagtgttctttttgcggtatcctggctgacaaaggccttgattgatggcatcggcaacagcttcttccctggactttctgtctgcaagacatgctccattggtagtataaatggatttgaaatagagtctcataaatgctattgcagtctattctgttgtccttactgtagagcttgctcatccgacaaaaacactcaccggatgcacttaaatgtttgcaaaaaaaggaaaatgggtagcaatgtcatgctggctgtctgtaaacgtatgtgctttagagcaaccattgaggcaagcaataaggctttactgatcaggagcatcataaattccacttttgtgatttgcatattaatcctaacaatctgtgtggtaagcacctccgcagttgatatggaaaatttgcctgcaggcatctgggagaaagaagaagatcttacaaacttctgtcaccaggagtgtcaagtgacagaaactgaatgcctctgcccgtatgaggccatggtactcaggaagccactcttcctggatagcatagccaagggaatgaaaagcctgttgaactccacgagcttagaaactagtctgtcaattgaagctccgtggggagcaatcaatgttcagtcaactttcaaaccaacagtttcagctgctaacatagcacttagctggagttcagttgaacacaggggcaacaaaattttggtttcaggtagatcagagtcaatcatgaaattagaagaaagaacaggagtcagctggaacctgggtgtagaagatgcttctgagtcaaagacgcttactgtttccgtcatggacctgtcacaaatgtactctcctgtttttgagtacttgtcaggtgacagacaagtggaggaatggccaaaggcaacttgcacaggtgactgtccagagagatgcggctgcacttcatcaacctgcttacataaagagtggccacattcaagaaactggagatgtaatcctacttggtgttggggggtggggactggctgcacttgctgtgggctggatgtgaaggatttttttactgactacatgttggtaaaatggaaagtggaatatataaagacagaagctatagtgtgtgtcgagctaactagtcaagagaggcagtgtagtttaattgaagcaggcacaagatttaacctaggccctgtaacaataaccctatcagagccaagaaatgtccagcagaggcttcctcccgaaattgtaacactgcatcctaaaatagaggaaggtttttttgatttgatgcatgtacaaaaaatactgtctgcaagcacagtttgcaagctacagagctgcacacacggtgtgccgggcgattttcaggtctaccatgtcggtaacctgctgaggggagacaaggttaatggacactcaattcacaagatagaaccacattttaatacttcatggatgtcatgggatggttgcgatctggactatttctgcaatatgggggactggccttcatgcacatacactggagtaacacagcataaccgtgctgcatttatcaacatgctcaacattgagactgactatacaaaaactttccactttcattcgaagagggtcacggcacatggagatactccccagctagacctaaaagcgagaccggcatatggtgctggcgaagtcactgttctagtggaggttgcagacttggagttgcacacaaagaaacttgaagtgtcaggtttgaaaattgcaagtttgacctgctctgggtgttatgcatgcagctctggcatctcctgcaaagttagaatccatgtaaatgaaccagacgaattcacagtgcatgtaagaagtagcgacccagatgttgtagcagcaggatcaagtcttatggcaaggaaaatagagtttggggctgacagtacattcaaggccttttcatcaatgcccaaggactccttatgcttttacatagtagaaaaggattactgcagcagctgcaccgacgatgacacacaaaagtgtgtcaacacgaagcttgaccatccacagagcatactcattgagcacaaaggaacaataattggcaagcaaaatgacacttgttcgaccaaaacaagctgctggctaaaatcatttaagggtttcttctatgggctcaaaaacatgctgagtggcatctttggaaatgtttttttaggcatcctcttattccttgctccttttgtactactgatattttttttcttttttgggtggaggcttctgttttgtctcaaatgttgcaaaaaaactaaaggactgttgaaatataagcaccttaaggacaaggaggaggctggatacaaaaaaatcattgaaaggctaaatggcaaaaaaggtaaaagtcaattgtttgatggtgaaaggcttgcaaacaggaaaattgctgagcttttttctactaaaattcacataggt

SEQ ID NO: 3793 - RNA, 3495 nt, synthetic construct
  misc_feature 1..3495: note = derived and/or modified CDS sequence (wt) from CCHVF(CCHVF Oman_812956)__KY362518.1__Gn-NSm-Gc
  source 1..3495: mol_type = other RNA
tccgaagagtctggtgaagactgtatatcaaggactcagctgttgaggacagaaactgcagaaatccatggtgataactatggtggtccaggtgacaaaataaccatctgcaatggttcaaccattgtagatcaaaggctgggtagtgaactggggtgttacactatcaatagggtgaagtcatttaagctatgcgaaaacagtgccacaggtaagtcctgtgaaatagataacactccagtaaaatgcaagcaaggtttttgcttgaaaataacccaagaaggaaggggccacgtgaagctttcaagagactcagaagttgtcctggacgcctgcgattcaagctgtgaaataatgataccaaagggcactggagacatcctggttgactgctcaggtgggcagcagcacttcttaaaagacaacctgattgatctgggatgccccaacatcccattattaggcaaaatggcaatctacatttgtagaatgtcaaatcatcctaaaacaactatggcttttcttttttggtttagctttggttatgtgataacctgcatactttgtaaagtcattttttatctattgatagttgttggaactttagggaaaaagtttaaacagtatagagagttaaaacctcagacctgcacaatatgtgaaacaactcctgtcaatgcaatagatgctgagatgcacgatctcaattgtagttacaatatatgtccttattgtgcatctaggttaacttcagatggtcttgccagacatgtaatgcagtgtcctaagcggaaggaaaaaatagaagaaaccgaattatacctgaacttagaaagaatcccttgggttgtcagaaaactactgcaggtatcagaatccactggtgtagcactaaagaggagcagttggctgattgtgctacttgtgcttctcacagtttcattgtcaccagtacaatcagcacctatcggtcatgggaagaccatagaaacgtatcaaactagagaagggtacacaagtatttgtctttttgtgctaggaagcattttgtttatagtttctcacctaatgaaggggctggttgacagtgttggtaacagttttttccctgggttatctatctgcaagacatgctctattggcagtataaatggctttgaaattgaatctcacaaatgttactgtagcctattttgttgcccctactgtagacactgctctgccgataaagaaatccataagttgcatttgagcatctgcaaaaaaagaaaagctgggagtaatgtcatgttggccgtctgtaagcgcatgtgttttagggcaactatggaagtgagcaacaaggctctactcatccgaagtgtcatcaacactacttttgttgtatgcatactaatattagcagtttgtgttgttagcacctccgcagtagagatggaaagcctgccagctggcacttgggagagagaggaagacctaacaaacttctgccatcaagaatgccaggtcactgaaactgaatgtctctgtccctatgaagctcttgtactcagaaagcccttattttttgacagtattgctaagggtatgaagaacctgctgaattcaacaagcttagaaacaagcttatcaattgaggcaccatggggagcaataaacgtccaatctactttcaaacctactgtgtcaactgcaaacatagcacttagttggagctcagtggaacacagaggtaataagatcttggtttcaggcagatcagagtcaatcatgaagctagaagaaagaacaggaatcagctgggatttgggagtagaagatgcctctgagtccaaattacttactgtttccgtcatggacttatcacagatgtactctcctgtctttgagtacctatcaggtgacagacaagtagaggaatggccaaaggcaacctgtacaggcgattgcccggaaagatgtggctgcacatcatcaacctgcctacacaaggaatggcctcactcaagaaactggagatgcaaccccacttggtgttggggagtcggcaccggatgcacctgttgtggactagatgtaaaggacctttttacagattacatgtttgttaaatggaaggtcgaatatataaaaacagaggctatagtgtgtgttgagcttactagccaagaaagacaatgtagcttgattgaggcaggcacaagattcaacttaggtcctgtgactatcacattatcagagccaagaaacattcagcaaaagctccctccagaaattgtcacattacatcctagaattgaagaaggtttttttgacttaatgcatgtacagaaggtactatcagcaagcacagtgtgcaagctacagagttgcacacatggcgtaccaggagacttacaggtctaccacatcggaaacttactaaaaggagacaaagtgaatgggcatctgatacataaagttgaaccacatttcaacacctcctggatgtcttgggacggctgtgacctagattactactgcaatatgggggattggccctcttgcacgtatactggagttacccaacataatcatgctgcatttgtaaacctacttaacattgaaactgattacacaaagaacttccactttcactctaagagagtcactgcacatggggacactccacaattagatttaaaagccagaccaaattatggtgcaggtgaaatcactgtgctggtggaagttgctgacatggagttacacacaaagaaaattgagatatcaggtttgaagtttgcaagcctaacctgcacaggttgttatgcttgtagctctggcatctcatgtaaggttaggatccatgtagatgaaccagatgagcttacagtacatgtgaagagtgaagacccagacatagttgctgctagctcaagtctcatggcaagaaagcttgaattcgggacggatagtacattcaaagccttctcagccatgcctaaaacctccttgtgcttttacattgttgagagagaatactgtaaaagctgcagtaaagaagacacacaaaagtgtgttaacgcaaagcttgagcgaccacagagcattttaattgagcacaaaggaacgataattggaaagcagaacgacacttgcacagctaaagcaagctgctggctagagtcagtcaagagtttcttttatggactaaagaacatgcttagtggcatttttggcaatgttttcatagggattttcttattccttgctccttttatcctgttaatacttttctttatgtttgggtggagaatcctattctgctttaagtgctgcaggagaactagaggcctatttaagtacagacacctcaaagatgatgaagaaaccggttataggaaaatcattgagagactaaacaacaaaaaaggtaaaaacaagctgcttgacggtgaaagattagctgatagaaagatcgctgagctgttctctacaaaaacacacattggc

SEQ ID NO: 3794 - RNA, 3495 nt, synthetic construct
  misc_feature 1..3495: note = derived and/or modified CDS sequence (wt) from CCHVF(CCHVF UCCR4405)__KY484029.1__Gn-NSm-Gc
  source 1..3495: mol_type = other RNA
tctgaagagccaggtgacgactgcatatcaagaactcagctattgaagacagaaacagcagagatccatgacgacaactatggtggtccaggtgacaaaataactatctgcaatggttcaaccattgtggatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaagtaatgatacctaaaggcactggagatatcctagtagactgttcaggtggacagcagcatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttactcattgataattattgggacactagggaaaaaaatcaagcaatatagggagctgaaacctcaaacttgcaccatatgtgagacagctcctgtcaatgcaatagatgctgaaatgcatgacctcaaatgtagttacaatatatgcccttattgtgcatcaagattgacctctgatgggctagctaggcatgtgacacaatgccctaagcgaaaggagaaagttgaggagactgaactgtacttgaacctggaaagaattccttggatagtcagaaagctattgcaagtgtcagagtccactggtgtagcattgaaacgaagcagttggctgattgtgctgcttgtgttactcacagtctcattgtcaccggttcaatcagcacctgttggtcatggtaagacaattgaaacatatcagaccagagaaggattcacaagtatctgtctctttatgttaggaagcatcctattcatagtctcttgcctagtaaaggggctggttgacagtgtcagtgacagcttcttccccggcctgtctgtctgtaagacatgctctattggcagtataaatggctttgaaattgaatcgcataaatgctactgtagtttattttgctgcccctactgtaggcactactctgctgacagagaaattcaccagttgcacttgagtatctgcaaaaaaaggaaaacggggagcaatgtcatgctggctgtctgcaaacgcatgtgctttaaggcaactatagaagcaagcagaagagccctgctcatccgaagtattatcaacaccacttttgtaatatgtattctaatattagcaatctgtgttgttagcacctctgcagtagagatggaaaaccttccagcaggcacttgggagagagaggaagacctgacaaatttctgccaccaggaatgccaggtgaccgagacggaatgcctctgtccatacgaagctcttgtgctcaggaaacctcttttcttagacagtacagttaaaggtatgaaaaatttgctaaactcaacaagcttggaaacaagcttatcaattgaggcaccatggggagcaataaatgtccagtcaacctttaaaccaacagtatcgactgcaaacatagcactcagttggagctcagtggagcacagaggcaacaagatcttggtcacaggcaggtctgaatcaattatgaaactagaggaaaggacaggagtcagctgggatctaggcgtagaagatgcctctgaatccaaattacttaccgtctccatcatggatttgtcacaaatgtattcccctgtttttgagtacttatcaggagatagacaggttgaagaatggcccaaggcaacctgtacaggtgattgcccagaaaggtgtggctgcacatcatcaacctgcttgcataaagaatggcctcactcaagaaactggagatgtaaccccacttggtgctggggagtaggaaccggctgcacatgctgcggagtggatgtaaaagacctttttacagatcacatgtttgtcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtacaaaaagtgttatctgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactattgcaacatggggaattggccttcttgcacatacacaggagtgacccaacataatcatgctgcatttgtaaatttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctggtttgcacgggttgctatgcttgtagctctggcatttcctgtaaagtcagaattcatgtagatgaaccagatgagctcacagtgcatgtaaagagcagtgatccagatgtggttgcagctagcacaagccttatggcaaggaagcttgaatttgggacagatagcatattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggtgcttttctttatgtttggatggaaaatcttgttttgctttaagtgttgcaggaggaccagaggcttgtttaagtatagacacctcaaagacgatgaggaaacaggctacagaaggattattgaaagactgaatagtaaaaaaggaaaaaacagactgcttgatggtgagaggttggctgataggaaaattgctgagctgttctccacaaaaacacacattggc

SEQ ID NO: 3795 - RNA, 3495 nt, synthetic construct
  misc_feature 1..3495: note = derived and/or modified CDS sequence (wt) from CCHVF(CCHVF UCCR4459)__KY484032.1__Gn-NSm-Gc
  source 1..3495: mol_type = other RNA
tccgaagagtctggtgatgactgcatatcaagaactcagctatcgaggacagagactgcggaaattcacagtgataactatggtggtccaggtgacaagataaccatctgcaatggttcaactattgtagatcagagattgggcagtgaactagggtgttacactatcaatagagtaaagtcatttaagctttgcgagaacagtgccacaggtaaatcctgtgaaatagatagcaccccaattaaatgcaggcagggtttttgtttaaaaattactcaggagggaaggggccacgtgaagctatcaagaggttcagaagttgtcttggacgcctgtgattcaagctgtgagataatgataccaaagggcactggagacatcctagttgactgttcaggtggacagcaacatttcttaaaagataacttgattgatctgggatgcccaaacatcccactattaggtaagatggctatctacatttgtagaatgtcaaatcatcctaaaacgactatggcttttcttttttggtttagctttggttatgtgataacctgtatactctgtaaggtcatcttctacctattaatagttgtggggacgttgggaaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagacggtcttgccagacatgtaatgcagtgccctaagcggaaggaaaaagtagaagaaaccgaattatacttaaacttagaaagaatcccctgggttgttaggaaattactgcaggtgtcagaatccaccggtgtggcactaaagaggagtagttggctggttgtgctacttgtgttacttacagtttcattgtcaccagtacaatcagcacctatcggccatggaaagacagttgaaacatatcaaaccagagaagggtacacaagcatttgcctttttgtactaggaagcatcttatttatagtctcttgcctaatgaaggggttggttgacagtgttggtaacagttttttccctggtttgtccatttgtaagacatgttctattggcagcataaatggctttgagattgaatctcacaaatgttactgtagcctattttgttgcccctactgtagacactgctctgccgatagagaaatacataagttgcacttgagcatctgcaagaaaaggaagactgggagtaatgtcatgttggccgtctgtaagcgcatgtgctttagggcaactgtggaagtaagcaacaaggctctacttatccgaaacatcatcaataccacttttgttgtgtgcatactgatattagcagtttgtgttgtcagcacctccgcagtggagatggaaagcctgccagctggcacttgggagagagaggaagatctgacaaatttctgtcatcaagaatgccaagtcactgagactgaatgcctctgtccttacgaagctcttgtgctcaggaaacccttgttttcagacagtattgtcaaaggcatgaagaacttgctaaattcaacaagcttagaaacaagcttatcaattgaggcaccatggggagctataaatgtccaatcaaccttcaaacctactgtgtccgctgcgaacatagctcttagttggagctcagtggaacacaggggtaataagattttggtttcaggtagatcagagtcaattatgaagctagaggaaaggacaggaatcagctgggatctaggggtagaagatgcctctgagtctaaattgcttactgtctctattatggacttgtcacagatgtattctcctgtctttgagtacctatcaggtgatagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttgtcaagtggaaagttgagtacattaaaacagaagctatagtgtgtgttgagcttactagccaagagagacaatgtagcttgattgaggcaggcacaagattcaacttaggtcctgtgaccatcacattgtcagagccaagaaacattcagcaaaagctccctccagagatagttacattgcatcccagaattgaagaaggtttctttgatttaatgcatgtaaaaaaagtgctatcagcaagtacagtatgtaagctacagagttgcacacatggtgtgccaggggacctacaggtctaccacataggaaacttgttaaaaggagacaaggtgaatgggcacctgattcacaaaattgaaccacacttcaacacttcctggatgtcttgggacggctgtgacctagactactactgtaatatgggagactggccatcttgctcatatactggagtaacccagcacaatcatgctgcatttgtaaacatgctcaacatcgaaactgattatacaaaaatcttccactttcactctaagagagttactgcacatggagacacaccacaattagatttgaaagctagaccaacttatggtgcaggtgaaatcactgtgctagtggaagttgctgacatggagttacacacaaagaaaattgagatatcaggtttaaagtttgcaagcttaacttgcacaggctgttatgcttgtagctctggtatctcctgtaaggttagaatccatgtagatgagcctgatgagcttacagtacatgtgaagagtgaagacccagacatagttgctgctagctcaagtctcatggctagaaaacttgaatttgggacagatagcacattcaaagccttttcagccatgcccaaaacctccttgtgcttttacattgtggagagagaatattgtaaaagctgcagtaaagaagatacacaaaaatgtgtcaacacaaagcttgagcaaccacagagcattttaattgagcacaaaggaacgataattggtaagcaaaacgacacctgcacatctaaagcaggctgttggctagagtcagtcaagagcttcttttatgggctaaaaaacatgcttagtggcatttttggcaatgttttcatagggattttcttattccttgctccttttatccttttaatacttttctttatgtttggatggagaatcctgttctgctttaaatgttgcagaagaactagaggcttatttaagtacagacacctcaaggacgatgaagaaaccggttacaggaaaatcattgagaggctgaacaacaaaaaagggaaaaacaaactgcttgatggtgaaagattagctgataggaagattgctgagctgttctccacaaagacacacattggc

SEQ ID NO: 3796 - RNA, 3495 nt, synthetic construct
  misc_feature 1..3495: note = derived and/or modified CDS sequence (wt) from CCHVF(CCHVF UCCR4401)__KY484035.1__Gn-NSm-Gc
  source 1..3495: mol_type = other RNA
tcagaagaacccagtgatgactgtatatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggccattttttacttgttaataattgttggaacactagggaaaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaacaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctggcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatagaagaattgccgaactgttctctacaaaaacacacattggc

SEQ ID NO: 3797 - RNA, 3495 nt, synthetic construct
  misc_feature 1..3495: note = derived and/or modified CDS sequence (wt) from CCHVF(CCHVF UCCR4448)__KY484042.1__Gn-NSm-Gc
  source 1..3495: mol_type = other RNA
tccgaagaaaccagtgatgactgcatatcaagaactcaactattgaggacagagactgcagagatccacggcgacaactatggtggcccgggtgacaaaataaccatctgcaacggctcaactattgtagaccaaagactaggcagtgagctagggtgttacactatcaacagagtgaagtcattcaagctatgcgaaaatagtgccacagggaagagctgtgaaatagacagtgtcccagttaaatgcaggcagggttattgcctaagaatcactcaggaagggaggggccatgtaaaattatctaggggctcagaggttgtcttagatgcatgtgatacaagctgtgaaataatgatacctaagggcactggtgacatcttggttgactgttcaggtgggcagcaacattttctaaaggacaatttgatagatctaggatgccccaaaattccattattgggcaaaatggctatttacatttgcagaatgtcgaatcaccccaaaacaaccatggctttcctcttctggttcagctttggctacgtgataacttgtatactttgcaaggccatcttctacttgttaataattattggaacactagggaaaaggttcaagcagtatagagagttaaaaccccagacctgcaccatatgtgagacaactcctgtaaatgcaatagatgctgagatgcacgacctcaattgcagttacaacatttgtccctactgtgcatctagactaacctcagatgggcttgctaggcatgtaacacaatgccctaagcggaaggagaaagtggaagaaactgaactgtacttgaacttagaaagaattccttgggttgtaagaaagctgttgcaggtatcagagtccactggtgtggcattgaaaagaagcagctggctgattgtgctgcttgtgctgttcacgatttcattgtcaccagttcaatcagcacccattagtcacgggaagacaattgaggcataccgggccagggagggatacacaagtatatgtctctttgtactaggaagtatcctattcatagtctcttacctaatgaaagggctggttgacagtgttggcaactccttcttccctggactgtccatttgcaagacgtgctccacaagcagcattaatggctttgaaattgagtcccataagtgctattgcagcttattctgttgcccttattgtaggcactgctctgctgataaagaaattcataagctgcacctgagcatctgcaaaaaaagaaaaacaggaagcaatgtcatgttggctgtctgcaagcgcatgtgtttcagggccaccatggaagtaagtaacagagccctgtttatccgtagcatcatcaacaccacttttgttttgtgtatactgatactagcagtttgtgttgttagcacctcagcagtggagatggaaaacctaccagccgggacctgggaaagagaagaagacctaacaaatttctgtcatcaggaatgtcaggttacagagactgaatgcctctgcccttatgaagctctagtactcagaaagcctctattcctagatagtatagttaaaggcatgaaaaatctgctaaactcaacaagtttagaaacaagtttatcaattgaggcaccatggggggcaataaatgttcagtcaacctacaaaccaactgtgtcaactgcaaacatagcactcagttggagctctgtggaacacagaggtaataagatcttggtttcaggcagatcagaatcaattatgaagctggaagaaaagacaggaatcagctgggatctcggcgtagaagacgcctctgagtctaaactgcttacagtctctgtcatggacttgtctcagatgtactctcctgtcttcgagtacttatcaggagacagacaggtggaagagtggcccaaagcaacttgtacaggtgactgcccagaaagatgcggctgcacatcatcaacgtgtttgcacaaagaatggccccactcaagaaattggagatgcaatcccacttggtgctggggtgtagggactggctgcacctgttgtggattagatgtgaaagacctttttacagattatatgtttgtcaagtggaaagttgaatatattaagacagaggccatagtgtgtgtagaacttaccagtcaggaaaggcagtgtagcttgattgaagcgggcacaaggttcaatttaggtcctgtgaccatcacactgtcagaaccaagaaacatccaacagaagctccctcctgaaataatcacactgcatcccaggatcgaagaaggtttttttgacctgatgcatgtacaaaaagtgttatcggcaagcacagtatgtaagttgcagagttgcacacatggtgtaccaggagacctacaggtctaccacatcggaaatttattgaaaggggataaggtaaatggacatctaattcataaaattgagccacacttcaacacttcctggatgtcctgggatggttgtgacctggactactactgcaacatgggagattggccttcttgcacatatacaggagtcacccaacacaatcatgcttcatttgtaaacctgctcaacattgaaactgattacacaaaaaacttccactttcactctaaaagggtcactgcacatggagacacaccacaactagatcttaaggcaagaccaacctatggtgcaggtgagatcactgtactggtagaagttgctgacatggaattacacacaaagaagattgaaatatcaggcttaaaatttgcaagcttgacttgcacaggttgttatgcttgtagctctggcatctcatgcaaagttagaattcatgtggatgaaccagatgaacttacagtacatgttaaaagtgatgatccagatgtagttgcagctagctcaagtctcatggcaagaaagcttgaatttggaacagacagtacatttaaagctttctcagccatgcctaaaacttctctatgtttctacattgttgaaagagaacactgtaagagctgcagcgaagaagacacaaaaaaatgtgttaacacaaaacttgagcaaccacaaagcattttgatcgaacacaagggaactataatcggaaagcaaaacagcacttgcacagccaaggcgagttgctggttagagtcagtcaaaagtttcttttatggtctaaagaacatgcttagtggtatttttggcaatgtttttataggtattttcttgttccttgcccccttcatcctattaatactattctttatgtttgggtggaagatcctattttgctttaaatgttgtagaagaactagaggcctattcaagtatagacacctcaaggacgatgaagaaactggttatagaaggattattgaaagactaaacaataaaaaaggaaaaaacaaactgcttgatggtgaaatacttgctgatagaagaattgccgaactgttctctacaaaaacacacattggc

SEQ ID NO: 3798 - RNA, 3495 nt, synthetic construct
  misc_feature 1..3495: note = derived and/or modified CDS sequence (wt) from CCHVF(CCHVF SPU4/81 )__DQ157175.1__Gn-NSm-Gc
  source 1..3495: mol_type = other RNA
tccgaagaacccagtgatgactgcatatcaagaactcaactattgaggacagagactgcagagatccacggcgacaactatggtggcccgggtgacaaaataaccatctgcaacggctcaactattgtagaccaaagactaggcagtgagctagggtgttacactatcaacagagtgaagtcattcaagctatgcgaaaatagtgccacagggaagagctgtgaaatagaaagtgtcccagttaaatgcaggcagggttattgcctgagaatcactcaggaagggaggggccatgtaaaattatctaggggctcagaggttgtcttagatgcatgtgatacaagctgtgaaataatgatacctaagggcactggtgacatcttggttgactgttcaggtgggcagcaacattttctaaaggacaatttgatagatctaggatgccccaaaattccattattgggcaaaatggctatttacatttgcagaatgtcgaatcaccccaaaacaaccatggctttcctcttctggttcagctttggctacgtaataacttgtatactttgcaaggccatcttctacttgttaataattattggaacactagggaaaaggttcaagcagtatagagagttaaaacctcagacctgcaccatatgtgagacaactcctgtaaatgcaatagatgctgagatgcacgacctcaattgcagttacaacatttgtccctactgtgcatctagactaacctcagatgggcttgctaggcatgtgacacaatgccctaagcggaaggagaaagtggaagaaactgaactgtacttgaacttagaaagaattccttgggttgtaagaaagctgttgcaggtatcagagtccactggtgtggcattgaaaagaagcagctggctgattgtgctgcttgtgctgttcacggtttcattgtcaccagttcaatcagcacccattggtcacgggaagacaattgaggcataccgggccagggagggatacacaagtatatgtctctttgtactaggaagtatcctattcatagtctcttgcctaatgaaagggctggttgacagtgttggcaactccttcttccctggactgtccatttgcaagacgtgctccataagcagcattaatggctttgaaattgagtcccataagtgctattgcagcttattctgttgcccctattgtaggcactgctctgctgataaagaaattcataagctgcacttgagcatctgcaaaaaaagaaaaacaggaagtaatgtcatgttggctgtctgcaagcgcatgtgtttcagggccaccatggaagtaagtaacagagccctgtttatccgtagcatcatcaacaccacttttgttttgtgtatactgatactagcagtttgtgttgttagcacgtcagcagtggagatggaaaacctaccagccgggacctgggaaagagaagaagacctaacaaatttctgtcatcaggaatgtcaggttacagagactgaatgcctctgcccttatgaagctctagtactcagaaagcctctattcctagatagtatagttaaaggcatgaaaaatctgctaaactcaacaagtttagaaacaagtttatcaattgaggcaccatggggggcaataaatgttcagtcaacctacaaaccaactgtgtcaactgcaaacatagcactcagttggagctctgtggaacacagaggcaataagatcttggtttcaggcagatcagaatcaattatgaagctggaagaaaggacaggaatcagctgggatctcggcgtagaagacgcctctgagtctaaactgcttacagtctctgtcatggacttgtctcagatgtactctcctgtcttcgagtacttatcaggagacagacaggtggaagagtggcccaaagcaacttgtacaggtgactgcccagaaagatgcggctgcacatcatcaacgtgtttgcacaaagaatggccccattcaagaaattggagatgcaatcccacttggtgctggggtgtagggactggctgcacctgttgtggattagatgtgaaagacctttttacagattatatgtttgtcaagtggaaagttgaatatattaagacagaggccatagtgtgtgtagaacttaccagtcaggaaaggcagtgtagcttgattgaagcgggcacaaggttcaatttaggtcctgtgaccatcacactgtcagaaccaagaaacatccaacagaagctccctcctgaaataatcacactgcatcccaggatcgaagaaggtttttttgacttgatgcatgtacagaaagtgttatcggcaagcacagtatgtaagttgcagagttgcacacatggtgtaccaggagacctacaggtctaccacatcggaaatttattgaaaggggataaggtaaatggacatctaattcataaaattgagccacacttcaacacttcctggatgtcctgggatggttgtgacctggactactactgcaacatgggagattggccttcttgcacatacacaggagtcacccaacacaatcatgcttcatttgtaaacctgctcaacattgagactgattacacaaaaaacttccactttcactctaaaagggtcactgcacacggagacacaccacaactagatcttaaggcaagaccaacctatggtgcaggtgagatcactgtactggtagaagttgctgacatggagttacacacaaagaagattgaaatatcaggcttaaaatttgcaagcttgacttgcacaggttgttatgcttgtagctctggcatctcatgcaaagttagaattcatgtggatgaaccagatgaacttacagtacatgttaaaagtgatgatccagatgtagttgcagctagctcaagtctcatggcaagaaagcttgaatttggaacagacagtacatttaaagctttctcagccatgcctaaaacttctctatgtttctacattgttgaaagagaacactgtaagagctgcagcgaagaagacacaaaaaaatgcgtcaacacaaaacttgagcaaccacaaagcattttgatcgaacacaagggaactataatcggaaagcaaaacagcacttgcacagccaaggcgagttgctggttagagtcagtcaaaagttttttttatggtctaaagaacatgcttagtggtatttttggcaatgtttttataggtattttcttgttccttggccccttcatcttgttaatactattctttatgtttgggtggaggatcctattttgctttaaatgttgtagaagaactagaggcctgctcaagtatagacacctcaaggaagatgaagaaactggttatagaaggattattgaaagactaaacaataaaaaaggaaaaaacaaactgcttgatggtgaaagacttgctgatagaagaattgccgaactgttctctacaaaaacacacattggc

SEQ ID NO: 3799 - RNA, 3495 nt, synthetic construct
  misc_feature 1..3495: note = derived and/or modified CDS sequence (wt) from CCHVF(CCHVF Sudan Al-Fulah 9-2008)__HQ378185.1__Gn-NSm-Gc
  source 1..3495: mol_type = other RNA
tccgaagaacccagtgatgactgcatatcaagaactcaactattgaggacagagactgcagaaatccacggcgacaactatggtggcccgggtgacaaaataaccatctgcaacggctcaactattgtagaccaaagactgggcagtgagttagggtgttacactatcaatagagtgaagtcattcaagctatgtgaaaatagtgccactgggaagagctgtgtgatagacagtgtcccagttaaatgcaggcagggttattgcctaaggattactcaagaaggaaggggccatgtaaaattatctaggggctcagaggttgtcttagatgcatgcgatacaagctgtgaaataatgatacctaagggcaccggtgacatcctagttgactgttcaggtgggcagcaacattttctaaaggacaatttggtagatctaggatgccccaaaatcccattactgggcaaaatggctatctacatttgcagaatgtcgaatcaccccaaaacaaccatggctttcctcttctggttcagctttggctatgtaataacttgtatactttgcaaggccatcttttacttgttaataattattggaacactagggaaaaggttcaggcagtatagagagttaaagcctcagacctgcaccatatgtgagacaactcctgtaaatgcaatagatgctgagatgcatgacctcaattgcagttacaacatttgtccctactgtgcatctagactaacctcggatgggcttgctaggcatgtgacacagtgccctaagcggaaggagaaagtggaagaaactgaactgtacttgaacttagaaagaattccttgggttgtgagaaagctgttgcaggtatcagagtccaccggtgtggcattgaaaagaagcagctggctgattgtgctgcttgtgctgttcacggtttcattgtcgccagttcaatcagcacccattggtcacgggaagacgattgaggcataccgtgccagggagggatacacaagtatatgtctctttgtactaggaagtatcctatttatagtctcttgcctaatgaaagggttggttgacagtgttggcaactccttcttccctggactgtccatttgcaaaacgtgctccataagcagcattaatggctttgaaattgagtcccataagtgctattgcagcttgttctgttgcccctattgtaggcactgctctgctgataaagaaattcacaagctgcacttgagcatctgcaaaaaaaggaaaacaggaagtaatgtcatgttggctgtttgcaagcgcatgtgtttcagggccaccatggaagtaagtaacagagccctgtttattcgtagcatcatcaataccacttttgttttgtgcatactgatactagcagtttgtgttgttagcacctcagcagtggagatggaaaacctaccagccgggacttgggaaagagaagaagacctaacaaatttctgtcatcaggaatgccaagttacagagactgaatgcctctgcccttatgaagctctagtactcagaaggcctctattcctagacagtatagttaaaggcatgaaaaatctgctaaactcaacaagtttagaaacaagtctgtcaattgaggcaccatggggggcaataaatgttcagtcaacctacaagccaactgtgtcgactgcaaatatagcactcagctggagctcagtggaacacagaggcaataagatcttggtttcaggcagatcagaatcaattatgaagctggaagaaaggacagggatcagctgggatctcggcgtagaagacgcctctgagtctaaactgcttacagtctctgttatggatttgtctcagatgtactctcctgtcttcgagtacttatcaggagacagacaggtggaggagtggcccaaagcaacttgcacaggtgactgcccagaaagatgtggctgcacatcatcaacatgtctgcacaaagaatggccccactcaagaaattggagatgcaatcccacttggtgctggggtgtagggactggctgcacctgctgtggattagatgtgaaagacctttttacagattatatgtttgtcaagtggaaagttgaatacatcaagacagaggccatagtgtgtgtagaactcaccagtcaggaaaggcagtgtagcttgattgaagcaggcacaaggttcaatttaggtcctgtgaccatcacactgtcagaaccaagaaacatccaacagaagctccctcctgaaataatcacactacatcctaggattgaagaaggtttttttgacctgatgcacgttcagaaagtgttatcagcaagcacagtgtgtaagttgcagagttgcacacatggtgtaccaggagacctacaggtctaccacatcggaaatttattaaaaggggacaaggtaaatggacatctaattcataaaattgagccacacttcaacacttcctggatgtcctgggatggttgtgacctagactactactgcaacatgggagattggccttcttgcacatacacaggagtcacccaacacaatcatgcttcatttgtaaacctgctcaacattgaaactgattacacaaaaaacttccactttcactctaaaagggtcactgcacacggagacacaccacaactggatcttaaggcaagaccaacctatggtgcaggtgagattactgtactggtagaagttgctgacatggagttacacacaaagaagattgaaatatcaggcttaaaatttgcaagcttgacttgcacaggttgttatgcctgtagctctggcatctcatgcaaagttagaattcatgtagacgaaccagatgaacttacagtgcatgttaaaagtgatgatccagatgtagttgcagctagctcaagcctcatggcaagaaagcttgaatttggaacagacagtacatttaaagctttttcagccatgcctaaaacttcgctatgtttctacattgttgaaaaagaatactgcaagagctgcagtgaagaagacacaaaaaaatgtgttaacacaaaacttgagcaaccacagagcattttgatcgaacacaagggaactataatcggaaagcaaaacagcacttgcacagccaaggtgagttgctggttagagtcagccaagagttttttttatggtctaaaggacatgcttagtggcatttttggcaatgtctttataggtattttcttattccttgcccccttcgtcctgttagtgctgttctttatgtttgggtggaggatcctactttgctttagatgttgtagaagaactagaggcctgttcaagtatagacacctcaaggacgatgaagaaactggttatagaaggattattgaaagactaaacaataaaaagggaaaaaacaaactgcttgatggtgaaagacttgctgatagaaaaattgctgaactgttctccacaaaaacacacattggt

SEQ ID NO: 3800 - RNA, 3495 nt, synthetic construct
  misc_feature 1..3495: note = derived and/or modified CDS sequence (wt) from CCHVF(CCHVF NIV161064)__KY213713.1__Gn-NSm-Gc
  source 1..3495: mol_type = other RNA
tccgaagaatctggtgatgactgcatatcaagaactcagctattgaggacagagactgcagaggtccatggcgataactatggtggtccaggtgataagataaccatctgtaatggttcaactgttgtagatcaaagactgggtagtgaactggggtgttacactatcaatagagtgaggtcattcaagctatgcgaaaacagtgccacagggaagagctgtgaaatagacagtatcccagtcaagtgtaagcagggttattgcctaaaaatcactcaggaaggaaggggccatgtgaagttatctagaggctcagaagttgtcttggatgtatgtgattcaagctgtgaagtgatgatacctaagggcactggtgacattctagtagattgttcaggtgggcagcaacattttttaaaagacaacctggttgacctagggtgtcccaaaattccgttactgggcaaaatggctatttatatctgcaggatgtcgaatcaccccaagacaaccatggccttcctcttttggttcagctttggctatgtgataacttgtatactttgcaaggccatttttttcttattaataatttttggaacactagggaaaaggttcaagcagtacagagagttaaaaccccagacctgcaccatatgtgagacaacacctgtaaatgcaatagatgctgaaatgcatgatctcaactgcagttacaatatatgtccctattgtgcgtctagactgacttcagatgggcttgctaggcatgtgacacaatgtcctagacggaaggagaaagtggaggaaaccgaattatacctgaatttagagagaattccctgggttgtaagaaagctattgcaggtgtcagagtccactggtacagtattaaaaaggagcagctggctaattgtattacttgtgctgttcacagtttcattgtcaccagttcaatcagcacccattggtcacgggaaaacaattgaaacataccgggttagggaagaatacacaagtatttgcctctttgtactaggaagtatcctgtttatagtctcttttctaatgaaaggactggttgacggtgttggcaacatcttctttcctgggctgtccgtctgtaagacatgctctataggtagcattaatggctttgagattgagtcccataagtgctactgtagcttgttttgttgcccttactgtaggcactgctctgctgatggagaaatccatcagctgcacttgagcatctgcaaaaaaaggaagacaggaagtaatgtcatgctggctgtttgcaaacgcatgtgtttcagggcaactatggaagtaagcaacaaggccctatttatccgtagcattatcaacaccacttttgttgtgtgcatactgatactagcggtttgtgttgttagcacctcagcagtagagatggaaagcctaccagctgggacctgggaaagagaagaagacctaacaaatttctgccatcaggaatgccaggtcacagagactgagtgcctctgcccttatgaagctttagtgctcagaaggcccctatttctagatagtatagtcaaaggtatgaaaaatctgctaaactcaacaagtctagaaacaagcttatcaattgaggcaccatggggagcaattaatgttcagtcaacctacaaaccaactgtatcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagtcatggacttgtctcagatgtactctcctgtcttcgagtacttatcaggtgacagacaagtggaagagtggcctaaagcaacctgcacaggtgactgcccagaaagatgtggctgcacatcatcaacctgcttacacaaagagtggccccactcaaggaattggagatgtaatcctacttggtgttggggtgtagggactggctgcacctgttgtggtttagatgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagaaccaaggaacattcaacaaaagctccctcctgaaataatcacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacctgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacagctagatctgaaggcaaggccaacctatggtgcaggtgaggtcaccgtgctggtggaagttgctgacatggagttacacacaaagaagattgaaatatcaggcttaaaatttgcaggcctaacttgcacaggttgttatgcttgtagttctggcatctcttgtaaagttagaattcatgtagatgaaccagatgaacttacagtacatgttaaaagtgatgacccagatgtagttgcagctagctcaagtctcatggcgaggaagcttgagtttggaacagacagtacatttaaagctttctcagccatgcctaaaacctccctatgtttctacattgtggaaagagaatactgtaagagctgcagtaaagaagatacacaaaaatgtgttaacacgaaactcgaacaaccacagagcattttgatcgaacataagggaactataattggaaagcaaaacaatacttgcacggctaaagcgagttgctggttagagtcagttaagagttttttttatggtctgaagaatatgctcggtggcatatttggcaatgtttttataggcattttcacatttcttaccccctttatcttgttaatactcttctttatgtttgggtggaggatcctgttttgcttcaagtgttgcagaagaaccagaggcctattcaagtacagacacctcaaagacgatgaagaaactggttacagaaagatcattgaaagactgaacaacaaaaagggaaaaaacaggctgcttgatggtgaaagacttgctgacagaaagattgctgaactgttctccacaaaaacacacattggc

SEQ ID NO: 3801 - RNA, 3495 nt, synthetic construct
  misc_feature 1..3495: note = derived and/or modified CDS sequence (wt) from CCHVF(CCHVF 5180-R-2011)__KR814874.1__Gn-NSm-Gc
  source 1..3495: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgacacaagctgcgaagtaatgatacctaaaggcactggagatatcctggtggactgttcaggtggacagcaacatttcttaaaagacaatttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtgtctgtctctttatgttaggaagcatcctgtttttagtctcttgcttggtgaaggggctagttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcatcagttacacttgagtatctgcaaaaaaagaaaaatgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctccatcatggatttgtcacaaatgtattcccctgtttttgagtacttgtcaggagacagacaggttgaagaatggcccaaagcaacttgcacaggtgactgcccagaaaggtgtggttgcacatcatcaacttgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgttcggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 3802 - RNA, 3495 nt, synthetic construct
  misc_feature 1..3495: note = derived and/or modified CDS sequence (wt) from CCHVF(CCHVF 4574-ST-2008)__KR814870.1__Gn-NSm-Gc
  source 1..3495: mol_type = other RNA
tccgaagagtcaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagaaggaaggggccacgtaaaattatctagaggctcagaggttgttttggatgcttgcgactcaagctgcgaagtaatgatacctaaaggcactggagatatcttggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtttattttgcaaggctcttttttattcattgataatcattgggacactagggaaaaagatcaagcaatatagggaattgagacctcaaacctgtaccatatgtgagacagctcctgtcaatgcaatagatgctgaaatgcatgaccttaactgcagttacaatatatgtccttattgtgcatcaagattgacctccgatgggctagctaggcatgtgccacaatgccccaagcggaaggaaaaagttgaggagactgagctgtacttgaacctggaaagaataccttggattgtcagaaagctattgcaagtgtcagagtccactggtgtggcattgaagcgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctccattggcagtataaatggctttgaaattgaatcgcataaatgctactgtagcctactttgctgcccctactgtaggcactgctctgctgacagagaaatccaccagttacacttgagtatctgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattaacaatctgtgttgttagcacctctgcagtagagatggaaaaccttccatcaggcacttgggagaaagaggaagacctgacaaatttctgtcatcaggaatgccaggtgaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaagtggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtacaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccaacctacggtgcaggtgagatcactgtgctggttgaggttgctgacatggagttgcataccaagaaagttgagatatcaggcctgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggcaactttttcataggcattttgttattccttgccccttttgtcctgttggtgcttttctttatgtttggatggaaaatcttgttttgcttcaaatgttgcaggagggccagaggcttgcttaagtatagacacctaaaagacgatgaggaaacaggctacagaaagattattgaaaggctgaacaacaaaaaaggaaaaaacagactgcttgatggtgaaaggttggctgataggaaaattgctgagctgttctccacaaaaacacacattggt

SEQ ID NO: 3803 - RNA, 3495 nt, synthetic construct
  misc_feature 1..3495: note = derived and/or modified CDS sequence (wt) from CCHVF(CCHVF 3010)__DQ019222.1__Gn-NSm-Gc
  source 1..3495: mol_type = other RNA
gcagaaggagtgagcaatgactgtgtttcaaggacccagctaatcaaaacagaagttgcagagattcatgaagatagttatggtgggcctggagaaaaaataacaatctgcaacggctccacaatcgtggaccaaagactcggtagcgaactaggctgctacacaatcaaccgtgtgaagacttataagctttgtgagaatagtgctacagagaagggttgtgagatcgatagtgtcccagtcaaatgcaaacaagggttctgcctcaaagtaacccaagagggcaggggccatgtaaaactgtccagaggaacggaaattgtcctagatgtatgtgacaccagttgtgagttgatgatacccaaaggcactggggacatattggtggactgctcaggaggacagcagcactttttgcaggataacttgattgacttaggttgtccaaatgtaccattattaggcaagatggcaatatatatctgcaggatgtcaaatcatcctaaaactaccatggcttttttgttctggtttagctttggctatgtcatcacatgcatagtatgtaaagtgcttttctatctgctaattgtcatcgggacactaagtaagaaacttaaacagtatagggaattaaaacctcaaacatgcattgtctgtgaatcaacccctgttaatgcaatagatgctgaaatgcacgagctcaattgtaattacaacatatgcccatactgcgcgtccagactaacttcagatggactagtcagacatgtgaatcaatgtcccaaaaggaaagaaaaggtcgaggagactgaactatacttgaacctggagaggataccttggctagtaaggaggctactacaagtgtcagagtcaacggggatggctctaaagagaagttgctggatgaccacactcctcattctgctagtagtttcattatcgccagttcaatctgctccagttggtcaggggaaagcagtcgaagtctaccgggtgagagaaagctacacaagcatatgcctctttgtattaggaagtgttctctttgcggtatcctggctgataaagggtttgattgacggtatcggcaacagttttttccctgggctttctgtctgcaaaacatgctctattggcagcataaatgggttcgagatagagtctcacaaatgctattgtagtctgttttgttgtccttattgcagagcttgctcatctgacaaaatcactcaccgaatgcatttgaacgtctgcaagaaaaggaaagcgggtagcaatgttatgctggctgtctgtaagcgtatgtgctttaaggcaactgttgaagcaagcaacacagccttgctcatcaggggtatcataaattccacttttgtgatatgcgtactgatcctggttatctgtgtggtaagcacatctgctgttgacatggagaatctaccagcaggaatctgggagagagaagaagaccttacaaacttttgccaccaagaatgtcaagtaacagaaactgagtgtctttgcccgtatgaagccttaattctcagaaagcctctttacctagacagcatagccaaggggatgaaaagtctgctaaattctacgaatttagagacaagcctgtcgattgaggccccgtggggagcaatcaatgttcagtcaacttttaaaccaacagtttcagctgccaatatagcacttagctggagttcagttgaacacagaggcaacaaaatcctagtttcgggcaggtcagagtcaattatgaagctggaagaaaggaccggtatcagctggagcctaggtgtagaggatgcttctgagtcaaagacgctgactgtttctgtcatggacctatcccaaatgtattctcccgtctttgagtatctgtcaggtgatagacaggtagaagagtggccaaaagccacctgcacaggcgactgccaagagagatgtggctgcacttcttcaacctgcttgcataaagaatggccacactcgagaaactggcgatgcaaccccacttggtgttggggagtggggactggctgcacctgctgtggattggatgtgagagaccttttcacggactacatgatggttaagtggaaagtggaatatgtaaaaacagaagctataatgtgtgttgagctaaccagtcaggagaggcaatgtagtttgattgaagcaggtacaagatttaacctaggccctgtgacaataaccctgtcagagccaagaaacatccagcaaaggctcccttccgaaatcgttacactgcaccctaagatagaagaagggttctttgacttgatgcatgtgcaaaaggtactatctgcaagtacagtctgcaaactacagagctgcacacacggtgtccctggcgatctacaggtctaccatgttggcaacctactgaaaggagataaggtcaatgggcactcaatccacaagatagagtcccatttcaacacttcatggatgtcatgggatggatgtgatctagactacttctgcaacatgggtgactggccctcatgtacatacactggagtgacacagcacaaccgtgcggcattcatcaatatgctcaatattgagactgattatacaaagactttccacttccattccaagagagtaacggcacatggtgacacccctcaactggatctgaaggcaaggcctacatatggtgcaggcgaagtcactgttctagtagaggttgcagatctggagctacacaccaagaaaattgaagtgtcaggactgaagtttgcaagtctgacctgctccggttgttacgcctgcagctccggtatctcctgcaaagttagaattcatgtgaatgaaccagatgaatttactgtacatgtgaaaagcagtgatccagatgttgtggcagcaggatcaagtttgatggcaaggaaaatagagtttggggctgacagcaccttcaaagctttctcatcaatgcctaaaaactctttgtgcttctatatagtggaaagagactactgcagcagctgcaccaatgatgacactcagaagtgtgttgacacaaagctcgaacatccacaaagcatattaattgagcataagggaacaataattggcaaacaaaacgacacctgttcgaccaaaacaagctgttggctagaatcagtcaagagttttttttatggactaaaaaacatgctgggtggcatcttcggtaatgtcttcttaggcatcttcctgttccttgctccttttgcactgctaatattcttcttcttcttcgggtggaggcttctgttctgtctgaagtgttgcagaagaaccagggggctgctaaagtataaacaacttaaggacgaagaagaagccgggtacaagaaaatcatcgagaggctaaatgacaaaaaaggcaaaagtcgactgtttgacggagagaggcttgcagataggaagattgcagaactcttttcaaccaaaactcatataggg

SEQ ID NO: 3804 - RNA, 3495 nt, synthetic construct
  misc_feature 1..3495: note = derived and/or modified CDS sequence (wt) from CCHVF(CCHVF UG3010)__DQ211637.1__Gn-NSm-Gc
  source 1..3495: mol_type = other RNA
gcagaaggagtgagcaatgactgtgtttcaaggacccagctaatcaaaacagaagttgcagagattcatgaagatagttatggtgggcctggagaaaaaataacaatctgcaacggctccacaatcgtggaccaaagactcggtagcgaactaggctgctacacaatcaaccgtgtgaagacttataagctttgtgagaatagtgctacagagaagggttgtgagatcgatagtgtcccagtcaaatgcaaacaagggttctgcctcaaagtaacccaagagggcaggggccatgtaaaactgtccagaggaacggaaattgtcctagatgtatgtgacaccagttgtgagttgatgatacccaaaggcactggggacatattggtggactgctcaggaggacagcagcactttttgcaggataacttgattgacttaggttgtccaaatgtaccattattaggcaagatggcaatatatatctgcaggatgtcaaatcatcctaaaactaccatggcttttttgttctggtttagctttggctatgtcatcacatgcatagtatgtaaagtgcttttctatctgctaattgtcatcgggacactaagtaagaaacttaaacagtatagggaattaaaacctcaaacatgcattgtctgtgaatcaacccctgttaatgcaatagatgctgaaatgcacgagctcaattgtaattacaacatatgcccatactgcgcgtccagactaacttcagatggactagtcagacatgtgaatcaatgtcccaaaaggaaagaaaaggtcgaggagactgaactatacttgaacctggagaggataccttggctagtaaggaggctactacaagtgtcagagtcaacggggatggctctaaagagaagttgctggatgaccacactcctcattctgctagtagtttcattatcgccagttcaatctgctccagttggtcaggggaaagcagtcgaagtctaccgggtgagagaaagctacacaagcatatgcctctttgtattaggaagtgttctctttgcggtatcctggctgataaagggtttgattgacggtatcggcaacagttttttccctgggctttctgtctgcaaaacatgctctattggcagcataaatgggttcgagatagagtctcacaaatgctattgtagtctgttttgttgtccttattgcagagcttgctcatctgacaaaatcactcaccgaatgcatttgaacgtctgcaagaaaaggaaagcgggtagcaatgttatgctggctgtctgtaagcgtatgtgctttaaggcaactgttgaagcaagcaacacagccttgctcatcaggggtatcataaattccacttttgtgatatgcgtactgatcctggttatctgtgtggtaagcacatctgctgttgacatggagaatctaccagcaggaatctgggagagagaagaagaccttacaaacttttgccaccaagaatgtcaagtaacagaaactgagtgtctttgcccgtatgaagccttaattctcagaaagcctctttacctagacagcatagccaaggggatgaaaagtctgctaaattctacgaatttagagacaagcctgtcgattgaggccccgtggggagcaatcaatgttcagtcaacttttaaaccaacagtttcagctgccaatatagcacttagctggagttcagttgaacacaggggcaacaaaatcctagtttcgggcaggtcagagtcaattatgaagctggaagaaaggaccggtatcagctggagcctaggtgtagaggatgcttctgagtcaaagacgctgactgtttctgtcatggacctatcccaaatgtattctcccgtctttgagtatctgtcaggtgatagacaggtagaagagtggccaaaagccacctgcacaggcgactgccaagagagatgtggctgcacttcttcaacctgcttgcataaagaatggccacactcgagaaactggcgatgcaaccccacttggtgttggggagtggggactggctgcacctgctgtggattggatgtgagagaccttttcacggactacatgatggttaagtggaaagtggaatatgtaaaaacagaagctataatgtgtgttgagctaaccagtcaggagaggcaatgtagtttgattgaagcaggtacaagatttaacctaggccctgtgacaataaccctgtcagagccaagaaacatccagcaaaggctcccttccgaaatcgttacactgcaccctaagatagaagaagggttctttgacttgatgcatgtgcaaaaggtactatctgcaagtacagtctgcaaactacagagctgcacacacggtgtccctggcgatctacaggtctaccatgttggcaacctactgaaaggagataaggtcaatgggcactcaatccacaagatagagtcccatttcaacacttcatggatgtcatgggatggatgtgatctagactacttctgcaacatgggtgactggccctcatgtacatacactggagtgacacagcacaaccgtgcggcattcatcaatatgctcaatattgagactgattatacaaagactttccacttccattccaagagagtaacggcacatggtgacacccctcaactggatctgaaggcaaggcctacatatggtgcaggcgaagtcactgttctagtagaggttgcagatctggagctacacaccaagaaaattgaagtgtcaggactgaagtttgcaagtctgacctgctccggttgttacgcctgcagctccggtatctcctgcaaagttagaattcatgtgaatgaaccagatgaatttactgtacatgtgaaaagcagtgatccagatgttgtggcagcaggatcaagtttgatggcaaggaaaatagagtttggggctgacagcaccttcaaagctttctcatcaatgcctaaaaactctttgtgcttctatatagtggaaagagactactgcagcagctgcaccaatgatgacactcagaagtgtgttgacacaaagctcgaacatccacaaagcatattaattgagcataagggaacaataattggcaaacaaaacgacacctgttcgaccaaaacaagctgttggctagaatcagtcaagagttttttttatggactaaaaaacatgctgggtggcatcttcggtaatgtcttcttaggcatcttcctgttccttgctccttttgcactgctaatattcttcttcttcttcgggtggaggcttctgttctgtctgaagtgttgcagaagaaccagggggctgctaaagtataaacaacttaaggacgaagaagaagccgggtacaagaaaatcatcgagaggctaaatgacaaaaaaggcaaaagtcgactgtttgacggagagaggcttgcagataggaagattgcagaactcttttcaaccaaaactcatataggg

SEQ ID NO: 3805 - RNA, 2916 nt, synthetic construct
  misc_feature 1..2916: note = derived and/or modified CDS sequence (wt) from CCHFV(10200, Artificial)__U39455.2__Gn-4aa-Gc
  source 1..2916: mol_type = other RNA
tcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctagcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggc

SEQ ID NO: 3806 - RNA, 2916 nt, synthetic construct
  misc_feature 1..2916: note = derived and/or modified CDS sequence (wt) from CCHFV(IbAr10200, Artificial)__AF467768.2__Gn-4aa-Gc
  source 1..2916: mol_type = other RNA
tcagaagaacccagtgatgactgtatatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggccattttttacttgttaataattgttggaacactagggaaaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtgggagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctggcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatagaagaattgccgaactgttctctacaaaaacacacattggc

SEQ ID NO: 3807 - RNA, 2916 nt, synthetic construct
  misc_feature 1..2916: note = derived and/or modified CDS sequence (wt) from CCHFV(Turkey-Kelkit06, Artificial)__GQ337054.1__Gn-4aa-Gc
  source 1..2916: mol_type = other RNA
tccgaagagccaggtgatgactgcatatcaagaactcagctattgaggacagaaacagcagagatccatgatgacaactatggtggtccaggtgataaaataactatctgcaacggttcaaccattgtagatcagagactgggcagtgaactagggtgttataccatcaacagggtgaagtcattcaagctatgcaaaaacagcgccacagggaaaacctgtgaggtagacagcactccggttaagtgcaggcaaggtttttgtttaaaaatcacccaagagggaaggggccacgtaaaattatctagaggctcagaggttgtcctggatgcttgcgactcaagctgtgaagtaatgatacctaaaggcactggggatatcctagtggactgttcaggtgggcagcaacatttcttaaaagacaacttaattgacctagggtgcccccatatcccgctattgggtaggatggctatttacatttgcagaatgtcaaatcatcctagaacaaccatggcttttctcttctggttcagctttggctatgttatcacttgtatattttgcaaggctcttttttattcattgataattattggaacactaggaaaaaagatcaagcaatatagggaactgaaacctcaaacctgcaccatatgtgagacagctcctgtcaatgcaatagatgctgaaatgcatgacctcaactgtagttacaatatatgcccttattgtgcatcaagattgacctccgatgggctagccaggcatgtaacgcaatgccccaagcggaaagagaaagttgaggagactgaactgtacctgaacctggaaagaattccttggattgtcagaaagctattgcaggtgtcagagtccactggtgtggcattgaaacgaagcagctggctgattgtactgcttgtgttactgacagtttcgttgtcgccggttcagtcagcacctgttggtagaaaacctcttttcttggacagtatagttaaaggtatgaaaaatttgctaaactcaacaagcttggaaacaagcttatcaattgaggcaccatggggagcaataaatgtccaatcaacctttaaaccaactgtatcgactgcaaacatagcactcagttggagctcagtggtgcacagaggcaacaagatcttggtcacaggcaggtctgaatcaattatgaaactggaggaaaggacaggagtcagctgggatctaggcgtagaagatgcctctgaatccaaattacttaccgtttctatcatggatttgtcacaaatgtattctcctgtttttgagtacttgtcaggagacagacaggttgaagaatggcccaaagcaacttgtacaggtgattgcccggaaaggtgtggttgcacatcatcaacctgcttacataaagaatggtctcactcaagaaactggagatgtaatcccacttggtgctggggagtaggaaccggctgcacctgctgcggggtggatgtaaaagatctttttaccgatcacatgtttgtcaaatggaaagttgaatacataaaaactgaagctatagtatgtgttgcgctcaccagccaagaaagacagtgcagtctgattgaggcaggtactagattcaacttgggccctgtgactattaccctgtctgagccaagaaacattcagcagaagcttcctcctgagattatcacgttgcatcccaaaattgaagaaggcttctttgacttgatgcatgtacaaaaagtgttgtctgcaagtacagtgtgtaaactgcagagttgcacacatggtataccaggagatctacaagtttaccacattggcaacttgttgaaaggggatagagtaaacgggcatctaattcacaaaattgaatcacatttcaacacctcttggatgtcctgggatggttgtgacttagactactactgcaacatgggggattggccatcttgcacatacacaggagtgacccagcataaccatgctgcatttgtaaacttgcttaacattgaaactgattacacgaaaaccttccacttccactctaaaagagtcacagcacatggtgacacaccacaattggacttaaaagcaaggccgacctacggtgcaggtgggatcactgtgctggttgaggttgctgacatggagttgcataccaagaaagttgaaatatcaggcttgaaatttgcaagtctggcttgcacgggttgctatgcttgtagctctggcatctcctgtaaagttaggattcatgtagatgaaccagatgagctcacagtacatgtaaagagcagtgatccagatgtggttgcagctagcacaagtctcatggcgaggaagcttgaatttgggacagacagcacattcaaggccttttcagctatgcccaaaacctctctatgtttttacattgtggagagagaatactgcaagagctgcagtgaagatgatacacaaaaatgtgttgacacaagacttgagcagccacagagcatactaattgagcacaaaggaacgataattggaaagcagaatgatacttgcacagccaaggcaagctgttggctagagtcagtcaagagttttttttatggattgaagaatatgcttggcagtgtttttggtaatcttttcataggcattttgttattccttgccccttttgtcctgttggtgcttttctttatgtttgggtggaaaatcttgttttgctttaaatgttgcaggaggaccagaggcttatttaagtatagacacctcaaagacgatgaggaaacaggctacagaaggattattgaaagactgaacagcaaaaaagggaaaaacaggctgcttgatggtgatagactggctgataggaaaattgctgagctgttctccacaaaaacacacattggc

SEQ ID NO: 3808 - RNA, 2919 nt, synthetic construct
  misc_feature 1..2919: note = derived and/or modified CDS sequence (wt) from CCHFV(SR3, Artificial)__AJ538199.1__Gn-4aa-Gc
  source 1..2919: mol_type = other RNA
tccgaagaatctggtgatgactgcatatcaagaactcagctattgaggacagagactgcagaggtccatggcgacaactacggtggtccaggtgataagataaccatctgtaatggttcaactgttgtagatcaaagactgggtagtgaactagggtgttacactatcaatagagtgaggtcattcaagctatgcgaaaacagtgccacagggaagagctgtgaaatagacagtatcccagtcaagtgtaagcagggttattgccttaaaatcactcaggaaggaaggggccatgtgaagttatctagaggctcagaagttgtcttggatgtatgtgattcaagctgtgaagtgatgatacctaagggcactggtgacattctagtagattgttcaggtgggcagcaacattttttaaaagacaacctggttgacctagggtgtcccaaaattccgttactgggcaaaatggctatttatatctgcaggatgtcgaatcaccccaagacaaccatggccttcctcttttggttcagctttggctatgtgataacttgtatactttgcaaggccatttttttcttattaataatttttggaacactagggaaaaggttcaagcagtacagagagttgaaaccccagacctgcaccatatgtgagacaacacctgtaaatgcaatagatgctgaaatgcatgatctcaactgcagttacaatatatgtccctattgtgcgtctagactgacttcagatgggcttgctaggcatgtaacacaatgtcctagacggaaggagaaagtggaggaaaccgaattatacctgaatttagagagaattccctgggttgtaagaaagctattgcaggtgtcagagtccactggtacagtattaaaaaggagcagctggctaattgtattacttgtgctgttcacagtttcattgtcaccagttcaatcagcacccattggtctcagaaggcccctatttctagatagtatagtcaaaggtatgaaaaatctgctaaactcaacaagtctagaaacaagcttatcaattgaggcaccgtggggagcaatcaatgttcagtcaacctacaaaccaactgtctcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagttatggacttgtctcagatgtactctcctgtcttcgagtacttatcaggtgacagacaagtggaagagtggcctaaagcaacctgcacaggtgactgcccagaaagatgtggctgcacatcatcaacctgcttacacaaagagtggccccactcaaggaattggagatgtaatcctacttggtgctggggtgtagggactggctgcacctgttgtggtttagatgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagaaccaaggaacattcaacaaaagctccctcctgaaataatcacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacctgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacaactagatctgaaggcaaggccaacctatggtgcaggtgagatcaccgtgctggtggaagttgctgacatggagttacacacaaagaagattgaaatatcaggcttaaaatttgcaggcctaacttgcacaggttgttatgcttgtagttctggcatctcttgtaaagttagaattcatgtagatgaaccagatgaacttacagtacatgttaaaagtgatgacccagatgtagttgcagctagctcaagtctcatggcgaggaagcttgaatttggaacagacagtacatttaaagctttctcagccatgcctaaaacctccctatgtttctacattgtggaaagggaatactgtaaaagctgcaataaagaagatacacaaaaatgtgttaacacgaaactcgaacaaccacagagcattttgatcgaacataagggaactataattggaaagcaaaacaatacttgcacggctaaagcgagttgctggttagagtcagttaagagtttcttttatggtctgaagaatatgctcggtggcatatttggcaatgtttttataggcattttcacatttcttaccccctttatcttgttaatacttttctttatgtttgggtggaggatcctgttttgcttcaagtgttgcagaaggaccagaggcctattcaagtacagacacctcaaagacgatgaagaaactggttacagaaagatcattgaaagactgaacaacaaaaaaggaaaaaacaggctgcttgatggtgaaagacttgctgacagaaagattgctgaactgttctccacaaaaacacacattggc

SEQ ID NO: 3809 - RNA, 2919 nt, synthetic construct
  misc_feature 1..2919: note = derived and/or modified CDS sequence (wt) from CCHFV(UCCR4413, Artificial)__KY484038.1__Gn-4aa-Gc
  source 1..2919: mol_type = other RNA
tcagaaagcagcgctagtggttgcatttcaaggacccagatgatcaagtcagaaacagcagagatccacgacgacatctacggaggacctggtgagaagcttaccatctgtaatggtaccactgttgtagatcaaagactgggcagtgaactaggttgctacacaatcaacagaattaagacctataaattgtgtgaaaacagtgtcaaagaaaaaacttgtgagattgacagtgtaccagtcaagtgtagacaggggctttgtttgaagataactcaagaaggaagaggccatgttaagctttccagaggctcagagattgtcctggacatttgtgactctagttgtgaattgatgatacctaaaggcactggggacatattggtagattgttctggaggacagcaacattttttacaggataacctggttgacttaggttgccctaacatccccctacttgggaaagtggctatctacatatgcagaatgtcaaatcaccccaagactaccatggcatttctcttctggttcagttttggttatgtgatcacatgcatattgtgcaaaatactcttttacctactcataatcactggcacactagggaaaaaactaaagcagtatagagagctcaagccacaaacatgtaccatatgtgaatcaacacctgtgaatgcaatagatgctgagatgcatgacctcaactgtagttacaacatatgcccttattgtgcatctagactgacttcagatgggctcataaggcatgtgaatctgtgccccaagaggaaggagaaagttgaagagacagaactgtatttgaacttagaaagaataccttggtttgtgagaaagcttttacaggtgtctgaatctacaggagtagctctcaaaagaagcagttggctattgatacttgttatattgctcacagtttctatgtcaccagttcagtcggcaccaattaatagaaaaccactcttcctgagtagtatagtcaagggtaagaagaatctgctaaactcagcaagtttagaaacaagcctgtcaattgaggcaccatggggagccataaatgctcagtccacctttaaacccaccatatcaactgcaaatatagcactcagctggagctcagtggagcatagaggcaataaagttttggtttcaggtagatcagagtctatcatgaaactcgaggagcgaacaggaatcagttggaacctaggggtagaggacgcatcagagtcaagaatgctaacggtctctgtcatggacttgtcacagatgtacttaccagtatttgaatatctgtctggtgacaggcaagtggaagagtggccaaaagcaacctgtacaggtgactgtccagaaagatgcggctgcacatcatcaacctgcttgcataaagaatggccgcactcaagaaactggagatgcaatcccacttggtgttggggggttggaacaggatgcacatgctgcggattagacgtgaaagacctgttcactgattatatgtttgttaagtggaaggttgagtatattaagactgaagccatagtttgtgttgagttaaccagccaagagagacagtgcagcttaattgaggccggcacaagattcaacttaggtcccgtgacaataacattatcagaaccaaggaacatccaacaaaagctcccttcagagatagtcacactgcatcccaaaatagaagaaggcttctttgacctcatgcatgtgcaaaaggtactatctgctagcacggtgtgcaagctgcagagctgcacgcacggagtggcgggagacctgcaggtctatcatgttggcaatttattaaaaggggacaaaataaatggacattcgattcacaagattgaaccacatctcaacacatcatggatgtcttgggatggctgtgatctagactattactgcaatatgggagattggccctcttgcacatacacaggggtgacacaacacaatcatgcagcatttgtcaacctactaaacattgaaactgattacaccaaaagcttccactttcactcaaaaagagtaacagcacatggagacactccccaactggacctgaaggcgcggcccatgtatggtgcaggcgaaataactgtcttggtggaggttgctgacatggaattgcactcaaagaacattgagatctcaggtctaaaatttgcaagcttgacctgctcaggctgttatgcctgcagctcaggtatttcatgcaaagtcagaatccatgtagacgagcccgatgagctagcagtacatgtaaagagtgatgatctggatgttgtggcagctagttcaagtcttatggcaagaaaaatagaattcggaacagatagcacatttaaagctttctcatctatgccaaaagaatctttatgcttctacattgttgaaagagacttctgtaaaagttgtgcagcagaagacacacaaaaatgtgtgaaagcaaaacttgaacagccacaaagcatacttattgaacacaaagggacaataattgggaaacaaaatgacacttgctcaaccaaaacaagctgttggttggagtcattcaaaagcttcttttatgggctaaaaaacatgctaagcggcgtttttggcagtgctattatgggcattctcttgttccttgccccctttatcttgttaatacttttcttcttttttggatggagaatcttattctgcctaagatgttgtagaaggaccagagggctgtttaagtacaagcatatcaaggatgatgaggaagcaggctacaaaaaaatcattgagaagcttaacaacaaaaaagggggaacaagtaaattgttagatggtgagagacttgcggacagaaagattgccgaacttttctcaacaaaagcacacatcggc

SEQ ID NO: 3810 - RNA, 2916 nt, synthetic construct
  misc_feature 1..2916: note = derived and/or modified CDS sequence (wt) from CCHFV(66019, Artificial)__AB069669.1__Gn-4aa-Gc
  source 1..2916: mol_type = other RNA
tccgaagagtctggtgacgactgcatatctagaactcagctattgaggacagagactgcagaggtccatggtgacaactatggtggtccaggtgacaaaataactatctgtaatggttcaaccattgtggatcaaagacttggcagtgaactggggtgttatactatcaatagagtgaagtcattcaagctatgcgaaaatagtggcacgggaaaatcctgtaagatagataacaccccagttaagtgcaggcagggtttttgcttaaaaattactcaggaaggaaggggccatgtgaagctatcgagaggctcagaagttgtcttagatgcctgcgactcaagctgtgaaataatgataccgaagggcacaggagacatcctagtagactgttcaggtgggcaacaacatttcttaaaagataacttggttgatctaggatgccctaacattccactattaggtaaaatggctatctacatttgcaggatgtcaaatcaccctaaaacaactatggcttttctcttttggtttagtttcggctatgtaataacatgtatattttgtaaaatcattttttacttgttgatagtcgtggggacattggggaaaaagttcaaacagtaccgggagctgaaacctcagacttgtactatatgtgaaacaactcctaccaatgcaatagatgctgaaatgcacgatcttaaatgcagttacaatatatgcccttattgtgcatctagattaacctcggacgggcttgccaggcatgtgacacaatgccctaagcgaaaagagaaagtagaagagactgaactgtacttgaacttggaaagaattccttggattgtcagaaaactactgcaagtgtcagagtctaccggtgtggcactgaaaaggagcagttggctaattgtgttacttgtgctacttacagtttcattgtcaccggttcaatcagcacccattggaaggaaacccctattctcagacagtatagtcaagggcatgaaaaacctgctaaattcaactagcttggaaacaagcttatcaattgaagcaccatggggagcaataaacgtccagtcaacctttaaacccaccgtttcaactgcaaacatagcacttagctggagttcagtagaacacagaggtaacaaaattttggtctcaggcagatcagaatcaattatgaagctagaagaaaggacaggaatcagctgggatctgggcgtagaagatgcctctgagtctaagttgcttactgtttctgtcatggatttgtcacagatgtattctcctgtctttgagtacttatcaggtgacagacaggtagaggagtggcccaaagcaacctgcacaggtaattgcccagataggtgtggctgcacatcatcaacctgcttacacaaggaatggccccattcaaggaattggagatgcaaccccacttggtgttggggagtcggcactggatgcacctgctgtggactagatgtgaaagatctttttacagattatatgtttgtcaagtggaaagttgaatacataaagaccgaggccatagtgtgcgttgagctcaatagccaagaaaggcagtgcagcttgattgaggcaggcacaagattcaacttgggtcctgtgaccatcacgttgtcagaaccaagaaacattcagcagaagcttccttctgaaataatcacattgcatcctagaattgaggaaggcttcttcgatctgatgcatgttcaaaaggtgctgtctgcaagtacagtatgcaagctacaaagctgcacacatggtgtgccaggagacttacagatctaccacattggcaacttgttaaaaggggatagggtaaatgggcatctgattcacaaaattgagccacacttcaacacttcttggatgtcctgggatggctgtgacctagattactactgtaacatgggggattggccctcttgcacatatactggagtgacccaacataaccatgctgcttttgtaaacttacttaacatcgaaactgattacacaaagaacttccattttcattctaagagagttactgcacatggagacacaccacagctggatttgaaagctagaccaacttacggtgcgggtgaaatcactgtactagtggaggttgctgacatggagttacacacaaaaaagattgcgatatcaggtctgaaatttgcaagtttgacttgcacaggttgctatgcttgtagctctggcatctcctgtaaagtcaggattcatgtggatgaaccagatgagcttacagtacatgtgaaaagtgaagatccggacattgttgcagccagctcaagcctcatggcaaggaagcttgaatttgggacagacagcacattcaaggccttctcagccatgcccaaaacctccttgtgcttctacattgtagagagagaatactgtgagagctgcagcaaagaagacacacagaaatgtgttaacacaaagcttgagcaaccacaaagcattttaattgagcacaaaggaacaataatcggaaagcaaaatgacacttgcacagccaaagcaagctgctggttagagtcagtaaagagttttttttatggattgaagaacatgcttagcggcatcttcggcaacgtttttataggcattttcttattccttgctccttttattctgttaatactcttctttatgtttgggtggagaatcctgttttgctttaagtgttgcagaaggaccagaggcttattcaagtacagatatctcaaggacgacgaagagtctggttacagaagaatcattgaaagattaaacaacaaaaaaggaaaaaacaagttacttgacggtgaaagactagctgacaggaggatcgctgagttgttctctaccaaaacacacattggt

SEQ ID NO: 3811 - RNA, 2916 nt, synthetic construct
  misc_feature 1..2916: note = derived and/or modified CDS sequence (wt) from CCHFV(7001, Artificial)__AB069670.1__Gn-4aa-Gc
  source 1..2916: mol_type = other RNA
gcagaaggaggaagcagtgactgcatttcaagaactcagctagttaaaacggaggttgcagaaattcatgaggacagttacggtgggcctggtgagaaaataacaatctgcaatggttccacaattgtagatcaaaggcttggtagtgaattgggctgttatacaatcaacagagtaagatcctacaagctatgcgagaacagtgcctcagggaaaagctgtgaaatagatagcatcccagtcaaatgcaaacaagggttttgcctcaaaataacccaagaaggaagaggtcatgtaaaactgtccagagggacagaaattgttctagatgtctgtgattccagctgtgagctgatgatacccaagggcactggagacattttagtggattgctcaggagggcaacagcattttttacaaaacaatctgattgacttgggatgccccaatgtcccattactgggtaaaatggccatatatgtctgcagaatgtcaaaccacccaaaaactaccatggcatttctgttctggttcagctttggctatgtcattacatgtatagcatgcagggtactcttctacttgctgattgccatcggaacagtagggaaaaagctaaaacagtatagagagctgaaaccacaaacatgcattgtctgtgaatctgtccctgttaatgcaatagatgctgaaatgcatgagcttaattgcagttacaatatatgcccatactgtgcatctagactgtctacagacgggctcatcaggcacgtaactcagtgtcccaaacggagggagaaggtggaagagactgagctattcttgaacttggaaagaataccttggctggtgagaaagctccttcaagtatcagagtcaacaggaatggctctaaagagaagctgttggatgatcacactcctcattctactattggtttcgatatcaccagtccaatctgcaccggtaggcaggaagccactcttcctggataacatagccaagggaatgaaaagcctgttgaactccacgagcttagaaactagtctgtcaattgaagctccgtggggagcaatcaatgtccagtcaactttcaaaccaacagtttcagctgctaacatagcacttagctggagttcagttgaacacaggggcaacaaaattttagtttcaggtagatcagagtcaatcatgaaattagaagaaagaacaggagtcagctggaatctgggtgtagaagatgcttctgagtcaaagacgcttactgtttccgtcatggacctgtcacaaatgtactctcctgtttttgagtacttgtcaggtgacagacaagtggaggaatggccaaaggcaacttgcacaggtgactgtccagagagatgcggctgcacttcgtcaacctgcttacataaagagtggccacattcaagaaactggcgatgtaatcctacctggtgttggggggtggggactggctgcacttgctgtgggctggatgtaaaggatttttttactgactacatgctggtaaaatggaaagtggaatatataaagacagaagctatagtgtgtgtcgagctgactagtcaagagaggcagtgtagtttaattgaagcaggcacaagatttaacctaggccctgtaacaataaccctatcagagccaagaaatgtccagcagaggcttcctcccgaaattgtaacactgcatcctaaaatagaggaaggtttttttgatttgatgcatgtacaaaaaatactgtctgcaagcacagtttgcaagctacagagctgcacacacggtgtgccgggcgattttcaggtctaccatgtcggtaacctgctgaggggagacaaggttaatggacactcaattcacaagatagaaccacattttaatacttcatggatgtcatgggatggttgcgatctggactatttctgcaatatgggggactggccttcatgcacatacactggagtgacacagcataaccgtgctgcatttatcaacatgctcaacattgagactgactatacaaaaactttccactttcattcgaagagggtcacggcacatggagatactccccagctagacctaaaagcgagaccggcatatggtgctggcgaggtcactgttctagtggaggttgcagacttggagttgcacacaaagaaacttgaagtgtcaggtttgaaaattgcaagtttgacctgctctgggtgttatgcctgcagctctggcatctcctgcaaagttagaatccatgtaaatgaaccagatgaatttacagtacatgtaagaagtagcgacccagatgttgtagcagcaggatcaagtcttatggcaaggaaaatagagtttggggctgacagtacattcaaggccttttcatcaatgcccaaggactccttatgcttttacatagtagaaaaggattactgcagcagctgcaccgacgatgacacacaaaagtgtgtcaacacgaagcttgaccatccacagagcatactcattgagcacaaaggaacaataattggcaagcaaaatgacacttgttcgaccaagacaagctgctggctagaatcagttaagggttttttctatgggctaaaaaacatgctaagtggcatctttggaaatgtttttttaggcatcttcttattccttgctccttttgtgctactgatattttttttcttttttgggtggaggcttctgttttgtctcaaatgttgcagaagaactagaggactgttgaaatacaagcaccttaaggatgaagaggaggctggatacaaaaaaatcattgaaaggctaaatggcaaaaaaggtaaaagtcaattgtttgatggtgaaaggcttgcagacaggaagattgctgagcttttttctactaaaattcacataggt

SEQ ID NO: 3812 - RNA, 2916 nt, synthetic construct
  misc_feature 1..2916: note = derived and/or modified CDS sequence (wt) from CCHFV(75024, Artificial)__AB069671.1__Gn-4aa-Gc
  source 1..2916: mol_type = other RNA
tctgaagaatctggtgatgactgcatatcaagaactcagctattgaggacagagactgcagagatccatggtgataactatggcggtccgggtgacaagattactatttgcaatggttcgacaattgtagatcaaagactgggtagtgagatggggtgttacactatcaatagggtgaagtcattcaagctgtgcgaaaacagtgcaacagggaagagctgtgaaatagacagtatcccagttaagtgcaggcagggttattgcctaaaaatcactcaggaaggaaggggccatgtgaaattatccaggggctcagaggttgtcttggatgcatgcgactcaagctgtgaagtaatgatacctaagggcacaggtgacatcctggtagactgttcaggtgggcagcaacattttttgaaggacaacttaattgatctaggatgtcccagtattccattactgggtaaaatggctatttatatttgcagaatgtcgaatcaccctaagacaaccatggctttcctcttttggttcagttttggctatgtgataacttgtatactctgcaaggctattttctacttattaataattgttggaacgctagggaagaggtttaagcagtacagagagttaaaaccccagacctgtaccatatgtgagacaactcctgcaaatgcaatagatgctgaaatgcatgaccttaactgcagttacaacatatgtccctattgtgcatctagactaacctcagacgggcttgctaggcatgtgacacaatgccctaagcggaaggagaaagtagaagaaactgaattgtacttgaacttagagagaattccctgggttgtaagaaagctgttgcaggtatcggagtccaccggtgttgcattaaaaagaagcagctggctgattgtgctgcttgtgctgttcgcaatttcattatcaccagttcaatcagcacccatcggtagaaggcccttgttcctggacagtatagttagaggcatgaaaaatcagctaaactcaacaagtttagaaacaagcttatcgattgaggcaccatggggagcaataaatgttcagtcaacctacaaaccaactgtgtcaactgcaaacatagcacttagttggagctcagttgaacacagaggtaataagattttggtttcaggcagatcagaatcaattatgaagctggaagaaaggacaggaatcagctgggaccttggcgtagaagatgcctctgaatctaagctacttacagtctctgtcatggacttgtctcagatgtactctcctgtcttcgagtacttatcaggtgacagacaagtagaagagtggcccaaggcaacctgtacaggagactgcccagaaagatgtggctgcacaacatcaacctgcttgcataaagaatggccccattcaagaaactggagatgtaatcccacttggtgctggggggtggggactggctgcacttgttgtggattagatgtgaaagacctttttacagattatatgattgtcaagtggaaagttgaatacattaaaacagaggccatagtgtgtgtggaactcaccagtcaggaaaggcagtgtagcttgattgaggcaggcacaaggttcaatttaggttctgtgaccatcacattgtcagaaccgaggaacattcaacaaaagctccctcctgaaataatcacattgcatcctaggattgaagaaggtttttttgacctgatgcatgtacaaaaagtgttgtcagctagcacagtgtgtaagttgcagagttgcacacacggtgtgccaggtgatctacaggtctaccatgtcggaaatttattaaaaggagataaggtgaatggacacctaattcataaaattgagccacacttaaacacttcctggatgtcctgggatggctgtgatctagactactattgcaacatgggagactggccttcttgtacatataccggagttacccaacacaatcatgcttcatttgtaaacctgctcaacattgaaactgactatacaaaaagcttccactttcactctaaaagggttactgcacacggagacacaccacaattagatctgaaggcaagaccaacctacggcgcaggagaaatcactgtactggtagaagttgctgacatggagttcacaccgaagaagattgaaatatcaggcctaaaatttgcaagcctgacttgcacaggctgttatgcttgtagttctggcatttcctgcaaagttaggattcatgtggatgaaccagatgaacttacagtacatgttaagagtgatgatccagatgtagtagcagctagctcaagtctcatggcaaggaagcttgagtttggaacagacagtacatttaaagctttctcagctatgcccaaaacttccttatgtttctacattgtcgaaagggagtactgtaagagctgcagtaaagaagacacacaaaaatgtgttaacacaaaacttgagcaaccacagagcattttgatcgaacataagggaactataattggaaagcaaaacaatacctgcacagccaaagcaagttgctggttagagtcggttaaaagtttcttttatggtctaaagaacatgcttagtggcatttttggcaatctttttatgggcatcttcttatttcttgcccccttcatcttgttaatacttttctttatgtttggatggaggatcctgttttgctttaagtgttgcagaagaaccaggggcctgttcaagtatagacatctcaaagacgatgaagaaactggttacaggaggatcattgaaagactgaacaacaagaaggggaagaacaagctgcttgatggtgaaagacttgccgatagaagaattgccgaactattctccacaaaaacacacattggc

SEQ ID NO: 3813 - RNA, 2916 nt, synthetic construct
  misc_feature 1..2916: note = derived and/or modified CDS sequence (wt) from CCHFV(7803, Artificial)__AB069672.1__Gn-4aa-Gc
  source 1..2916: mol_type = other RNA
tctgaagaatctggtgatgactgcatatcaagaactcagctattgaggacagagactgcagagatccatggtgataactatggtggtccgggtgacaagattactatttgcaatggttcgacaattgtagatcaaagactgggtagtgagatggggtgttacactatcaatagggtgaagtcattcaagctgtgcgaaaacagtgcaacagggaagagctgtgaaatagacagtatcccagttaagtgcaggcagggttattgcctaaaaatcactcaggaaggaaggggccatgtgaaattatccaggggctcagaggttatcttggatgcatgcgactcaagctgtgaagtaatgatacctaagggcacaggtgacatcctggtagactgttcaggtgggcagcaacattttttgaaggacaacttaattgatctaggatgtcccagtattccattattgggtaaaatggctatttatatttgcagaatgtcgaatcaccctaagacaaccatggctttcctcttttggttcagttttggctatgtgataacttgtatactctgcaaggctattttctacttattaataattgttggaacgctagggaagaggtttaagcagtacagagagttaaaaccccagacctgtaccatatgtgagacaactcctgcaaatgcaatagatgctgaaatgcatgaccttaactgcagttacaacatatgtccctattgtgcatctagactaacctcagacgggcttgctaggcatgtgacacaatgccctaagcggaaggagaaagtagaagaaactgaattgtacttgaacttagagagaattccctgggttgtaagaaagctgttgcaggtatcggagtccaccggtgttgcattaaaaagaagcagctggctgattgtgctgcttgtgctgttcgcaatttcattatcaccagttcaatcagcacccatcagtagaaggcccttgttcctggacagtatagttagaggcatgaaaaatccgctaaactcaacaagtttagaaacaagcttatcgattgaggcaccatggggagcaataaatgttcagtcaacctacaaaccaactgtgtcaactgcaaacatagcacttagttggagctcagttgaacacagaggtaataagattttggtttcaggcagatcagaatcaattatgaagctggaagaaaggacaggaatcagctgggaccttggcgtagaagatgcctctgaatctaagctacttacagtctctgtcatggacttgtctcagatgtactctcctgtcttcgagtacttatcaggtgacagacaagtagaagagtggcccaaggcaacctgtacaggagactgcccagaaagatgtggctgcacaacatcaacctgcttgcataaagaatggccccattcaagaaactggagatgtaatcccacttggtgctggggggtggggactggctgcacttgttgtggattagatgtgaaagacctttttacagattatatgattgtcaagtggaaagttgaatacattaaaaccagaggcatagtgtgtgtggaactcaccagtcaggaaaggcagtgtagcttgattgaggcgggcacaaggttcaatttaggttctgtgaccatcacattgtcagaaccgaggaacattcaacaaaagctccctcctgaaataatcacattgcatcctaggattgaagaaggtttttttgacctgatgcatgtacaaaaagtgttgtcagctagcacagtgtgtaagttgcagagttgcacacacggtgtgccaggtgatctacaggtctaccatgtcggaaatttattaaaaggagataaggtgaatggacacctaattcataaaattgagccacacttaaacacttcctggatgtcctgggatggctgtgacctagactactactgcaacatgggagactggccttcttgtacatataccggagttacccaacacaatcatgcttcgtttgtaaacctgctcaacattgaaactgactatacaaaaagcttccactttcactctaaaagggttactgcacacggagacacaccacaattagatctgaaggcaagaccaacctacggcgcaggagaaatcactgtactggtagaagttgctgacatggagttcacaccgaagaagattgaaatatcgggcctaaaatttgcaagcctgacttgcacaggctgttatgcttgtagttctggcatttcctgcaaagttaggattcatgtggatgaaccagatgaacttacagtacatgttaagagtgatgatccagatgtagtagcagctagctcaagtctcatggcaaggaagcttgagtttggaacagacagtacatttaaagctttctcagctatgcccaaaacttccttatgtttctacattgtcgaaagggagtactgtaagagctgcagtaaagaagacacacaaaaatgtgttaacacaaaacttgagcaaccacagagcattttgatcgaacataagggaactataattggaaagcaaaacaatacctgcacagccaaagcaagttgctggttagagtcggttaaaagtttcttttatggtctaaagaacatgcttagtggcatttttggcaatttttttatgggcatcttcttatttcttgcccccttcatcttgttaatacttttctttatgtttggatggaggatcctgttttgctttaagtgttgcagaagaaccaggggcctgttcaagtatagacatctcaaagacgatgaagaaactggttacaggaggatcattgaaagactgaacaataagaaggggaagaacaagctgcttgatggtgaaagacttgccgatagaagaattgccgaactattctccacaaaaacacacattggc

SEQ ID NO: 3814 - RNA, 2916 nt, synthetic construct
  misc_feature 1..2916: note = derived and/or modified CDS sequence (wt) from CCHFV(79121, Artificial)__AB069673.1__Gn-4aa-Gc
  source 1..2916: mol_type = other RNA
gcagaaggaggaagcagtgactgcatttcaagaactcagctagttaaaacggaggttgcagaaattcatgaggacagttacggtgggcctggtgagaaaataacaatctgcaatggttccacaattgtagatcaagggcttggtagtgaattgggctgttatacaatcaacagagtaagatcctacaagctatgcgagaacagtgcctcagggaaaagctgtgaaatagatagcatcccagtcaaatgcaaacaagggttttgcctcaaaataacccaagaaggaagaggtcatgtaaaactgtccagagggacagaaattgttctagatgtctgtgattccagctgtgagctgatgatacccaagggcactggagacattttagtggattgctcaggagggcaacagcattttttacaaaacaatctgattgacttgggatgccccaatgtcccattactgggtaaaatggccatatatgtctgcagaatgtcaaaccacccaaaaactaccatggcatttctgttctggttcagctttggctatgtcattacatgtatagcatgcagggtactcttctacttgctgattgccatcggaacagtagggaaaaagctaaaacagtatagagagctgaaaccacaaacatgcattgtctgtgaatctgtccctgttaatgcaatagatgctgaaatgcatgagcttaattgcagttacaatatatgcccatactgtgcatctagactgtctacagacgggctcatcaggcacgtaactcagtgtcccaaacggagggagaaggtggaagagactgagctattcttgaacttggaaagaataccttggctggtgagaaagctccttcaagtatcagagtcaacaggaatggctctaaagagaagctgttggatgatcacactcctcattctactattggtttcgatatcaccagtccaatctgcaccggtaggcaggaagccactcttcctggatagcacagccaagggaatgaaaagcctgttgaactccacgagcttagaaactagtctgtcaattgaagctccgtggggagcaatcaatgtccagtcaactttcaaaccaacagtttcagctgctaacatagcacttagctggagttcagttgaacacaggggcaacaaaattttagtttcaggtagatcagagtcaatcatgaaattagaagaaagaacaggagtcagctggaatctgggtgtagaagatgcttctgagtcaaagacgcttactgtttccgtcatggacctgtcacaaatgtactctcctgtttttgagtacttgtcaggtgacagacaagtggaggaatggccaaaggcaacttgcacaggtgactgtccagagagatgcggctgcacttcgtcaacctgcttacataaagagtggccacattcaagaaactggcgatgtaatcctacctggtgttggggggtggggactggctgcacttgctgtgggctggatgtaaaggatttttttactgactacatgctggtaaaatggaaagtggaatatataaagacagaagctatagtgtgtgtcgagctgactagtcaagagaggcagtgtagtttaattgaagcaggcacaagatttaacctaggccctgtaacaataaccctatcagagccaagaaatgtccagcagaggcttcctcccgaaattgtaacactgcatcctaaaatagaggaaggtttttttgatttgatgcatgtacaaaaaatactgtctgcaagcacagtttgcaagctacagagctgcacacacggtgtgccgggcgattttcagatctaccatgtcggtaacctgctgaggggagacaaggttaatggacactcaattcacaagatagaaccacattttaatacttcatggatgtcatgggatggttgcgatctggactatttctgcaatatgggggactggccttcatgcacatacactggagtgacacagcataaccgtgctgcatttatcaacatgctcaacattgagactgactatacaaaaactttccactttcattcgaagagggtcacggcacatggagatactccccagctagacctaaaagcgagaccggcatatggtgctggcgaggtcactgttctagtggaggttgcagacttggagttgcacacaaagaaccttgaagtgtcaggtttgaaaattgcaagtttgacctgctctgggtgttatgcctgcagctctggcatctcctgcaaagttagaatccatgtaaatgaaccagatgaatttacagtacatgtaagaagtagcgacccagatgttgtagcagcaggatcaagtcttatggcaaggaaaatagagtttggggctgacagtacattcaaggccttttcatcaatgcccaaggactccttatgcttttacatagtagaaaaggattactgcagcagctgcaccgacgatgacacacaaaagtgtgtcaacacgaagcttgaccatccacagagcatactcattgagcacaaaggaacaataattggcaagcaaaatgacacttgttcgaccaagacaagctgctggctagaatcagttaagggttttttctatgggctaaaaaacatgctaagtggcatctttggaaatgtttttttaggcatcttcttattccttgctccttttgtgctactgatattttttttcttttttgggtggaggcttctgttttgtctcaaatgttgcagaagaactagaggactgttgaaatacaagcaccttaaggatgaagaggaggctggatacaaaaaaatcattgaaaggctaaatggcaaaaaaggtaaaagtcaattgtttgatggtgaaaggcttgcagacaggaagattgctgagcttttttctactaaaattcacataggt

SEQ ID NO: 3815 - RNA, 2916 nt, synthetic construct
  misc_feature 1..2916: note = derived and/or modified CDS sequence (wt) from CCHFV(8402, Artificial)__AB069674.1__Gn-4aa-Gc
  source 1..2916: mol_type = other RNA
tccgaagagtctggtgatgactgcatatcaagaactcagctattgaggacagagactgcggaaattcacaatgataactatggtggtccaggtgacaagataaccatctgcaatggttcaactgttgtggatcagagattgggcagtgaactggggtgttacactatcaatagagtaaagtcatttaagctttgcgagaacagtgccacaggcaaatcctgtgaaatagatagcaccccagtcaaatgcaggcagggtttctgtttgaaaattactcaggagggaaggggccacgtgaagctatcgagaggttcagaagttgtcctggacgcctgcgattcaagctgtgaaataatgataccaaagggcaccggagacatcctagttgactgttcaggtggacagcaacatttcttaaaagataacttgattgatctaggatgcccaaacatcccactattaggcaagatggctatctacatttgtagaatgtcaaatcatcctaaaacgactatggcttttcttttttggtttagctttggttatgtggtgacctgtatactctgtaaggtcatcttctatctattaatagttgtggggacgttggggaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagatggtcttgccagacatgtaatgcagtgccctaagcggaaggaaaaaatagaagaaaccgaattatacttaaacttggaaagaatcccctgggttgttaggaaattactgcaggtgtcagaatccaccggtgtggcactaaagaggagtagttggctggttgtgctacttgtgttacttacagtttcattgtcaccagtacaatcagcacctatcggcaggaaacccttgttttcagacagcattgtcaaaggcatgaagaacttgctaaattcaacaagcttagaaacaagcttatcaattgaggcaccatggggagcaataaatgtccaatcaaccttcaaacctactgtgtcagctgcgaatatagctcttagttggagctcagtggaacacaggggtaataagattttggtttcaggtagatcagagtcaatcatgaagctagaggaaaggacaggaatcagctgggatctaggggtagaagatgcttctgagtctaaattgcttactgtctctgttatggacttgtcacagatgtactctcctgtctttgagtacctatcaggtgacagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttatcaagtggaaagttgagtacattaaaacagaagctatagtgtgtgttgagcttactagccaagagagacaatgtaccttgattgaggcaggcacaagattcaacttaggtcctgtgaccatcacattgtcagagccaagaaacattcagcaaaagctccctccagagatagttacattgcaccccagaattgaagaaggtttctttgatttaatgcatgtacaaaaggtgctatcagcaagtacagtgtgtaagctacagagttgcacacatggtgtgccaggggacctacaggtctatcacataggaaacttgttaaaaggagacaaggtgaatgggcacctgattcacaaaattgaaccacacttcaacacttcctggatgtcttgggacggctgtgacctagactactactgtaatatgggggattggccatcttgcacatatactggagtaacccagcacaatcatgctgcatttgtaaacatgctcaacatcgaaactgattatacaaaaaacttccactttcactctaagagagttactgcacatggagacacaccacaattagatttgaaagctagaccaacttatggtgcaggtgaaatcactgtgctggtggaagttgctgacatggagttacacacaaagaaaattgagatatcaggtttgaagtttgcaagcttaacttgcacaggctgttatgcttgtagctctggtatctcctgtaaggttagaatccatgtagatgagccagatgagcttacagtacatgtgaagagtgaagacccagacatagttgctgctagctcaagtctcatggctagaaaacttgaatttgggacagatagtacattcaaagccttttcagccatgcccaaaacctccttatgcttttacattgtggagagagaatattgtaaaagctgcagcaaagaagatacacaaaaatgtgtcaacacaaagcttgagcaaccacagagcattttaatcgagcacaaaggaacgataattggtaagcagagcaacacctgcacagctaaagcaagctgttggctagagtcagtcaagagcttcttttatgggctaaagaacatgcttagtggcatttttggcaatgttttcataggggttttcttattctttgctccttttatccttttgatacttttctttatgtttggatggagaatcctgttctgctttaaatgttgcagaagaactagaggcctttttaagtacagacacctcaaggacgatgaagaaaccggttacaggaaaatcattgagagactgaacaacaaaaaagggaaaaacaaactgcttgatggtgaaagattagctgataggaagattgctgagctgttctccacaaagacacacattggc

SEQ ID NO: 3816 - RNA, 2916 nt, synthetic construct
  misc_feature 1..2916: note = derived and/or modified CDS sequence (wt) from CCHFV(88166, Artificial)__AB069675.1__Gn-4aa-Gc
  source 1..2916: mol_type = other RNA
tccgaagagtctggtgatgactgcatatcaagaactcagctattgaggacagagactgcggaaattcacagtgataactatggtggtccaggtgacaagataaccatctgcaatggttcaactgttgtggatcagagattgggcagtgaactagggtgttacactatcaatagagtaaagtcatttaagctttgcgagaacagtgccacaggcaaatcctgtgaaatagatagcaccccagtcaaatgcaggcagggtttctgtttgaaaattactcaggagggaaggggccacgtgaagctatcgagaggttcagaagttgtcctggacgcctgcgattcaagctgtgaaataatgataccaaagggcactggagacatcctagttgactgttcaggtggacagcaacatttcttaaaagataacttgattgatctaggatgcccaaacatcccactattaggcaagatggctatctacatttgtagaatgtcaaatcatcctaaaacgactatgggttttcttttttggtttagctttggttatgtggtgacctgtatactctgtaaggtcatcttctatctattaatagttgtggggacgttggggaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagatggccttgccagacatgtaatgcagtgccctaagcggaaggaaaaaatagaagaaaccgaattatacttaaacttggaaagaatcccctgggttgttaggaaattactgcaggtgtcagaatccaccggtgtggcactaaagaggagtagttggctggttgtgctacttgtgttacttacagtttcattgtcaccagtacaatcagcacctatcggcaggaaacccttgttttcagacagcattgtcaaaggcatgaagaacttgctaaattcaacaagcttagaaacaagcttatcaattgaggcaccatggggagcaataaatgtccaatcaaccttcaaacctaccatgtcagctgcgaatatagctcttagttggagctcagtggaacacaggggtaataagattttggtttcaggtagatcagagtcaatcatgaagctagaggaaaggacaggaatcagctggaatctaggggtagaagatgcttctgagtctaaattgcttactgtctctgttatggacttgtcacagatgtactctcctgtctttgagtacctatcaggtgacagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttatcaagtggaaagttgagtacattaaaacagaagctatagtgtgtgttgagcttactagccaagagagacaatgtaccttgattgaggcaggcacaagattcaacttaggtcctgtgaccatcacattgtcagagccaagaaacattcagcaaaagctccctccagagatagttacattgcaccccagaattgaagaaggtttctttgatttaatgcatgtacaaaaggtgctatcagcaagtacagtgtgtaagctacagagttgcacacatggtgtgccaggggacctacaggtctatcacataggaaacttgttaaaaggagacaaggtgaatgggcacctgattcacaaaattgaaccacacttcaacacttcctggatgtcttgggacggctgtgacctagactactactgtaatatgggggattggccatcttgcacatatactggagtaacccagcacaatcatgctgcatttgtaaacatgctcaacatcgaaactgattatacaaaaaacttccactttcactctaagagagttactgcacatggagacacaccacaattagatttgaaagctagaccaacttatggtgcaggtgaaatcactgtgctggtggaagttgctgacatggagttacacacaaagaaaattgagatatcaggtttgaagtttgcaagcttaacttgcacaggctgttatgcttgtagctctggtatctcctgtaaggttagaatccatgtagatgagccagatgagcttacagtacatgtgaagagtgaagacccagacttagttgctgctagctcaagtctcatggctagaaaacttgaatttgggacagatagtacattcaaagccttttcagccatgcccaaaacctccttatgcttttacattgtggagagagaatattgtaaaagctgcagcaaagaagatacacaaaaatgtgtcaacacaaagcttgagcaaccacagagcattttaatcgagcacaaaggaacgataattggtaagcagaacaacacatgcacagctaaagcaagctgttggctagagtcagtcaagagcttcttttatgggctaaagaacatgcttagtggcatttttggcaatgttttcataggggttttcttattctttgctccttttatccttttgatacttttctttatgtttggatggagaatcctgttctgctttaaatgttgcagaagaactagaggcctttttaagtacagacacctcaaggacgatgaagaaaccggttacaggaaaatcattgagagactgaacaacaaaaaagggaaaaacaaactgcttgatggtgaaagattagctgataggaagattgctgagctgttctccacaaagacacacattggc

SEQ ID NO: 3817 - RNA, 2916 nt, synthetic construct
  misc_feature 1..2916: note = derived and/or modified CDS sequence (wt) from CCHFV(BA88166, Artificial)__AF338470.1__Gn-4aa-Gc
  source 1..2916: mol_type = other RNA
tccgaagagtctggtgatgactgcatatcaagaactcagctattgaggacagagactgcggaaattcacagtgataactatggtggtccaggtgacaagataaccatctgcaatggttcaactgttgtggatcagagattgggcagtgaactagggtgttacactatcaatagagtaaagtcatttaagctttgcgagaacagtgccacaggcaaatcctgtgaaatagatagcaccccagtcaaatgcaggcagggtttctgtttgaaaattactcaggagggaaggggccacgtgaagctatcgagaggttcagaagttgtcctggacgcctgcgattcaagctgtgaaataatgataccaaagggcactggagacatcctagttgactgttcaggtggacagcaacatttcttaaaagataacttgattgatctaggatgcccaaacatcccactattaggcaagatggctatctacatttgtagaatgtcaaatcatcctaaaacgactatgggttttcttttttggtttagctttggttatgtggtgacctgtatactctgtaagggcatcttctatctattaatagttgtggggacgttggggaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagatggccttgccagacatgtaatgcagtgccctaagcggaaggaaaaaatagaagaaaccgaattatacttaaacttggaaagaatcccctgggttgttaggaaattactgcaggtgtcagaatccaccggtgtggcactaaagaggagtagttggctggttgtgctacttgtgttacttacagtttcattgtcaccagtacaatcagcacctatcggcaggaaacccttgtatttagacagcattgtcaaaggcatgaagaacttgctaaattcaacaagcttagaaacaagcttatcaattgaggcaccatggggagcaataaatgtccaatcaaccttcaaacctaccatgtcagctgcgaatatagctcttagttggagctcagtggaacacaggggtaataagattttggtttcaggtagatcagagtcaatcatgaagctagaggaaaggacaggaatcagctggaatctaggggtagaagatgcttctgagtctaaattgcttactgtctctgttatggacttgtcacagatgtactctcctgtctttgagtacctatcaggtgacagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttatcaagtggaaagttgagtacattaaaacagaagctatagtgtgtgttgagcttactagccaagagagacaatgtaccttgattgaggcaggcacaagattcaacttaggtcctgtgatcatcacattgtcagagccaagaaacattcagcaaaagctccctccagagatagttacattgcaccccagaattgaagaaggtttctttgatttaatgcatgtacaaaaggtgctatcagcaagtacagtgtgtaagctacagagttgcacacatggtgtgccaggggacctacaggtctatcacataggaaacttgttaaaaggagacaaggtgaatgggcacctgattcacaaaattgaaccacacttcaacacttcctggatgtcttgggacggctgtgacctagactactactgtaatatgggggattggccatcttgcacatatactggagtaacccagcacaatcatgctgcatttgtaaacatgctcaacatcgaaactgattatacaaaaaacttccactttcactctaagagagttactgcacatggagacacaccacaattagatttgaaagctagaccaacttatggtgcaggtgaaatcactgtgctggtggaagttgctgacatggagttacacacaaagaaaattgagatatcaggtttgaagtttgcaagcttaacttgcacaggctgttatgcttgtagctctggtatctcctgtaaggttagaatccatgtagatgagccagatgagcttacagtacatgtgaagagtgaagacccagacatagttgctgctagctcaagtctcatggctagaaaacttgaatttgggacagatagtacattcaaagccttttcagccatgcccaaaacctccttatgcttttacattgtggagagagaatattgtaaaagctgcagcaaagaagatacacaaaaatgtgtcaacacaaagcttgagcaaccacagagcattttaatcgagcacaaaggaacgataattggtaagcagaacaacacatgcacagctaaagcaagctgttggctagagtcagtcaagagcttcttttatgggctaaagaacatgcttagtggcatttttggcaatgttttcataggggttttcttattctttgctccttttatccttttgatacttttctttatgtttggatggagaatcctgttctgctttaaatgttgcagaagaactagaggcctttttaagtacagacacctcaaggacgatgaagaaaccggttacaggaaaatcattgagagactgaacaacaaaaaagggaaaaacaaactgcttgatggtgaaagattagctgataggaagattgctgagctgttctccacaaagacacacattggc

SEQ ID NO: 3818 - RNA, 2916 nt, synthetic construct
  misc_feature 1..2916: note = derived and/or modified CDS sequence (wt) from CCHFV(BA66019, Artificial)__AF350448.1__Gn-4aa-Gc
  source 1..2916: mol_type = other RNA
tccgaagagtctggtgacgactgcatatctagaactcagctattgaggacagagactgcagaggtccatggtgacaactatggtggtccaggtgacaaaataactatctgtaatggttcaaccattgtggatcaaagacttggcagtgaactggggtgttatactatcaatagagtgaagtcattcaagctatgcgaaaatagtggcacgggaaaatcctgtaagatagataaacacccagttaagtgcaggcagggtttttgcttaaaaattactcaggaaggaaggggccatgtgaagctatcgagaggctcagaagttgtcttagatgcctgcgactcaagctgtgaaataatgataccgaagggcacaggagacatcctagtagactgttcaggtgggcaacaacatttcttaaaagataacttggttgatctaggatgccctaacattccactattaggtaaaatggctatctacatttgcaggatgtcaaatcaccctaaaacaactatggcttttctcttttggtttagtttcggctatgtaataacatgtatattttgtaaaatcattttttacttgttgatagtcgtggggacattggggaaaaagttcaaacagtaccgggagctgaaacctcagacttgtactatatgtgaaacaactcctaccaatgcaatagatgctgaaatgcacgatcttaaatgcagttacaatatatgcccttattgtgcatctagattaacctcggacgggcttgccaggcatgtgacacaatgccctaagcgaaaagagaaagtagaagagactgaactgtacttgaacttggaaagaattccttggattgtcagaaaactactgcaagtgtcagagtctaccggtgtggcactgaaaaggagcagttggctgattgtgttacttgtgctacttacagtttcattgtcaccggttcaatcagcacccattggaaggaaacccctattctcagacagtatagtcaagggcatgaaaaacctgctaaattcaactagcttggaaacaagcttatcaattgaagcaccatggggagcaataaacgtccagtcaacctttaaacccaccgtttcaactgcaaacatagcacttagctggagttcagtagaacacagaggtaacaaaattttggtctcaggcagatcagaatcaattatgaagctagaagaaaggacaggaatcagctgggatctgggcgtagaagatgcctctgaatctaagttgcttactgtttctgtcatggatttgtcacagatgtattctcctgtctttgagtacttatcaggtgacagacaggtagaggagtggcccaaagcaacctgcacaggtgattgcccagataggtgtggctgcacatcatcaacctgtttacacaaagaatggccccattcaagaaattggagatgcaaccccacttggtgttggggagtcggcactggatgcacctgctgtggactagatgtgaaagatctttttacagattatatgtttgtcaagtggaaagttgaatacataaagaccgaggccatagtgtgcgttgagctcaatagccaagaaaggcagtgcagcttgattgaggcaggcacaagattcaacttgggtcctgtgaccatcacgttgtcagaaccaagaaacattcagcagaagcttcctcctgaaataatcacattgcatcctagaattgaggaaggtttcttcgatctgatgcatgttcaaaaggtgctgtctgcaagtacagtatgcaagctacaaagctgcacacatggtgtgccaggagacttacagatctaccacattggcaacttgttaaaaggggatagggtaaatgggcatctgattcacaaaattgagccacacttcaacacttcttggatgtcctgggatggctgtgacctagattactactgtaacatgggggattggccctcttgcacatatactggagtgacccaacataaccatgctgcttttgtaaacttacttaacatcgaaactgattacacaaagaacttccattttcattctaaaagggttactgcccatggagacaccccacaactggatcttaaagctagaccaacttacggtgcgggtgaaatcactgttctggtggaggttgctgacatggagttacacacaaaaaagattgcgatatcaggtctgaaatttgcaagtttgacttgcacaggttgctatgcttgtagctctggcatctcctgtaaagtcaggattcatgtggatgaaccagatgagcttacagtacatgtgaaaagtgaagatccggacattgttgcagccagctcaagcctcatggcaaggaagcttgaatttgggacagacagcacattcaaggccttctcagccatgcccaaaacctccttgtgcttctacattgtagagagagaatactgtgagagctgcagcaaagaagacacacagaaatgtgttaacacaaagcttgagcaaccacaaagcattttaattgagcacaaaggaacgataatcggaaagcaaaatgacacttgcacagccaaagcaagctgctggttagagtcagtaaagagttttttttatggattgaagaacatgcttagcggcatcttcggcaacgtttttataggcattttcttattccttgctccttttattctgttaatactcttctttatgtttgggtggagaatcctgttttgctttaagtgttgcagaaggaccagaggcttattcaagtacagatatctcaaggacgacgaagagtctggttacagaagaatcattgaaagattaaacaacaaaaaaggaaaaaacaagttacttgacggtgaaagactagctgacaggaggatcgctgagttgttctctaccaaaacacacattggt

SEQ ID NO: 3819 - RNA, 2916 nt, synthetic construct
  misc_feature 1..2916: note = derived and/or modified CDS sequence (wt) from CCHFV(BA8402, Artificial)__AF350449.1__Gn-4aa-Gc
  source 1..2916: mol_type = other RNA
tccgaagagtctggtgatgactgcatatcaagaactcagctattgaggacagagactgcggaaattcacaatgataactatggtggtccaggtgacaagataaccatctgcaatggttcaactgttgtggatcagagattgggcagtgaactggggtgttacactatcaatagagtaaactcttttaacctttgcgaaaacactgccacgggcaaatcctgtgaaatagatagcaccccagtcaaatgcaggcagggtttctgtttgaaaattactcaggagggaaggggccacgtgaagctatcgagaggttcagaagttgtcctggacgcctgcgaatcaagctgtgaaataatgataccaaagggcaccggagacatcctagttgactgttcaggtggacagcaacatttcttaaaagataacttgattgatctaggatgcccaaacatcccactattaggcaagatggctatctacatttgtagaatgtcaaatcatcctaaaacgactatggcttttcttttttggtttagctttggttatgtggtgacctgtatactctgtaaggtcatcttctatctattaatagttgtggggacgttggggaaaaagttcaaacagtatagagagttgaaacctcagacctgtaccatatgcgaaacaactcctgttaatgcaatagatgctgaaatgcacgacctcaattgcagttacaatatatgtccatactgtgcatctaggccaacctcagatggtcttgccagacatgttatgcagtgccctaagcggaaggaaaaaattgaagaaaccgcattatacttaaacttggaaagaatcccctgggttgttaggaaattactgcaggtgtcagaatccaccggtgtggcactaaagaggagtagttggctggttgtgctacttgtgctacttacagtttcattgtcaccagtacaatcagcacctatcggcaggaaacccttgttttcagacagcattgtcaaaggcatgaagaacttgctaaattcaacaagcttagaaacaagcttatcaattgaggcaccatggggagcaataaatgtccaatcaaccttcaaacctactgtgtcagctgcgaatatagctcttagttggagctcagtggaacacaggggtaataagattttggtttcaggtagatcagaatcaatcatgaagctagaagaaaggacaggaatcagctgggatctaggggtagaagatgcttctgaatctaaattgcttactgtctctgttatggacttgtcacagatgtactctcctgtctttgagtacctatcaggtgacagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttatcaagtggaaagttgagtacattaaaacagaagctatagtgtgtgttgagcttactagccaagagagacaatgtaccttgattgaggcaggcacaagattcaacttaggtcctgtgaccatcacattgtcagagccaagaaacattcagcaaaagctccctccagagatagttacattgcaccccagaattgaagaaggtttctttgatttaatgcatgtacaaaaggtgctatcagcaagtacagtgtgtaagctacagagttgcacacatggtgtgccaggggacctacaggtctatcacataggaaacttgttaaaaggagacaaggtgaatgggcacctgattcacaaaattgaaccacacttcaacacttcctggatgtcttgggacggctgtgacctacactactactgtaatatgggggattggccatcttgcacatatactggagtcacccagcacaatcatgctgcatttgtaaacatgctcaacatcgaaactgattatacaaaaaacttccactttcactctaagagagttactgcacatggagacacaccacaattagatttgaaagctagaccaacttatggtgcaggtgaaatcactgtgctggtggaagttgctgacatggagttacacacaaagaaaattgagatatcaggtttgaagtttgcaagcttaacttgcacaggctgttatgcttgtagctctggtatctcctgtaaggttagaatccatgtagatgagccagatgagcttacagtacatgtgaagagtgaagaccccgacatagttgctgctagctcaagtctcatggctaggaagcttgaatttgggacagatagtacattcaaagccttttcagccatgcccaaaacctccttatgcttctacattgtggagagagaatattgtgaaagctgcagcaaagaagatacacaaaaatgtgttaacacaaagcttgagcaaccacagagcattttaatcgagcacaaaggcacgataattggtaagcagagcaacacctgcacagctaaagcaagctgttggctagagtcagtcaagagcttcttttatgggctaaagaacatgcttagtggcatttttggcaatgttttcataggggttttcttattctttgctccttttatccttttgatacttttctttatgtttggatggagaatcctgttctgctttaaatgttgcagaagaactagaggcctttttaagtacagacacctcaaggacgatgaagaaaccggttacaggaaaatcattgagagactgaacaacaaaaaagggaaaaacaaactgcttgatggtgaaagattagctgataggaagattgctgagctgttctccacaaagacacacattggc

SEQ ID NO: 3820 - RNA, 2916 nt, synthetic construct
  misc_feature 1..2916: note = derived and/or modified CDS sequence (wt) from CCHFV(Matin, Artificial)__AF467769.2__Gn-4aa-Gc
  source 1..2916: mol_type = other RNA
tccgaagagtctggtgatgactgtatatcaagaactcagctattgaggacagagactgcggaaattcacagtgatagctatggtggaccaggtgataagataaccatctgcaatggttcaactgttgtagatcagaggttgggcagtgaactagggtgttacactataaatagagtaaagtcatttaagctttgcgagaacagtgccacaggtaaatcctgtgaaatagatagcaccccagttaaatgcaggcagggtttttgcttaaaaattactcaggagggaaggggccacgtgaagctgtcgagaggttcagaagttgtcttggatgcctgtgactcaagctgtgaaataatgataccaaagggcactggagacatcctagttgactgttcaggtgggcagcaacatttcttaaaagataacctgattgatctgggatgccccaacattccactattaggcaaaatggccatctacatttgtagaatgtcaaatcatcccaaaacaactatggtttttcttttttggtttagctttggttatgtaataacctgtatactctgtaaggtcatcttctatctattaatagttgtagggacattagggaaaaagttcaaacagtatagagagttgaaacctcagacctgtaccatatgcgaaacaactcctgttaatgcaatagatgctgaaatgcacgaccttaactgcagttacaatatatgtccttactgtgcatccaggttgacatcagatggtcttgccagacatgtaatgcagtgccccaaacggaaggaaaaaatagaagaaaccgaattatacttaaacttagaaaggatcccttgggttgttaggaaattactgcaggtgtcagaatctaccggtgtggcactaaagaggagtagctggctggttgtgctacttgtgttacttacagtttcactatcaccagtacaatcagcacctatcggcagaaaacccttgtttttagacagtattattaagggtatgaagaacttgctaaattcaacaagcttagaaacaagcttatcaattgaggcaccatggggagcaataaatgtccaatcaactttcaaacctactatgtcagctgcgaacatagcgctaagttggagctcagtggaacacagaggtaataagattttggtttcaggcagatcagagtcgatcatgaagctagaggaaaggacaggaatcagctgggatctaggagtagaagatgcctctgagtctaaattgcttactgtatctgttatggacttatcacagatgtattctcctgtctttgagtacttatcaggtgatagacaagtggaggaatggcccaaggcaacctgcacaggcgattgtccagaaagatgtggctgcacatcatcaacctgcctacacaaagaatggccccattcaagaaactggagatgcaatcctacttggtgttggggagtcggcactggatgtacctgctgtgggctagacgtaaaagacctttttactgattacatgtttgtcaagtggaaagttgaatacattaaaacggaagttatagtgtgtgttgagcttactagccaagaaagacaatgtagcttgattgaggcaggcacaagattcaacttaggtcctgtgaccattacattgtcagagccaagaaacattcagcaaaagctccctccagagatagtcacattgcatcccagaattgaagaaggtttctttgatttaatgcatgtacaaaaagtgctatcagcaagtacagtgtgcaagctacagagttgcacacatggtgtgccaggggacctacaggtctaccacataggaaacttgttaaaaggagataaggtgaacgggcacttgattcacaaaattgaaccacacttcaacacttcctggatgtcttgggacggctgtgacctagactactactgtaatatgggggattggccatcttgctcatatactggagtaacccaacacaatcatgctgcatttgtaaacatgctcagcatcgaaactgattatacaaaaaacttccactttcactctaagagagttactgcacatggagacacaccacaattagatctgaaagctaggccaacttacggtgcaggtgaaatcactgtgctggtagaggttgctgacatggaattacatacaaagaaaattgagatatcaggtttgaagtttgcaagcttaacttgcacaggatgttatgcttgtagctctggtatctcctgtaaggttagaatccatgtagatgaaccagatgagcttacagtacatgtgaagagtgaagacccagacatagttgctgctagctcaagtctcatggctagaaagcttgaatttgggacagatagtacattcaaagccttttcagccatgcccaaaacctccttatgcttttacattgtggagagagaatattgtaaaagttgcagtaaagaagacacacaaaaatgtgtcaacacaaagcttgagcaaccacagagcatcttaatcgagcataaagggacgataattggaaagcaaaacgacacctgtacagccaaagcaagctgctggctggagtcagtcaaaagttttttttatggactaaagaacatgcttagtggcatttttggcaatgttttcatagggattttcttattccttgctccttttgcccttttaatacttttctttatgtttggatggagaatcctgttctgctttaaatgttgcagaagaactagaggcctatttaaatacagacacctcaaggacgacgaagaaaccggttacaggaaaatcattgagaggctgaacaacaaaaaaggtaaaaacaaactgctcgacggtgaaagactagctgacaggaagatcgctgagctgttctccacaaaaacacacgttggc

SEQ ID NO: 3821 - RNA, 2916 nt, synthetic construct
  misc_feature 1..2916: note = derived and/or modified CDS sequence (wt) from CCHFV(Baghdad 12, Artificial)__AJ538197.2__Gn-4aa-Gc
  source 1..2916: mol_type = other RNA
tctgaagaatctggtgatgactgcatatcaagaactcggctattgagaacagagactgcagagatccatggtgacagctatggtggtccgggtgacaaaattactatttgcaacggttcaactattgtagatcaaagactgggaagtgagatggggtgttacactatcaatagagtgaagtcattcaagctgtgcgaaaacagtgcaacaggaaagagctgtaaaatagacagtatcccagttaagtgcagacagggttattgcctaaaaatcactcaggaaggaaggggccatgtgaaattatccaggggctcagaggttgtcttggatgcatgcgactcaagctgtgaagtaatgatacctaaaggcacaggtgacatcttagtagactgttcaggtgggcagcaacattttttgaaggataacttgattgatctaggatgccccaacattccattattaggtaaaatggctatttatatttgcagaatgtcaaatcaccctaagacaaccatggctttcctcttttggttcagttttggttatgtgataacctgtatactctgcaaggccatcttctacttattaataattgttgggacactagggaaaaggtttaagcagtacagagagttaaaaccccagacctgtactatatgtgagacaactcctgtaaatgcaatagatgctgaaatgcatgaccttaactgcagttacaatatatgtccctattgtgcatctagattaacctcagatgggcttgctaggcatgtgacacaatgccctaagcggaaggagaaagtggaagaaactgaattgtacttgaacttagagaggattccctgggttgtaagaaagctgttgcaggtatcagagtccacaggtgttgcattaaagagaagcagctggctgattgtgctgcttgtgctacttgcagtttcatcatcaccagttcaatcagcacccatcggtagaaagcccttgttcctggatagtatagtcaaaggcacgaaaaatctgctaaactcaacaagtttagaaacaagcttatcgattgaggcaccatggggagcaataaatgttcagtcaacctataaaccaactgtgtcaactgcaaacatagcacttagttggagttcagttgaacacagaggtaacaagattttggtttcaggcagatcagaatcaattatgaagctagaagagagaacaggaatcagttgggatcttggcgtagaagatgcctctgaatctaagctacttacagtctctgtcatggacttgtctcagatgtactctcctgtctttgagtacttatcaggtgacagacaagtagaagaatggcccaaggcaacctgtacaggtgactgcccagaaagatgtggctgcacaacatcaacctgcttgcataaagaatggccccattcaagaaactggagatgtaatcccacttggtgctggggagtgggaactggctgcacttgttgcggattagatgtgaaggacctttttacagattatatgttcgtcaaatggaaagttgaatacattaaaacagatgccatagtgtgtgtggaactcactagtcaagaaaggcaatgcagcttgattgaggcaggtacaaggtttaacttaggttctgtgaccatcacattgtcagaaccgaggaacattcagcaaaagctccctcctgaaataatcacattacatcctaggattgaagaaggtttttttgacctgatgcatgtacaaaaagtgttgtcagctagcacagtgtgtaagttgcagagttgcacacacggtgtgccaggtgatctacaggtctaccacatcggaaatttattaaaaggggataaagtgaatggacacctaattcataaaattgagccacattttaacacttcttggatgtcctgggatggctgtgacttagactactattgcaatatgggagactggccttcttgcacatataccggagttacccaacacaatcatgcttcatttgtaaacctgctcaacattgaaactgattacacaaaaagcttccactttcactctaaaagggttactgcacatggagatacaccacagttagatctgaaggtaagaccaacctacggcgcaggagaaatcactgtactggtagaagttgctgacatggagttgcacacgaagaagattgaaatatcaggcctaaaatttgcaagcctgacttgcacaggctgttatgcttgtagctctggcatttcctgcaaagttaggatacatgtggatgaaccggatgaactcacagtacacgtcaaaagtgatgatccagatgtagtagcagctagctcaagtctcatggcaaggaagcttgagtttggaacagacagcacatttaaagctttctccgccatgccaaaaacttccttatgtttctacattgtcgaaagggagtactgtaaaagctgcagtaaagaagatacacaaaaatgtgttaacacaaaacttgagcaaccacagagcattttgattgaacataagggaactataatcggaaagcaaaacaatacctgcacagccaaaacaagttgctggttagagtcagttaaaagtttcttttatggtctaaagaatatgcttagtggcatttttggcaattttttcatgggcatcttcttatttcttgccccctttatcttgttaatacttttctttatgtttggatggaggatcctgttttgctttaagtgttgcagaagaaccaggggcctgtttaagtacagacatctcaaagatgatgaagaaactggttatagaaggatcattgaaagactgaacaacaagaaagggaagaacaagctgcttgatggtgaaagacttgccgatagaaggattgccgaactattctccacaaaaacacatattggc

SEQ ID NO: 3822 - RNA, 2916 nt, synthetic construct
  misc_feature 1..2916: note = derived and/or modified CDS sequence (wt) from CCHFV(VLG/TI29414, Artificial)__AY179961.1__Gn-4aa-Gc
  source 1..2916: mol_type = other RNA
tccgaggagccaggtgatgactgcatatcaagaactcagctattgagggcagaaccagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaatttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagcccctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaagagactgagctgtacttgaacctggaaagaattccttggaatgtcagaaagctattgcaagtgtcagagtccactggtgtggcattgaaacgaagcagctggctgattgtactgcttgtgttactcacagtttcattgtcaccggttcaatcagcacctgttggtagaaaacctctgttcttagacagtatagttaaaggcatgaagaatttactaaactcaacaaacttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctgggaagtaggaactggctgcacctgctgcgggtggaatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgctgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggaatgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtgattgcagctagcacaagtctcatggcgaggaagcttgaatttgggacagacagtacattcaaggccttttcagctatgcccaaaacctctttatgtttttacattgcggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacgaaaacacacattggt

SEQ ID NO: 3823 - RNA, 2916 nt, synthetic construct
  misc_feature 1..2916: note = derived and/or modified CDS sequence (wt) from CCHFV(TADJ/HU8966, Artificial)__AY179962.1__Gn-4aa-Gc
  source 1..2916: mol_type = other RNA
tctgaagaatctggtgacgactgcatatcaagaactcagctactgaggacagagactgcagagatccatggtgatgattatggtggtccgggtgacaagattaccatttgcaatggttcgactattgtagatcaaagactgggtagtgaactggggtgttacactatcaatagagtgaagtcattcaagctgtgcgaaaacagtgcaacagggaagaactgcgaaatagacagcgtcccagttaaatgcaggcagggttattgcctaaaaattactcaggaaggaaggggccatgtgaaattatccaggggctcagaggttgttttggatgcatgcgattcaagctgtgaagtaatgatacctaagggcacaggtgacatctcagtagactgttcaggagggcagcaacattttttgaaagacaacttaattgatctgggatgtcccaagattccattattgggtaaaatggccatttatatttgcagaatgtcgaatcaccctaaaacaaccatggctttcctcttttggttcagttttggctatgtgataacccgtatactctgcaaggccattttctacttattaataattgttggaacactagggaagaggtttaagcaatatagagagttaaaaccccagacctgtaccatatgtgagacaactcctgcaaatgcaatagatgctgaaatgcatgaccttaactgcagttacaacatatgtccctattgtgcatctagactgacctcagatggactcgctaggcatgtgacacaatgccctaagcggaaggagagagtagaagaaactgaattgtacttgaacttagaaagaattccctggattgtaagaaagctgttgcaggtatcggagtccactggtgttgcattaaaaagaagcagctggctgattgtgctacttgtgctgttcacagtttcattatcaccagttcaatcagcacccattggtagaaggcccctgttcctggatagtatagtcaaaggcatgaaaaatccgctaaactccacaagtttagaaacaagcttgtcgattgaggcaccatggggggcaataaatgttcagtcaacttacaagccaactgtttcaactgcaaacatagcacttagttggagttcaattgaacacagaggtaataatattttggtttcaggcagatcagaatcaattatgaagctggaagaaagaacaggaattagtggggatcttggcgttgaagatgcctctgaatccaagctacttacagtctctgttatggacttgtctcagatgtactcccctgtcttcgagtacttatcaggtgacagacaagtagaagagtggcccaaggcaacctgtacaggtgactgcccagaaagatgtggctgcacatcatcaacctgcttacataaagaatggccccattcacgaaactggagatgcaatcccacttggtgctggggggtggggactggctgcacctgttgtggattagatgtgaaagacctatttatagattatatgttcgtcaagtggaaagttgattacattaaaacagaagccatagtgtgtgtagaactcaccagtcaggaaaggcagtgtagcttggttgaggcgggcacaaggttcaatttaggtcctgtgaccatcacattgtcagaaccgaggaacatacaacaaaagctccctcctgaaataatcacattgcatcctaggattgaagaaggtttttttgatctaatgcatgtgcaaaaagtgctgtcagcaagcacagtgtgtaaattgcagagttgcacacatggtgtgccaggagatctacaggtctaccacatcggaaacttattaaaaggagataaagagaacggacacctaattcataaaattgagccgcacttcaatacttcctggatgtcctgggatggctgtgacctagactactactgcaacatgggagactggccttcttgcacatataccggagttacccagcacaatcatgcttcatttgtaaacctgctcaacattgaaactgactatacaaaaagcttccactttcactctaaaagggttactgcacacggagacacaccacaattggatctgaaggcaagaccaacttacggcgcaggagaaatcactgtactggtagaagttgctgatatggagttacacacgaagaagattgaaataacaggcctcaaatttgcaagcctgacttgcacaggttgttatgcttgtagttcaggcatttcctgcaaagttaggattcatgtggacgagccagatgaacttacagtacatgttaaaagtgatgatccagatgtagttgcagctagctcaagtctcatggcaaggaagcttgagttcgggacagacagtacattcaaagctttctcagccatgcctaaaacttccttatgcttctacattgtcgaaagggagtaccgtaagagctgtagtaaagaggacacacagaaatgtgttaacacaaaacttgagcaaccacagagcattttgatcgaacacaagggaactataatcggaaagcaaaataatacttgcacagccaaagcaagttgctggttagagtcagtcaaaagtttcttttatggtctaaagaacatgcttagtggcatttttggcaatgtttttgtgggcattttcttgtttcttgccccttttatcttgttaatacttttctttatgtttggatggaggatcctgtcttgctttaagtgttgcagaagaaccaggggcctgcttaagcatagacatctcaaagacgatgaagaaactggttacagaaggatcattgaaagactgaacaacaagaaggggaaaaacaagctgcttgatggtgaaagacttgccgatagacggattgccgaactattctccacaaaaacacacattggc

SEQ ID NO: 3824 - RNA, 2916 nt, synthetic construct
  misc_feature 1..2916: note = derived and/or modified CDS sequence (wt) from CCHFV(Hodzha, Artificial)__AY223476.1__Gn-4aa-Gc
  source 1..2916: mol_type = other RNA
tctgaagaatctggtgacgactgcatatcaagaactcagctactgaggacagagactgcagagatccatggtgatgattatggtggtccgggcgacaagattaccatttgcaatggttcaactattgtagatcaaagactaggtagtgaactggggtgttacactatcaatagagtgaagtcattcaagctgtgcaaaaacagtgcaacagggaagagctgtgaaatagacagcaccccagttaaatgcaggcagggttattgcctaaaaatcactcaggaaggaaggggccatgtgaaattatccaggggctcggaggttgtcttggatgcatgcgattcaagctgtgaagtaatgatacctaagggcacaggtgacatcctagtagactgttcaggtgggcagcaacattttttgaaagacaacttaattgatctaggatgtcccagaattccattattaggtaaaatggctatttatatttgcagaatgtcgaatcaccctaagacaaccatggctttcctcttttggttcagttttggctatgtgataacctgtatactctgcaaggccattttctacttattaataattgttggaacactagggaagaggttcaagcagtatagagagttaaaaccccagacctgtaccatatgtgagacaactcctgcaaatgcaatagatgctgaaatgcatgaccttaactgcagttacaacatatgtccctattgtgcatctagactaacctcagatgggcttgctaggcatgtgacacaatgccctaagcggaaggagaaggtagaagaaactgaattgtacttgaacttagagagaattccctggattgtaagaaagctgttgcaggtgtcggagtccactggtgttgcattaaaaagaagcagctggctgattgtgctgcttgtgctgttcgcagtttcattatcacctgttcaatcagcacccattggtagaaggcccctgttcctggatagtatagttaaaggcacgaaaaatctgttaaactccacaagtttagaaacaagcttgtcgattgaggcaccatggggggcaataaatgttcagtcaacctacaaaccaactgtatcaactgcaaacatagcacttagttggagttcagttgaacacagaggtaataagattttggtttcaggcagatcagaatcaattatgaagctggaagaaagaacaggaatcagctgggatcttggcgttgaagatgcctctgaatctaagctacttactgtctctgtcatggacttgtctcagatgtactcccctgtcttcgagtacttatcgggtgacagacaagtagaagagtggcccaaagcaacctgcacaggtgactgcccagaaagatgtggctgcacatcatcaacctgcttacataaagaatggccccattcacgaaactggagatgcaatcccacttggtgctggggggtggggactggctgcacctgttgtggattagatgtgaaagacctatttacagattatatgttcgtcaagtggaaagttgattacattaaaacagaggccatagtgtgtgtagaactcaccagtcaggaaaggcagtgtagcttggttgaggcgggcacaaggttcaatttaggtcctgtaaccatcacattgtcagaaccgaggaacatacaacaaaagctccctcctgaaataatcacattgcatcctaggattgaagaaggtttttttgacctgatgcatgtacaaaaagtgctgtcagcaagcacagtgtgtaaattgcagagttgcacacatggtgtgccaggagatctacaggtctaccacatcggaaatttattaaaaggggataaagtgaacggacacctaattcataaaattgagccgcacttcaatacttcctggatgtcctgggatggctgtgacctagactactactgcaacatgggagactggccttcttgcacatataccggagttacccaacacaatcatgcttcatttgtaaacctgctcaacattgaaactgactatacaaaaagcttccactttcactctaaaagggttactgcacatggagacacaccacaattggatctgaaggcaagaccaacctacggcgcaggagaaatcactgtactggtagaagttgctgatatggagttacacacaaagaagatcgaaataacaggccttaaatttgcaagcctgacttgcacaggttgttatgcttgtagttcaggcatctcctgcaaagttaggattcacgtggatgaaccagatgagctaacagtacatgttaaaagtgatgacccagatgtagttgcagccagctcaagtctcatggcaaggaaacttgagtttggaacagacagtacattcaaagctttctcagccatgcctaaaacttccttatgcttctacattgtcgaaagggagtactgtaagagctgcagtaaagaagacacacagaaatgtgttaacacaaaacttgagcaaccacagagcattttgatcgaacgcaagggaactataatcggaaagcaaaacaatacttgcacagccaaggcaagttgctggttagagtcagttaaaagtttcttttatggtctaaagaacatgcttagtggcatttttggcaatgtttttgtaggcattttcttatttcttgccccctttatcttgttaatacttttcttcatgtttggatggaggatcctgttttgcttcaagtgttgcagaagaaccaggggcctgtttaagtataaacatctcaaagacgatgaagaaactggttacagaaggatcattgaaagactgaacaacaagaaggggaaaaacaagctgcttgacggtgaaagacttgccgatagaaggattgccgaactattctccacaaaaacacacattggc

SEQ ID NO: 3825 - RNA, 2916 nt, synthetic construct
  misc_feature 1..2916: note = derived and/or modified CDS sequence (wt) from CCHFV(Kosovo/9553/2001, Artificial)__AY675511.1__Gn-4aa-Gc
  source 1..2916: mol_type = other RNA
tccgaagagccaggtgatgactgcatatcaaggactcagctattgaggacagaaacagcagagatccatgacgataactatggtggtccaggtgacaaaataactatctgcaatggttcgaccattgtagatcagagactgggcagtgaactagggtgttataccatcaacagggtgaagtcattcaagctatgcgaaaacagcgccacagggaaaacctgtgagatagacagcactccagttaagtgcaggcaaggtttttgtttaaaaatcacccaagagggaaggggccacgtaaaattatctagaggctcagaggttgtcttggacgcttgcgactcaagctgtgaagtaatgatacccaaaggcactggagatatcctagtagactgctctggtggacagcagcatttcttaaaagacaacttgattgacctagggtgccctcatatcccactattgggtaagatggccatttacattgccagaatgtcaaatcatcctaaaacaaccatggcttttctcttctggttcagtttgggctatgtgatcacctgtatactttgcaaggctcttttttattcattgataattattgggacactagggaaaaaaatcaagcaatatagggaactgaaacctcaaacttgcaccatatgtgagacagctcctgtcaatgcaatagatgctgaaatgcatgacctcaactgtagttacaatatatgcccctattgtgcatcaagattgacctctgatgggctagctaggcatgtaaagcagtgccctaagcgaaaggagaaagtcgaggagactgagctgtacctgaacctggaaagaattccttgggtcgtcagaaagctattgcaagtgtcagagtccactggtgtggcattgaaacgaagcagttggctgattgtgctgcttgtgttactcacagtttcattgtcaccggttcaatcagcacccgttggtaggaaacctcttttcttagacagtatagtcaaaggtatgaaaaatttgctaaactcaacaagcttggaaacaagcttatcaattgaggcaccatggggagcaataaatgtccagtcaacctttaaaccaacagtatcgactgcgaacatagcactcagttggagctcagtggagcacagaggcaacaagatcttagtcacaggcaggtctgaatcaattatgaaactagaggaaaggacaggagtcagctgggatctaggggtagaagatgcctctgaatccaaattacttaccgtctctatcatggatttgtcacagatgtattccccagtttttgagtacttgtctggagacagacaggttgaagaatggcccaaagcaacttgtacaggtgactgcccagaaaggtgtggctgcacatcatcaacctgcttgcataaagaatggcctcattcaagaaactggagatgtaatcccacttggtgctggggagtgggaaccggctgcacctgctgcggggtggatgtaaaagacctttttacagatcacatgtttgtcaaatggaaggttgaatatataaaaactgaagccatagtgtgtgttgagctcaccagccaagaaagacagtgcagtctgattgaggcaggtactagattcaacttgggccctgtgactattaccctgtctgagccaagaaacattcagcagaagcttccccctgagatcattacgttgcatcccaaaattgaggaaggcttctttgacttgatgcatgtacaaaaagtgttgtccgcaagtacagtgtgtaaactgcagagttgcacacatggtataccaggagatctacaagtttaccacattggcaacttgttgaaaggggatagagtaaacgggcatctaattcacaaaattgaaccacatttcaacacctcttggatgtcctgggatggttgtgacttagactactactgcaacatgggggactggccttcttgtacatacacaggagtgacccagcataatcatgctgcatttgtaaacttgcttaacattgaaactgattacacgaaaaccttccacttccactctaaaagagtcacagcacatggtgacacaccacaattggacttaaaagcaaggccgacctacggtgcaggagagatcactgtgctggttgaggttgctgacatggagttgcataccaagaaagttgagatatcgggcttgaaatttgcaagtctggcttgcacaggttgctatgcctgtagctctggcatctcctgtaaagtcaggattcatgtagatgaaccagatgagctcacagtgcatgtaaagagcagtgacccagatgttgttgcagctagcacaagcctcatggcaaggaagcttgaatttgggacagacagcacattcaaggccttttcagctatgcccaaaacctctttatgtttttacattgtggagaaagaatactgcaagagctgcagtgaagatgatacaaaaaaatgtgttgacacaaaacttgagcagccacagagcatactaattgagcacagagggacgataattggaaagccgaatgatacttgcccagccaagacaagctgttggctagagtccgtcaagagctttttttatggattgaagaatatgcttggcagtgtctttggtaattttttcataggcattttgttattccttgccccttttttcctgtggatgctttcctttatgtttggatggaaaatcttgttctgctttaaatgttgcaggaggaccagaggcctgtttaagtatagacacctcaaagacgatgaggaaacaggctacagaaggattattgaaaggctgaacaacaaaaaagggaaaaatagactgcttgatggtgaaaggttggctgataggaaaattgccgagctgttttctacaaaaacacacattggc

SEQ ID NO: 3826 - RNA, 2916 nt, synthetic construct
  misc_feature 1..2916: note = derived and/or modified CDS sequence (wt) from CCHFV(SPU41/84, Artificial)__AY900142.1__Gn-4aa-Gc
  source 1..2916: mol_type = other RNA
tccgaggagtctagcgacgactgcatatcaagaactcaactattgaggacagagactgcagagatccacggcgataactatggtggcccaggtgacaagataaccatctgcaatggctcaactgttgtagaccagagactgggtagtgagctggggtgttacactatcaatagagtaaagacattcaaactatgcgaaaacagtgctacagggaagagttgtgagatagatagtgtcccagttaaatgcaggcagggttattgcctaaaaatcactcaggaaggaaggggccatgtaaaattatctagaggctcagaggttgtcttggatgcatgtgatacaagctgtgaagtaatgatacccaaaggcactggtgacatcctagttgactgttcaggtgggcagcaacattttctaaaagacaatctaatagacctaggatgccccaaaattccattactgggtaaaatggctatttacatttgcagaatgtcgaatcaccccaaaacaactatggctttcctcttctggttcagctttggctatgtgataacttgtataatttgtaaggtcattttttacttgttaataattgttggaacactaggaaaaaggttcaagcagtacagagagttaaaacctcagacctgcaccatatgtgagacaactcctgtgaatgcaatagatgctgagatgcatgacctcaattgcagttacaacatatgtccctattgtgcatctagactaacctcagacgggcttgctaggcatgtgacacagtgccctaagcggaaggaaaaagtggaggaaactgaattgtacttgaacttggagagaattccctgggttgtgagaaagctgttgcaggtatcagagtccactggtgtggcattgaaaaggagcagctggctggttgtgctgctggtgctgttgacggtttcattgtcaccggttcagtcagcgcccattagtagaagacctctattcttagatagtatagttaagggcatgaaaaatttgctaaactcaacaagtttagagacaagtttatcaattgaggcaccatggggagcaataaatgttcagtcaacctacaaaccaactgtatcaactgcaaacatagcgcttagttggagctcagtggaacacagaggcaataagatactggtttcaggcagatcagaatcaattatgaagctggaagaaaggacaggaataagctgggatctcggtgtggaagacgcctctgagtctaaactgcttacagtctctgtcatggacttgtctcagatgtactcacctgtcttcgagtacttatcaggagacagacaggtggaggagtggcccaaagcaacttgtacgggtgactgcccagaaagatgtggctgcacatcatcaacctgcttgcacaaagaatggccccactcaagaaattggagatgtaatcccacttggtgctggggtgtaggaactggctgcacctgttgtggattagacgtgaaagacctctttacagattatatgtttgtcaagtggaaagttgaatacattaagacagaagcaatagtgtgtgtagaacttactagtcaggaaagacagtgtagcttgattgaagcgggcacaaggttcaacttgggtcctgtgaccatcacattgtcagaaccaagaaacatccagcaaaagctcccacctgaaataatcacactgcatcccaggattgaggagggtttttttgacctgatgcatgtacaaaaagtgttgtcggcaagcacagtgtgtaagttgcagagttgcacacatggtgtgccaggagatctacaggtctaccacatcggaaatttactaaaaggggataaggtaaatgggcacctagttcataaaattgagccacacttcaatacttcttggatgtcctgggatggttgtgatctagactattattgcaacatgggagattggccttcttgcacatacacaggagttacccagcacaatcatgcctcatttgtaaacatgctcaacattgaaactgattacacaaaaaacttccactttcactctaaaagggtcactgcacacggagacacaccacaactagatcttaaagcaagaccaacctatggtgcaggtgagatcactgtattggtggaggttgctgacatggagttacacacaaagaagattgaaatatcaggcttaaaatttactagcttgacttgtacaggttgttatgcttgtagttctggcatctcatgcaaagttagaattcatgtggatgaaccagatgagcttacagtgcatgttaaaagtgaagatccagatgttgttgcagctagctcaagtctcatggcaagaaagcttgaatttggaacagacagtacatttaaagctttttcagccatgcctaaaacttctctatgtttctacattgtggaaagagaatactgtaagagctgcagtgaagaagacacacaaaaatgtgttaacacaaaacttgagcagccacagagcattttgatcgaacgtaagggaactataatcgggaagcaaaacaacacttgcaaggctaaggcgggttgctggttagagtcagttaagagttttttttacggcctaaagaacatgctcagtggcatttttggcaatgtatttataggcattttcttattccttgcccccttcatcctgttaatactattctttatgtttgggtggaggatcttgttttgttttaagtgttgtagaagaaccagaggcctgttcaagtacagacacctgaaagacgatgaagaaactggttatagaaagatcattgaaagactaaacaacaaaaaagggaaaaataaactgcttgatggtgaaagacttgctgatagaagaattgccgaactgttctctacaaaaacacacattggc

SEQ ID NO: 3827 - RNA, 2916 nt, synthetic construct
  misc_feature 1..2916: note = derived and/or modified CDS sequence (wt) from CCHFV(UG3010, Artificial)__AY900143.1__Gn-4aa-Gc
  source 1..2916: mol_type = other RNA
gcagaaggagtgagcaatgactgtgtttcaaggacccagctaatcaaaacagaagttgcagagattcatgaagatagttatggtgggcctggagaaaaaataacaatctgcaacggctccacaatcgtggaccaaagactcggtagcgaactaggctgctacacaatcaaccgtgtgaagacttataagctttgtgagaatagtgctacagagaagggttgtgagatcgatagtgtcccagtcaaatgcaaacaagggttctgcctcaaagtaacccaagagggcaggggccatgtaaaactgtccagaggaacggaaattgtcctagatgtatgtgacaccagttgtgagttgatgatacccaagggcactggggacatattggtggactgctcaggaggacagcagcactttttgcaggataacttgattgacttaggttgtccaaatgtaccattattaggcaagatggcaatatatatctgcaggatgtcaaatcatcctaaaactaccatggcttttctgttctggtttagctttggctatgtcatcacatgcatagtatgtaaagtgcttttctatctgctaattgtcatcgggacactaagtaagaaacttaaacagtatagggaattaaaacctcaaacatgcattgtctgtgaatcaacccctgttaatgcaatagatgctgaaatgcacgagctcaattgtaattacaacatatgcccatactgcgcgtccagactaacttcagatggactagtcagacatgtgaatcaatgtcccaaaaggaaagaaaaggtcgaggagactgaactatacttgaacctggagaggataccttggctagtaaggaggctactacaagtgtcagagtcaacggggatggctctaaagagaagttgctggatgaccacactcctcattctgctagtagtttcattatcgccagttcaatctgctccagttggtagaaagcctctttacctagacagcatagccaaggggatgaaaagtctgctaaattctacgaatttagagacaagcctgtcgattgaggccccgtggggagcaatcaatgttcagtcaacttttaaaccaacagtttcagctgccaatatagcacttagctggagttcagttgaacacaggggcaacaaaatcctagtttcgggcaggtcagagtcaattatgaagctggaagaaaggaccggtatcagctggagcctaggtgtagaggatgcttctgagtcaaagacgctgactgtttctgtcatggacctatcccaaatgtattctcccgtctttgagtatctgtcaggtgatagacaggtagaagagtggccaaaagccacctgcacaggcgactgccaagagagatgtggctgcacttcttcaacctgcttgcataaagaatggccacactcgagaaactggcgatgcaaccccacttggtgttggggagtggggactggctgcacctgctgtggattggatgtgagagaccttttcacggactacatgatggttaagtggaaagtggaatatgtaaaaacagaagctataatgtgtgttgagctaaccagtcaggagaggcaatgtagtttgattgaagcaggtacaagatttaacctaggccctgtgacaataaccctgtcagagccaagaaacatccagcaaaggctcccttccgaaatcgttacactgcaccctaagatagaagaagggttctttgacttgatgcatgtgcaaaaggtactatctgcaagtacagtctgcaaactacagagctgcacacacggtgtccctggcgatctacaggtctaccatgttggcaacctactgaaaggagataaggtcaatgggcactcaatccacaagatagagtcccatttcaacacttcatggatgtcatgggatggatgtgatctagactacttctgcaacatgggtgactggccctcatgtacatacactggagtgacacagcacaaccgtgcggcattcatcaatatgctcaatattgagactgattatacaaagactttccacttccattccaagagagtaacggcacatggtgacacccctcaactggatctgaaggcaaggcctacatatggtgcaggcgaagtcactgttctagtagaggttgcagatctggagctacacaccaagaaaattgaagtgtcaggactgaagtttgcaagtctgacctgctccggttgttacgcctgcagctccggtatctcctgcaaagttagaattcatgtgaatgaaccagatgaatttactgtacatgtgaaaagcagtgatccagatgttgtggcagcaggatcaagtttgatggcaaggaaaatagagtttggggctgacagcaccttcaaagctttctcatcaatgcctaaaaactctttgtgcttctatatagtggaaagagactactgcagcagctgcaccaatgatgacactcagaagtgtgttgacacaaagctcgaacatccacaaagcatattaattgagcataagggaacaataattggcaaacaaaacgacacctgttcgaccaaaacaagctgttggctagaatcagtcaagagttttttttatggactaaaaaacatgctgggtggcatcttcggtaatgtcttcttaggcatcttcctgttccttgctccttttgcactgctaatattcttcttcttcttcgggtggaggcttctgttctgtctgaagtgttgcagaagaaccagggggctgctaaagtataaacaacttaaggacgaagaagaagccgggtacaagaaaatcatcgagaggctaaatgacaaaaaaggcaaaagtcgactgtttgacggagagaggcttgcagataggaagattgcagaactcttttcaaccaaaactcatataggg

SEQ ID NO: 3828 - RNA, 2916 nt, synthetic construct
  misc_feature 1..2916: note = derived and/or modified CDS sequence (wt) from CCHFV(Hy13, Artificial)__AY900145.1__Gn-4aa-Gc
  source 1..2916: mol_type = other RNA
tccgaagagtctggtgatgactgcatatcaagaactcagctatcgaggacagagactgcggaaattcacagtgataactatggtggtccaggtgacaagataaccatctgcaatggttcaactattgtagatcagagattgggcagtgaactagggtgttacactatcaatagagtaaagtcatttaagctttgcgagaacagtgccacaggtaaatcctgtgaaatagatagcaccccaattaaatgcaggcagggtttttgtttaaaaattactcaggagggaaggggccacgtgaagctatcaagaggttcagaagttgtcttggacgcctgtgattcaagctgtgagataatgataccaaagggcactggagacatcctagttgactgttcaggtggacagcaacatttcttaaaagataacttgattgatctgggatgcccaaacatcccactattaggtaagatggctatctacatttgtagaatgtcaaatcatcctaaaacgactatggcttttcttttttggtttagctttggttatgtgataacctgtatactctgtaaggtcatcttctacctattaatagttgtggggacgttgggaaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagacggtcttgccagacatgtaatgcagtgccctaagcggaaggaaaaagtagaagaaaccgaattatacttaaacttagaaagaatcccctgggttgttaggaaattactgcaggtatcagaatccaccggtgtggcactaaagaggagtagttggctggttgtgctacttgtgttacttacagtttcattgtcaccagtacaatcagcacctatcggcaggaaacccttgttttcagacagtattgtcaaaggcatgaagaacttgctaaattcaacaagcttagaaacaagcttatcaattgaggcaccatggggagctataaatgtccaatcaaccttcaaacctactgtgtccgctgcgaacatagctcttagttggagctcagtggaacacaggggtaataagattttggtttcaggtagatcagagtcaattatgaagctagaggaaaggacaggaatcagctgggatctaggggtagaagatgcctctgagtctaaattgcttactgtctctattatggacttgtcacagatgtattctcctgtctttgagtacctatcaggtgatagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagatcacatgtttgtcaagtggaaagttgagtacattaaaacagaagctatagtgtgtgttgagcttactagccaagagagacaatgtagcttgattgaggcaggcacaagattcaacttaggtcctgtgaccatcacattgtcagagccaagaaacattcagcaaaagctccctccagagatagttacattgcatcccagaattgaagaaggtttctttgatttaatgcatgtaaaaaaagtgctatcagcaagtacagtatgtaagctacagagttgcacacatggtgtgccaggggacctacaggtctaccacataggaaacttgttaaaaggagacaaggtgaatgggcacctgattcacaaaattgaaccacacttcaacacttcctggatgtcttgggacggctgtgacctagactactactgtaatatgggagactggccatcttgctcatatactggagtaacccagcacaatcatgctgcatttgtaaacatgctcaacatcgaaactgattatacaaaaatcttccactttcactctaagagagttactgcacatggagacacaccacaattagatttgaaagctagaccaacttatggtgcaggtgaaatcactgtgctagtggaagttgctgacatggagttacacacaaagaaaattgagatatcaggtttaaagtttgcaagcttaacttgcacaggctgttatgcttgtagctctggtatctcctgtaaggttagaatccatgtagatgagcctgatgagcttacagtacatgtgaagagtgaagacccagacatagttgctgctagctcaagtctcatggctagaaaacttgaatttgggacagatagcacattcaaagccttttcagccatgcccaaaacctccttgtgcttttacattgtggagagagaatattgtaaaagctgcagtaaagaagatacacaaaaatgtgtcaacacaaagcttgagcaaccacagagcattttaattgagcacaaaggaacgataattggtaagcaaaacgacacctgcacatctaaagcaggctgttggctagagtcagtcaagagcttcttttatgggctaaaaaacatgcttagtggcatttttggcaatgttttcatagggattttcttattccttgctccttttatccttttaatacttttctttatgtttggatggagaatcctgttctgctttaaatgttgcagaagaactagaggcttatttaagtacagacacctcaaggacgatgaagaaaccggttacaggaaaatcattgagaggctgaacaacaaaaaagggaaaaacaaactgcttgatggtgaaagattagctgataggaagattgctgagctgttctccacaaagacacacattggc

SEQ ID NO: 3829 - RNA, 2916 nt, synthetic construct
  misc_feature 1..2916: note = derived and/or modified CDS sequence (wt) from CCHFV(Semunya, Artificial)__DQ094832.1__Gn-4aa-Gc
  source 1..2916: mol_type = other RNA
gcagaaggagtgagcaatgactgcgtttcaaggacccagctaatcaaaacagaagttgcggagattcatgaagatagctacggtgggcctggagaaaaaataacaatctgcaacggctccacaatcgtggaccaaaggcttggtagcgaactaggttgctacacaattaaccgcgtgaagacttataagctttgtgagaacagtgccacagaaaagggttgtgagatcgatagtgttccagtcaaatgcaaacaagggttctgcctcaaagtaacccaagagggcaggggccatgtgaaactatctagaggaacggaaattgtcctggatgtgtgtgacaccagttgtgagttgatgatacctaaaggcactggagacatattggtggactgctcaggaggacagcagcacttcttgcaggacaacttgattgacttaggttgcccaaatgtaccattactaggcaagatggcaatatatatctgcaggatgtcgaaccatccaaagaccaccatggcttttttgttctggttcagttttggctatgtcatcacatgcgtagtatgcaaagtgctcttctatctgctaattgtcatcgggacactaggaaagaaacttaaacagtatagggaactaaaacctcagacatgcattgtctgtgaatcaatccctgtcaatgcaatagatgctgaaatgcacgagctcaattgcaattacaatatatgcccatactgtgcgtccagactgacttcagatggactagttagacatgtgactcaatgtcccaaaaggaaggaaaaggtcgaggagactgagctgtacttgaacctggagaggataccctggttggtaagaagactactgcaagtgtcagagtcaacagggatggctctaaagagaagttgctggatgaccacactcctcattctgctagtagtttcattgtctccagttcaatctgctccagtaggtagaaagccccttttcctggatagcatagccaaggggaagaaaagtctgttaaattctacgaacttagagacaagcctgtcgattgaggccccatggggagcaatcaatgttcagtcaacttttaaaccaacagtttcagctgccaacatagcacttagctggagttcagttgaacacaggggcaacaaaatcctagtttcgggcaggtcagagtcaattatgaaactggaagaacggaccggcatcagctggagcctaggtgtagaggatgcttctgagtcaaagacgcttactgtttctgtcatggacctgtctcaaatgtattctcctgtctttgagtatctgtcaggtgatagacaagtagaagagtggccaaaggccacttgcacaggcgactgcccggagagatgtggctgcacctcctcaacctgcttgcataaagaatggccgcactcgagaaactggcgatgcaaccccacttggtgttggggagtagggactggctgcacctgctgtggactggatgttagagaccttttcacggactacatgatggtcaagtggaaagtggaatatgtaaaaacagaagctataatgtgtgttgagctaactagtcaggaaaggcagtgtagtttaattgaggcaggtacaaggtttaacctaggccctgtgacaataaccctgtcagagccaagaaatgtccagcaaaggcttccctccgaaatcgttacactgcaccctaagatagaggaaggattctttgatttgatgcatgtgcaaaaagtactattctgcaagtacagtttgcaagctacaagctgcacacacggcgtcccaggcgatttgcaggtctaccatgttggcaacctactgaaaggagacaaggttaatgggcactcaattcacaagatagagtctcatttcaacacctcatggatgtcatgggatggatgtgacctagactacttttgcaacatgggtgactggccttcatgtacatatactggagtgacacagcacaatcgtgcggcattcgtcaacatgctcaatattgagactgattatacaaagacttttcacttccattccaagagggttacggcacacggtgacacccctcaactggatctgaaggcaagaccaacatatggtgcaggcgaggtcactgttctagtggaggttgcagatctggagctacacactaagaaaatagaagtgtcagggttgaagtttgcaagtctgacctgctccggttgttatgcctgcagttccggcatctcctgcaaagttagaattcatgtgaatgaaccagatgagttcacagtacacgtgaaaagcaatgatccagacgttgtggcagcaggatcaagtctgatggcaaggaaaatagagtttggggctgacagcacctttaaagccttttcatcaatgcctaaaaactctttgtgcttttatatagtggaaagagactactgcagcagctgcaccgatgatgacactcagaagtgtgttaacataaagctcgaacatccacaaagcatattaattgagcataagggaacaataattggtaagcaaaatgacacctgtccgaccaaaacaagctgctggctagaatcagtcaagagttttttttatggactgaaaaacatgctgggtggcatcttcggcaatgtcttcttaggcatcttcctattccttgctccttttgcactgctgatactcttcttcttctttggatggaggcttctgttctgtctgaagtgttgcagaaggaccaggggtctgctaaagtataaacaacttaaggatgaagaagaagccgggtacaagaaaatcatcgagaggctgaatgacaaaaagggcaaaagtcgactttttgatggagagaggctcgctgacaggaagattgctaaactcttctcaaccaagactcatataggg

SEQ ID NO: 3830 - RNA, 2916 nt, synthetic construct
  misc_feature 1..2916: note = derived and/or modified CDS sequence (wt) from CCHFV(SPU128/81/7, Artificial)__DQ157174.1__Gn-4aa-Gc
  source 1..2916: mol_type = other RNA
tccgaagaacccagtgatgactgcatatcaagaactcaactattgaggacagagactgcagagatccacggcgacaactatggtggcccgggtgacaaaataaccatctgcaacggctcaactattgtagaccaaagactaggcagtgagctagggtgttacactatcaacagagtgaagtcattcaagctatgcgaaaatagtgccacagggaagagctgtgaaatagaaagtgtcccagttaaatgcaggcagggttattgcctgagaatcactcaggaagggaggggccatgtaaaattatctaggggctcagaggttgtcttagatgcatgtgatacaagctgtgaaataatgatacctaagggcactggtgacatcttggttgactgttcaggtgggcagcaacattttctaaaggacaatttgatagatctaggatgccccaaaattccattattgggcaaaatggctatttacatttgcagaatgtcgaatcaccccaaaacaaccatggctttcctcttctggttcagctttggctacgtaataacttgtatactttgcaaggccatcttctacttgttaataattattggaacactagggaaaaggttcaagcagtatagagagttaaaacctcagacctgcaccatatgtgagacaactcctgtaaatgcaatagatgctgagatgcacgacctcaattgcagttacaacatttgtccctactgtgcatctagactaacctcagatgggcttgctaggcatgtgacacaatgccctaagcggaaggagaaagtggaagaaactgaactgtacttgaacttagaaagaattccttgggttgtaagaaagctgttgcaggtatcagagtccactggtgtggcattgaaaagaagcagctggctgattgtgctgcttgtgctgttcacggtttcattgtcaccagttcaatcagcacccattggtagaaagcctctattcctagatagtatagttaaaggcatgaaaaatctgctaaactcaacaagtttagaaacaagtttatcaattgaggcaccatggggggcaataaatgttcagtcaacctacaaaccaactgtgtcaactgcaaacatagcactcagttggagctctgtggaacacagaggcaataagatcttggtttcaggcagatcagaatcaattatgaagctggaagaaaggacaggaatcagctgggatctcggcgtagaagacgcctctgagtctaaactgcttacagtctctgtcatggacttgtctcagatgtactctcctgtcttcgagtacttatcaggagacagacaggtggaagagtggcccaaagcaacttgtacaggtgactgcccagaaagatgcggctgcacatcatcaacgtgtttgcacaaagaatggccccattcaagaaattggagatgcaatcccacttggtgctggggtgtagggactggctgcacctgttgtggattagatgtgaaagacctttttacagattatatgtttgtcaagtggaaagttgaatatattaagacagaggccatagtgtgtgtagaacttaccagtcaggaaaggcagtgtagcttgattgaagcgggcacaaggttcaatttaggtcctgtgaccatcacactgtcagaaccaagaaacatccaacagaagctccctcctgaaataatcacactgcatcccaggatcgaagaaggtttttttgacttgatgcatgtacagaaagtgttatcggcaagcacagtatgtaagttgcagagttgcacacatggtgtaccaggagacctacaggtctaccacatcggaaatttattgaaaggggataaggtaaatggacatctaattcataaaattgagccacacttcaacacttcctggatgtcctgggatggttgtgacctggactactactgcaacatgggagattggccttcttgcacatacacaggagtcacccaacacaatcatgcttcatttgtaaacctgctcaacattgagactgattacacaaaaaacttccactttcactctaaaagggtcactgcacacggagacacaccacaactagatcttaaggcaagaccaacctatggtgcaggtgagatcactgtactggtagaagttgctgacatggagttacacacaaagaagattgaaatatcaggcttaaaatttgcaagcttgacttgcacaggttgttatgcttgtagctctggcatctcatgcaaagttagaattcatgtggatgaaccagatgaacttacagtacatgttaaaagtgatgatccagatgtagttgcagctagctcaagtctcatggcaagaaagcttgaatttggaacagacagtacatttaaagctttctcagccatgcctaaaacttctctatgtttctacattgttgaaagagaacactgtaagagctgcagcgaagaagacacaaaaaaatgtgtcaacacaaaacttgagcaaccacaaagcattttgatcgaacacaagggaactataatcggaaagcaaaacagcacttgcacagccaaggcgagttgctggttagagtcagtcaaaagttttttttatggtctaaagaacatgcttagtggtatttttggcaatgtttttataggtattttcttgttccttggccccttcatcttgttaatactattctttatgtttgggtggaggatcctattttgctttaaatgttgtagaagaactagaggcctgctcaagtatagacacctcaaggaagatgaagaaactggttatagaaggattattgaaagactaaacaataaaaaaggaaaaaacaaactgcttgatggtgaaagacttgctgatagaagaattgccgaactgttctctacaaaaacacacattggc

SEQ ID NO: 3831 - RNA, 2916 nt, synthetic construct
  misc_feature 1..2916: note = derived and/or modified CDS sequence (wt) from CCHFV(ROS/HUVLV-100, Artificial)__DQ206448.1__Gn-4aa-Gc
  source 1..2916: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagcccctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtagaaaacctctgttcttagacagtatagttaaaggcatgaagaatttgctaaactcaacaagcttagaaacaagcctatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacattgcatcccaaagttgaagagggcttctttgacttgatgcatgtgcaaaaagtgctgtctgcaagtacagtgtgtaaactgcagagttgcacacatggtataccaggagatctacaagtttaccatattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaattttttcataggcattttgttattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaagggaaaaaacagactgcttgatggtgaaaggttggctgataggaaaattgctgagctgttctccacaaaaacacacattggt

SEQ ID NO: 3832 - RNA, 2916 nt, synthetic construct
  misc_feature 1..2916: note = derived and/or modified CDS sequence (wt) from CCHFV(AP92, Artificial)__DQ211625.1__Gn-4aa-Gc
  source 1..2916: mol_type = other RNA
tcagaagggggtgatggaggctgcatctcaagaactcaactgataaaaacagaaactgcggaggtgcacggagacgattacggtggacctggcgagaaaattaccatctgcaatggttcaaccatcgttgatcagaggttaggtagtgaactggggtgttacacaattaacagaataaaatctttcaaactatgcgagaatagtgcccagggcaagaactgtgagatagacagtgcaccagtacaatgcaggcaaggttattgcttgaaaattagtcaagagggaagaggacatgtgaaactttccaggggttcagaaattgttctagatgtttgtgacacaagctgtgagataatgattcctaagggcacaggtgacatcttagtagactgctcaggagggcagcagcattttctacagagcaacttagttgacctgggttgtccgaacattccgctgctgggcaagatggctatttatatttgcagaatgtcaaatcaccctaaaacaaccatggctttccttttttggttcagctttggctacgtgatcacttgtatattgtgcaagacacttttttacatacttataattattgggacattagggaaaaaattaaagcagtacagagagctgaaaccccaaacatgtaccatatgtgaatcagtaccggttaatgcaatagatgctgaaatgcatgacctcaactgcagctacaacatatgcccttattgtgcctccagactcacctcagaggggctcactagacatgtgaaccagtgccccaaaaggaaagagaaggtagaagagacagagttatacctgaacctggaaaggatcccctggattgttaggaagctcctacaggtatctgagtcaacaggtgtggccttaaaaagaagcagctggatgatcgtgctcctcatattactgatagtctctatgtcaccggttcaatctgcaccaataagtaggaaaccactttttttggatagcatagctaaaggtgttaagaacctcttgaactcaacaagcctggaaactagcttgtcaattgaagcaccatggggggccatcaatgcccaatcaacttacaaaccaactgcatcaagtgctaatattgctctaacatggagctcagtggaacacaggggcaacaagatcttggtctcaggcaggtctgaatcaattatgaaacttgaagagaggaccggaataagctggaacttgggcgttgaagatgcttctgagtcaagaacactcaccatctccgtcatggatctatcacagatgtattcccctgtctttgagtacctgtcaggagatcgtcaggtggaggaatggccaaaggcaacctgcactggcaactgcccggagagatgcggctgcacatcgtcaacctgcctttacaaggagtggccacattcgagaaactggagatgcaaccccacctggtgttggggggttgggactggctgcacatgctgtggactagatgtcaaagaactgttcacggatcacatgctagtaaaatggaaagttgagtacatcaagacagaggccatagtgtgtgttgagcttaccagtcaagaaaggcagtgcagtttgattgaagcaggtacgagatttagcttaggaccagtaacaatcaccttgtctgagccaaggaacattcagcagaagcttcctcctgaattaattacattacacccaaagatagaagacggctactttgacttaatgcatgttcaaaaggttatgtccgccagtacagtgtgcaagctgcaaagttgcacacacggtgtgcccggggacttgcaaatttatcatgttggcaatctgttgaagggggacagagtgaatgggcacctgatccacaaggttgagccacacctgaacacatcctggatgtcgtgggatggttgtgacttagactatttctgcaatatgggggactggccctcctgcacatacaccggggtgacacaacacaatcatgccgcatttgcaaatctgcttaacattgaaaccgactatacaaagactttccatttccactccaaaagagtgacggcccatggagacacaccacagctggacttgaaggcaaggcctaggtatggtgcaggtgaaatcactgttctggttgaagtagctgatatggagttacatacaaagaaggtcgaggtaacaggcttaaaatttgcaagcctaacttgttcaggatgctatgcctgtagttcaggtatctcctgcaaggttagaatacatgtggacgagccagatgagctcacagtgcatgtgaaaagcagcgacccagacattgtggcagccagctcaagtctcatggcaaggaagattgagtttggggttgacagtactttcaaagcgttctcctctatgcctaaagattctctgtgcttttatattgtcgaaagagactattgcaacagctgcaaaaatgaggaaacacagaggtgtgtgaacgcaaagcttgaacagccacagagcatcctcatcgaacatacaggtacaatcattggcaagcagaacgacacctgtggatctaggacaagctgctggctagactcatttaaaagtttcttttatggactaaagagcatgttgagcggcatttttggtaatgtctttctaggcatcttcttgtttcttgccccctttgctctgctgctgtttttctttttctttggatggagaatcctgttttgctttaagtgctgtagaagaaccagaggcctgtttaaatacagacacatcaaggacgatgaagaggttggctacaaaaaaatcatcgaaagactgaacaataaaaaaggcaaacacagacttcttgacggcgagagacttgcagataggaagatcgctgaacttttctcaactaagacacacattgga

SEQ ID NO: 3833 - RNA, 2916 nt, synthetic construct
  misc_feature 1..2916: note = derived and/or modified CDS sequence (wt) from CCHFV(ArD8194, Artificial)__DQ211626.1__Gn-4aa-Gc
  source 1..2916: mol_type = other RNA
gcagagggggggagcaatgattgtgtttcaagaacccagctagtcaaaacagaggttgcagaaattcatgaagacagttacggtggtcctggcgaaaaaatcacaatttgcaacggctccacaatagtggatcaaaggcttggcagcgaattaggttgctatacaataaacagagtgagaacctataagctctgtgagaacagtgccacagaaaagagctgtgaaatagacagtgttccagttaaatgcaaacaggggttctgcctcaaaataactcaggaaggtaggggccatgtgaaattgtctagagggacagaaatcgttttggatgtctgtgatactagctgtgaactgatgatacccaaaggcactggggatatattggtggactgctcaggagggcagcaacactttttacaggacaatctaattgacttgggatgcccaaatattccattgctaggtcgaacagctatatatgtttgtagaatgtcaaaccatcccaagacaaccatggcttttctgttttggttcagttttggctatgtcatcacatgtgtagtgtgcaaggtgctcttctatttgctaattgtcatcgggacactaggaaaaaggctgaaacagtacagagagctaaagcctcaaacatgtattgtctgtgaatctatccctgtcaatgcaatagatgctgaaatgcacgatcttaactgcaactacaacatatgcccttactgtgcatccagactgacctcagatggtctcgtcaggcacgtaactcaatgtcccaaacggaaagagaaggtcgaagaaactgaactatacttaaacctggagagaataccttggttggtgagaaaactcctacaagtgtcggagtcaacaggagtggctctaaagagaagctgctggatgatcacactccttattctgctgactgtttcaatgtcaccagttcagtccgcaccagtaggcagaaaaccacttttcttagatagaatagccaagggaatgaaaagcttgttgaactccacaagtttagaaacgagcttgtcaattgaagctccatggggggcaatcaatgttcaatcaactttcaaaccaacagtttcagccgccaatatagcacttagctggagttcagttgaacacaagggcaacaagatcttagtttcaggcagatcagagtcaattatgaaattagaagaaagaactggaatcagctggtgtctaggtgtggaagatgcctctgagtcaaaaacactcaccgtttctgttatggatctgtctcaaatgtattctcctgttttcgagtacctgtcaggtgaccgacaggtggaggagtggccaaaagcaacctgcacaggtgactgtccagaaagatgtggctgcacttcatcaacctgcctgcataaggagtggccgcactcgaggaactggcgctgtaaccccacttggtgttggggggtgggaactggctgcacctgctgtgggctagatgtaaaggatctcttcacagactacatgttggttaaatggaaagtggaatatataaaaacagaagccataatatgtgttgagcttactagtcaagagaggcagtgtagtttaattgaagcaggcacaaggtttaacctaggccctgtgacaataactctatcagaaccaaggaacgtacagcagaggcttcctcccgagatcatcacactgcaccctaaaatagaagaagggttttttgatttgatgcatgtacagaaggtaatgtctgcaagcacggtttgtaagctgcaaagctgtactcatggtgtgcctggagacttacaagtctaccatgttggcaacttgttaaagggggacaaagtcaatgggcactcaatccacaagatagaatcacacctcaacacctcatggatgtcatgggatgggtgtgatttagactatttttgcaacatgggggactggccctcatgcacatacacaggggtgacacaacacaaccatgctgcattcatcaacatgcttaacattgagactgattacacaaaaacctttcactttcattcaaaaagggtcacagcacacggagacacccctcagttggacctaaaagcgagaccagcatatggtgcaggcgaaatcactgttctagtagaagttgcagatttagaactgcacacgaagaaaattgaagtgtcgggtctgaaattcgcaagtttgtcatgctccggatgttatgcttgcagctctggcatctcctgcaaagttaggattcatgtaaatgaaccggatgaattcacagtacatgtaaaaagtaatgacccagatgttgtagcagcaggatcaagtctcatggctagaaagatagagtctggggccgacagcacgtttaaggctttttcatcaatgccaaaaaactctctatgtttttacatagtagaaagagattattgtagcagctgtacagatgatgacactcagaaatgtgttgacattaaacttgaacatccacagagcatactcattgaacacaaaggaacgattattggcaagcagaatgacacctgtccaactaaaacaagctgctggttggaatctattaagagttttttttatgggcttaaaaacatgctgagtgggatcttcggtaatgttttcttaggcatgctcctgtttcttgctccttttatattgctaatattgtttttcttcttcgggtggagacttctcttttgccttaagtgctgtagaaggaccagaaagctgctaaagtataagcaccttagggacgaagaagagagtggttacaaaaaaatcattgaaaggctaaatgacaaaaaaggcaaaagtcgattgtttgatggagaaaggcttgcagacagaaagattgccgaactcttttcaactaaaactcatataggt

SEQ ID NO: 3834 - RNA, 2916 nt, synthetic construct
  misc_feature 1..2916: note = derived and/or modified CDS sequence (wt) from CCHFV(ArD15786, Artificial)__DQ211627.1__Gn-4aa-Gc
  source 1..2916: mol_type = other RNA
gcagagggggggagcaatgactgtgtttcaagaacccagctagtcaaaacagaggttacagaaattcatgaagacagttacggtggtcctggcgaaaaaatcacaatttgcaacggctccacaatagtggatcaaaggcttggcagcgaattaggttgctatacaataaacagagtgagaacctataagctctgtgagaacagtgccacagaaaagagctgtgaaatagacagtgttccagttaaatgcaaacaggggttctgcctcaaaataactcaggaaggtaggggtcatgtgaaattgtctagagggacagaaatcgttctggatgtctgtgatactagctgtgaactgatgatacccaaaggcactggggatatattggtggactgctcaggagggcagcaacactttttacaggacaatctaattgacttgggatgcccaaatattccattgctaggtcaaacggctatatatgtctgtagaatgtcaaaccatcccaagacaaccatggcttttctgttttggttcagttttggctatgtcatcacatgtgtagtgtgcaaggtgctcttctatttgctaattgtcatcgggacactaggaaaaaggctgaaacagtacagagagctaaagcctcaaacatgtattgtctgtgaatctatccctgtcaatgcaatagatgctgaaatgcatgatcttaactgcaactacaacatatgcccttactgtgcatccagactgacctcagatggcctcgtcaggcacgtaactcaatgtcccaaacggaaagagaaggtcgaagaaactgaactatacttaaacttggagagaataccttggttggtaagaaagctcctacaagtgtcggagtcaacaggagtggctctgaagagaagctgctggataatcacactccttattctgctgactgtttcaatgtcaccagttcagtccgcaccggtaggcagaaagccactttccttagatagtatagccaagggaatgaaaagcttgttgaactccacaagtttagaaacgagcttgtcaattgaagctccatggggggcaatcaatgttcaatcaaccttcaaaccaacaatttcagccgccaacatagcacttagctggagttcagttgaacacaagggcaacaagatcttagtttcaggcagatcagagtcaattatgaaattagaagaaagaactggaatcagctggtgtctaggtgtggaagatgcttctgaatcaaaaacactcactgtttctgttatggatctgtctcaaatgtattctcctgttttcgagtacctgtcaggtgaccgacaggtggaggagtggccaaaagcaacctgcacaggtgactgtccagaaagatgtggctgcacttcatcaacctgcctacataaggagtggccgcactcgaggaactggcgctgtaaccccacttggtgttggggggtgggaaccggctgcacctgctgtgggctagatgtaaaggatctcttcacagactacatgttggttaaatggaaagtggaatatataaaaacagaagccataatatgtgttgagcttactagtcaagagaggcagtgtagtttaattgaagcaggcacaaggtttaacctaggccctgtgacaataactctatcagaaccaaggaacgtacagcagaggcttccccccgagatcattacactgcaccctaaaatagaagaagggttttttgatttgatgcatgtgcagaaggtaatgtctgcaagcacggtttgtaagctgcaaagctgtactcacggtgtgcctggagacttacaagtctaccatgttggcaacttgttaaagggggacaaagtcaatgggcactcaatccacaagatagaatcgcacctcaacacctcatggatgtcatgggatgggtgtgatttagattatttttgcaacatgggggactggccctcatgcacatacacaggggtgacacaacacaaccgtgctgcattcatcaacatgcttaacattgagactgattacacaaaaacttttcactttcattcaaaaagggtcacagcacacggagacacccctcagttggacctaaaagcgaggccaacatatggtgcaggcgaaatcactgttctagtggaagttgcagatttagaactacacacgaagaaaattgaagtgtcgggtctgaaattcgcaagtttgacatgctctggatgttatgcttgcagctctggcatctcctgcaaagttaggattcatgtaaatgaaccggatgaattcacagtacatgtaaaaagcaatgacccagatgttgtagcagcaggatcaagtctcatggctagaaagatagagtctggggccgacagcacgtttaaggctttttcatcaatgccaaaaaactctctatgtttttacatagtagaaagagattattgtagcagctgtacagatgatgacactcaaaaatgcgttgacataaaacttgaacatccacaaagcatacttattgaacacaaaggaacgattattggcaagcaaaatgacacctgtccaactaaaacaagctgctggttggaatctatcaagagtttcttttatgggcttaaaaatatgctgagtgggatcttcggtaatattttcttaggcatgctcctgtttcttgctccttttgtattgctaatattgtttttcttcttcgggtggagacttctcttttgccttaagtgctgtagaaggactagaaagctgctaaagtataagcaccttagggacgaagaagagagtggttacaaaaaaatcattgaaaggctaaatgacaagaagggcaaaagtcgattgtttgatggagaaaggcttgcagacagaaagattgccgaactcttttcaactaaaactcatgtaggt

SEQ ID NO: 3835 - RNA, 2916 nt, synthetic construct
  misc_feature 1..2916: note = derived and/or modified CDS sequence (wt) from CCHFV(ArD39554, Artificial)__DQ211628.1__Gn-4aa-Gc
  source 1..2916: mol_type = other RNA
tcagaaagcaacaacaatgattgcgtatcaaggactcagctgatcaagacagaaaatgctgaaatacatggtgatgactatggcgggcccggagagaaaataaccatctgcaacggctctactattgtagaacaaagattaggcagcgaattaggatgctacactatcaacagaataaagtccttcaaactatgcgaaaatagtgcttcaggaaagggttgtgaaattgacagtactccagtaaaatgtaagcaaggcttctgtttgaaaataacccaagaaggaaggggtcatgttaaactttccagaggctcagagataattctagacgtttgcgactcaagctgtgaaatgatgataccaaaagggtctggtgatatcctggtagattgctctggaggacagcagcacttcctacaggacaacttggtcgacttaggatgcccaaacgttcccctactgggcaaaatggccatatacatctgcagaatgtcaaaccaccccaagacaaccatggccttcctcttttggttcagctttggctatgtcataacctgcatcttttgcaaggttatcttttatgtgctaataataattggaacattaggaaaaaggatcaaacagtacagagagcttaagcctcagacctgcactatatgtgaagcaactcctgttaatgcaatagatgctgaaatgcatgatcttaactgtagctacaacatatgcccttattgcgcatctagattaacttcagaaggtctggttaggcatgtgactcagtgtcctaagaggaaggaaaagatagaggaaacagagctgtacttaaatttggaaaggataccctggtttgtcagaaagctcttgcaggtatcagaatcaacaggggtagcgctcaagagaagcagctggctggtgacacttcttgtgttgctaacagtatctttgtcgcctgtgcaatcagcacccattggtagaaagccactttttttggacagtactgccaagagcatgaaaagcctgttaaattcaacaagtttggaaacaagcctgtcaattgaagcaccctggggggcaattaatgtacagtcaactttcaaacccaccgcttcgactgcaaatatagcgctcagttggagctcagtagaacacagaggcaataagattcttgttacaggtagatcagagtcgattatgaaactggaagaaagaacaggaatcagttggaatctcggtgtggaagatgcttctgaatcaaagacactcactgtatcagtcatggacttatctcagatgtattccactgtcttcgagtacttatcaggcgaccggcaagtagaggagtggcctaaagcaacctgcacaggtgattgtccagaaagatgtggctgtacatcatctacttgcctccacaaggcgtggccccattcaaggaactggaggtgcaaccccacgtggtgttggggagttggaactggttgcacttgctgtggattggatgtgaaaaacctctttactgactatatgcttatcaaatggaaagttgaatttataaaaactgaagccatagtgtgtgttgaactcacaagccaggaaaggcaatgcagtcttatagaagcaggcacaagatttaacttgggccctgttaccatcactttatcagaaccaagaaacattcagcagaagctccctcctgaactggttacgctgcatccaagagtagaagaaggcttcttcgaccttatgcatgtgcagaaagtgctttctgcaagcactgtgtgtaaattgcagagctgcacgcatggtgtaccaggtgacttgcaagtgtatcatgtaggcaacttgctgaaaggggataaaataaatggcaactcatttcacaaaattgagccgaacctaaatacatcatggatgtcttgggacggctgtgatcttgattactactgcaacatgggagactggccctcctgtacttacacaggtgtgacgcagcacaaccatgctgcttttgtgaacctgctcaacattgaaactgactatacaaagaacttccactttcactcaaagagagtcacagcacatggagagacgccccagctagaccttaaagccagaccaaagtatggagcaggtgaggtcacagtcctggtggaagttgctgacatggagctgcacactaaaaagattgagatatcaggtttgaaatttgctagcctgacctgcacgggctgctatgcttgtagctcaggtatctcctgcaaggttaggcttcatgtagatgagccagatgagctcacggtacacgtgaagagtgatgatccggatgtagttgcagccagctcaagcctgatggccagaaaaattgaatttggaactgatagcacatttaaagctttctcgtccatgcctaaggataaactctgcttttacattgtggaaagagactactgcagcagttgcagcaaagaggacacacaaaagtgtgtaaatgcaaaacttgagcagcctcagagtatacttattgaacataaaggcaccataattgggaagcaaaatgacacttgtacagtcaaggcgagctgttggttggaatcggtaaaaagttttttttatggactaaaaaacatgttgggtggtatcttcggcaacgttatcttgggcatcatcatgttccttgctccttttgccttgttactgctcttcttccttttcggatggagaattctgttctgccttagatgctgcagaaggactagggggctatttaagtacaaacacatcaaagatgatgaagaatcaggctacaaaaggattattgaaaggttaaataacaagaaaggtaagaacaagttatttgacggcgagagattggcagacaagaaaattgctgaactattctcaacgaagacacacattggc

SEQ ID NO: 3836 - RNA, 2916 nt, synthetic construct
  misc_feature 1..2916: note = derived and/or modified CDS sequence (wt) from CCHFV(C-68031, Artificial)__DQ211629.1__Gn-4aa-Gc
  source 1..2916: mol_type = other RNA
tccgaagagtctggtgatgactgcatatcaagaactcagctatcgaggacagagactgcggaaattcacagtgataactatggtggtccaggtgacaagataaccatctgcaatggttcaactattgtagatcagagattgggcagtgaactagggtgttacactatcaatagagtaaagtcatttaagctttgcgagaacagtgccacaggtaaatcctgtgaaatagatagcaccccaattaaatgcaggcagggtttttgtttaaaaattactcaggagggaaggggccacgtgaagctatcaagaggttcagaagttgtcttggacgcctgtgattcaagctgtgagataatgataccaaagggcactggagacatcctagttgactgttcaggtggacagcaacatttcttaaaagataacttgattgatctgggatgcccaaacatcccactattaggtaagatggctatctacatttgtagaatgtcaaatcatcctaaaacgactatggcttttcttttttggtttagctttggttatgtgataacctgtatactctgtaaggtcatcttctacctattaatagttgtggggacgttgggaaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagacggtcttgccagacatgtaatgcagtgccctaagcggaaggaaaaagtagaagaaaccgaattatacttaaacttagaaagaatcccctgggttgttaggaaattactgcaggtgtcagaatccaccggtgtggcactaaagaggagtagttggctggttgtgctacttgtgttacttacagtttcattgtcaccagtacaatcagcacctatcggcaggaaacccttgttttcagacagtattgtcaaaggcatgaagaacttgctaaattcaacaagcttagaaacaagcttatcaattgaggcaccatggggagctataaatgtccaatcaaccttcaaacctactgtgtccgctgcgaacatagctcttagttggagctcagtggaacacaggggtaataagattttggtttcaggtagatcagagtcaattatgaagctagaggaaaggacaggaatcagctgggatctaggggtagaagatgcctctgagtctaaattgcttactgtctctattatggacttgtcacagatgtattctcctgtctttgagtacctatcaggtgatagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttgtcaagtggaaagttgagtacattaaaacagaagctatagtgtgtgttgagcttactagccaagagagacaatgtagcttgattgaggcaggcacaagattcaacttaggtcctgtgaccatcacattgtcagagccaagaaacattcagcaaaagctccctccagagatagttacattgcatcccagaattgaagaaggtttctttgatttaatgcatgtaaaaaaagtgctatcagcaagtacagtatgtaagctacagagttgcacacatggtgtgccaggggacctacaggtctaccacataggaaacttgttaaaaggagacaaggtgaatgggcacctgattcacaaaattgaaccacacttcaacacttcctggatgtcttgggacggctgtgacctagactactactgtaatatgggggactggccatcttgctcatatactggagtaacccagcacaatcatgctgcatttgtaaacatgctcaacatcgaaactgattatacaaaaatcttccactttcactctaagagagttactgcacatggagacacaccacaattagatttgaaagctagaccaacttatggtgcaggtgaaatcactgtgctagtggaagttgctgacatggagttacacacaaagaaaattgagatatcaggtttaaagtttgcaagcttaacttgcacaggctgttatgcttgtagctctggtatctcctgtaaggttagaatccatgtagatgagcctgatgagcttacagtacatgtgaagagtgaagacccagacatagttgctgctagctcaagtctcatggctagaaaacttgaatttgggacagatagcacattcaaagccttttcagccatgcccaaaacctccttgtgcttttacattgtggagagagaatattgtaaaagctgcagtaaagaagatacacaaaaatgtgtcaacacaaagcttgagcaaccacagagcattttaattgagcacaaaggaacgataattggtaagcaaaacgacacctgcacatctaaagcaggctgttggctagagtcagtcaagagcttcttttatgggctaaaaaacatgcttagtggcatttttggcaatgttttcatagggattttcttattccttgctccttttatccttttaatacttttctttatgtttggatggagaatcctgttctgctttaaatgttgcagaagaactagaggcctatttaagtacagacacctcaaggacgatgaagaaaccggttacaggaaaatcattgagaggctgaacaacaaaaaagggaaaaacaaactgcttgatggtgaaagattagctgataggaagattgctgagctgttctccacaaagacacacattggc

SEQ ID NO: 3837 - RNA, 2916 nt, synthetic construct
  misc_feature 1..2916: note = derived and/or modified CDS sequence (wt) from CCHFV(Drosdov, Artificial)__DQ211630.1__Gn-4aa-Gc
  source 1..2916: mol_type = other RNA
tctgaagagccaggtgacgactgcatatcaagaactcagctattgaagacagaaacagcagagatccatgacgacaactatggtggtccaggtgacaaaataactatctgcaatggttcaaccattgtggatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaagtaatgatacctaaaggcactggagatatcctagtagactgttcaggtggacagcagcatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttactcattgataattattgggacactagggaaaaaaatcaagcaatatagggagctgaaacctcaaacttgcaccatatgtgagacagctcctgtcaatgcaatagatgctgaaatgcatgacctcaaatgtagttacaatatatgcccttattgtgcatcaagattgacctctgatgggctagctaggcatgtgacacaatgccctaagcgaaaggagaaagttgaggagactgaactgtacttgaacctggaaagaattccttggatagtcagaaagctattgcaagtgtcagagtccactggtgtagcattgaaacgaagcagttggctgattgtgctgcttgtgttactcacagtctcattgtcaccggttcaatcagcacctgttggtaggaaacctcttttcttagacagtacagttaaaggtatgaaaaatttgctaaactcaacaagcttggaaacaagcttatcaattgaggcaccatggggagcaataaatgtccagtcaacctttaaaccaacagtatcgactgcaaacatagcactcagttggagctcagtggagcacagaggcaacaagatcttggtcacaggcaggtctgaatcaattatgaaactagaggaaaggacaggagtcagctgggatctaggcgtagaagatgcctctgaatccaaattacttaccgtctccatcatggatttgtcacaaatgtattcccctgtttttgagtacttatcaggagatagacaggttgaagaatggcccaaggcaacctgtacaggtgattgcccagaaaggtgtggctgcacatcatcaacctgcttgcataaagaatggcctcactcaagaaactggagatgtaaccccacttggtgctggggagtaggaaccggctgcacatgctgcggagtggatgtaaaagacctttttacagatcacatgtttgtcaaatggaaggttgaatatatgaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtacaaaaagtgttatctgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactattgcaacatggggaattggccttcttgcacatacacaggagtgacccaacataatcatgctgcatttgtaaatttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctggtttgcacgggttgctatgcttgtagctctggcatttcctgtaaagtcagaattcatgtagatgaaccagatgagctcacagtgcatgtaaagagcagtgatccagatgtggttgcagctagcacaagccttatggcaaggaagcttgaatttgggacagatagcatattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggtgcttttctttatgtttggatggaaaatcttgttttgctttaagtgttgcaggaggaccagaggcttgtttaagtatagacacctcaaagacgatgaggaaacaggctacagaaggattattgaaagactgaatagtaaaaaaggaaaaaacagactgcttgatggtgagaggttggctgataggaaaattgctgagctgttctccacaaaaacacacattggc

SEQ ID NO: 3838 - RNA, 2916 nt, synthetic construct
  misc_feature 1..2916: note = derived and/or modified CDS sequence (wt) from CCHFV(Kashmanov, Artificial)__DQ211631.1__Gn-4aa-Gc
  source 1..2916: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtactatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtagaaaacctctgttcttagacagtatagttaaaggcatgaagaattcgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggataggataaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 3839 - RNA, 2916 nt, synthetic construct
  misc_feature 1..2916: note = derived and/or modified CDS sequence (wt) from CCHFV(Oman, Artificial)__DQ211632.1__Gn-4aa-Gc
  source 1..2916: mol_type = other RNA
tccgaagagtctggtgaagactgtatatcaaggactcagctattgaggacagaaactgcagaaatccatggtgataactatggtggtccaggtgacaaaataaccatctgcaatggttcaaccattgtagatcaaaggctgggtagtgaactggggtgttacactatcaatagggtgaagtcatttaagctatgcgaaaacagtgccacaggtaagtcctgtgaaatagataacactccagtaaaatgcaagcaaggtttttgcttgaaaataacccaagaaggaaggggccacgtgaagctttcaagagactcagaagttgtcctggacgcctgcgattcaagctgtgaaataatgataccaaagggcactggagacatcctggttgactgctcaggtgggcagcagcacttcttaaaagacaacctgattgatctgggatgccccaacatcccattattaggcaaaatggcaatctacatttgtagaatgtcaaatcatcctaaaacaactatggcttttcttttttggtttagctttggttatgtgataacctgcatactttgtaaagtcattttttatctattgatagttgttggaactttagggaaaaagtttaaacagtatagagagttaaaacctcagacctgcacaatatgtgaaacaactcctgtcaatgcaatagatgctgagatgcacgatctcaattgtagttacaatatatgtccttattgtgcatctaggttaacttcagatggtcttgccagacatgtaatgcagtgtcctaagcggaaggaaaaaatagaagaaaccgaattatacctgaacttagaaagaatcccttgggttgtcagaaaactactgcaggtgtcagaatccactggtgtagcactaaagaggagcagttggctgattgtgctacttgtgcttctcacagtttcattgtcaccagtacaatcagcacctatcggtagaaagcccttatttttagacagtattgctaagggcatgaagaacctgctgaattcaacaagcttagaaacaagcttatcaattgaggcaccatggggagcaataaacgttcaatctactttcaaacctactgtgtcaactgcaaacatagcacttagttggagctcagtggaacacagaggtaataagatcttggtttcaggcagatcagagtcaatcatgaagctagaagaaagaacaggaatcagctgggatttgggagtagaagatgcctctgagtccaaattacttactgtttccgtcatggacttatcacagatgtactctcctgtctttgagtacctatcaggtgacagacaagtagaggaatggccaaaggcaacctgtacaggcgattgcccggaaagatgtggctgcacatcatcaacctgcctacacaaggaatggcctcactcaagaaactggagatgcaaccccacttggtgttggggagtcggcaccggatgcacctgttgtggactagatgtaaaggacctttttacagattacatgtttgttaaatggaaggtcgaatatataaaaacagaggctatagtgtgtgttgagcttactagccaagaaagacaatgtagcttgattgaggcaggcacaagattcaacttaggtcctgtgactatcacattatcagagccaagaaacattcagcaaaagctccctccagaaattgtcacattacatcctagaattgaagaaggtttttttgacttaatgcatgtacagaaggtactatcagcaagcacagtgtgcaagctacagagttgcacacatggcgtaccaggagacttacaggtctaccacatcggaaacttactaaaaggagacaaagtgaacgggcatctgatacataaagttgaaccacatttcaacacctcctggatgtcttgggacggctgtgacctagattactactgcaatatgggggattggccctcttgcacgtatactggagttacccaacataatcatgctgcatttgtaaacctacttaacattgaaactgattacacaaagaacttccactttcactctaagagagtcactgcacatggggacactccacaattagatttaaaagccagaccaaattatggtgcaggtgaggtcactgtgctggtggaagttgctgacatggagttacacacaaagaaaattgagatatcaggtttgaagtttgcaagcctaacttgcacaggttgttatgcttgtagctctggcatctcatgtaaggttaggatccatgtagatgaaccagatgagcttacagtacatgtgaagagtgaagacccagacatagttgctgctagctcaagtctcatggcaagaaagcttgaattcgggacggatagtacattcaaagccttctcagccatgcctaaaacctccttgtgcttttacattgttgagagagaatactgtaaaagctgcagtaaagaagacacacaaaagtgtgttaacgcaaagcttgagcgaccacagagcattttaattgagcacaaaggaacgataattggaaagcagaacgacacttgcacagctaaagcaagctgctggctagagtcagtcaagagtttcttttatggactaaagaacatgcttagtggcatttttggcaatgttttcatagggattttcttattccttgctccttttatcctgttaatacttttctttatgtttgggtggagaatcctattctgctttaagtgctgcaggagaactagaggcctatttaagtacagacacctcaaagatgatgaagaaaccggttataggaaaatcattgagagactaaacaacaaaaaaggtaaaaacaagctgcttgacggtgaaagattagctgatagaaagatcgctgagctgttctctacaaaaacacacattggc

SEQ ID NO: 3840 - RNA, 2916 nt, synthetic construct
  misc_feature 1..2916: note = derived and/or modified CDS sequence (wt) from CCHFV(SPU97/85, Artificial)__DQ211633.1__Gn-4aa-Gc
  source 1..2916: mol_type = other RNA
tccgaggagtctgatggtgactgtatatcaagaactcaactattgaggacagagactgcagaaatccacagtgacaactatggtggcccaggtgacaaaataactatctgcaatggttcaactattgtagatcaaagactaggcagtgaactggggtgttatactatcaatagggtaaagtcatttaagctttgcgaaaacagtgccacaggaaaatcttgtgaaatagatagcaccccagttaagtgcagacaaggtttttgcttgaaaatcactcaagaagggaggggccacgtgaagctgtcgagaggctcagaaattgtcttggacgcctgcgattcaagctgtgaaataatgataccaaagggcaccggagacatcttagttgactgttcaggtggacaacaacatttcttaaaagataatttgattgatcttggatgtcccaatatcccattattaggcagaatggccatctacatttgcagaatgtccaatcatcctaaaacaaccatggcctttctcttttggtttagctttggttatgtgataacctgtatcctttgtaaggtgatcttttacctattgatagttgcagggacagtagggaaaaagttcaaacagtatagagagttgagacctcagacctgcaccatatgtgaaacaactcctgtcaatgcaatagatgctgaaatgcatgacctcaactgcagttacaatatatgtccttattgcgcatctagattaacctcagatggtcttgccagacatgtaatgcaatgccccaagcggaaggaaaaaatagaggaaactgaattatacttaaacctagaaaggattccctgggttgttaggaaattattgcaagtttcagagtctaccggtgtggcattgaagaggagcagttggctgacagtgctgcttgtgttgcttatagtttcattgtcaccggtgcagtcagcacctattggtagaaaacccttatttttagacagtattgttaaaggcaagaagaacttgctaaactcaacaagcttggaaacaagcttatcaattgaagcaccatggggtgcaataaatgtccaatcaaccttcaaacctactgtgtcagctgcaaacatagcacttagctggagctcagtggaacacagaggcaacaagattttggtttcaggcaggtcagaatcaatcatgaagctggaggaaaggacaggaatcagctgggatctgggagtagaagacgcctctgagtccaaattgctcaccgtctctgtcatggacttgtcacagatgtattcccccgtctttgagtacctgtcaggtgatagacaggtagaagagtggcccaaggcgacctgtacaggcgattgcccagaaagatgtggctgcacatcatcaacctgtttgcacaaggaatggccccattcaaggaactggagatgcaaccccacttggtgttggggggtcggcactggatgcacctgttgtggactagatgtaaaagacctctttacagattacatgtttgtcaagtggaaagttgaatacataaaaacagaggccatagtgtgcgtcgaacttactagccaagaaagacaatgtagcttgattgaagcaggcacaagattcaatttaggtcctgtgactatcacattgtcagagccaagaaacattcagcaaaagctccctccagagataatcacattgcatcctagaattgaagaaggcttttttgacttaatgcatgtgcaaaaagtgctgtcagcaagcacagtgtgcaagctacagagttgcacacatggtgttccaggagacctacaggtctaccacatcggaaacttgttaaaaggagacaaggtaaacgggcatctgattcacaagattgaaccacatttcaacacttcctggatgtcttgggatggctgtgacctagactactactgcaatatgggggactggccttcttgcacatacactggagtaacccaacataaccatgctgcatttgtaaatttgctcaatatcgaaaccgattatacaaaaaactttcattttcactccaagagagttactgcacatggagacacaccacagttagacttgaaggccagaccaacttatggtgcaggggaggtcactgtactagtggaggttgctgacatggagttgcacacaaagaaaattgagatatcaggcttgaagtttgcaagcctatcttgcacaggctgctatgcttgtagctctggtatctcctgtaaggtcaggatccatgtagatgaaccagatgagcttacagtacatgtgaagagtgaagacccagacatagttgctgcaggctcaagtctcatggcaaggaagcttgaatttggggcagatagtacattcaaagccttttcagccatgcccaaaacctccttgtgcttttacattgtggagagagaatactgtaagagctgcagtagagaagacacacaaaaatgtgttaacactaaacttgagcgaccacagagcattttgatcgaacataaaggaacgattattggaaagcaaaacgacacttgcacagctaaagcaagctgctggctagagtcagtcaaaagttttttctacggattaaagagtatgcttagtggcatttttggcaacgttttcatagggattttcttattcattgctccttttgtcctgttaatacttttctttatgtttgggtggaggattctgttctgctttaagtgctgcagaagaaccaggggcctatttaagtacagacacctcaaggacgatgaagaaaccggttacaggaaaatcattgagaggctaaataacaaaaagggaaaaaacaaactacttgatggggaaaggctagctgacaggaaaatcgccgagttattctccacaaaatcacatatcggc

SEQ ID NO: 3841 - RNA, 2916 nt, synthetic construct
  misc_feature 1..2916: note = derived and/or modified CDS sequence (wt) from CCHFV(SPU103/87, Artificial)__DQ211634.1__Gn-4aa-Gc
  source 1..2916: mol_type = other RNA
tccgaggagtctagcgacgactgtatatcaagaactcaactattgaggacagagactgcagagatccacggcgataactatggtggcccaggtgacaagataaccatctgcaatggctcaactattgtagaccagagactgggtagtgagctggggtgttacactatcaatagagtaaagacattcaaactatgcgaaaacagtgctacagggaagagttgtgaaatagatagtgtcccagttaaatgcaggcagggttattgcctaaaaatcactcaggaaggaaggggtcatgtaaaattatctagaggctcagaggttgtcttagatgcatgtgacacaagctgtgaagtaatgatacccaaaggcactggtgacatcctagttgactgttcaggtgggcagcaacattttctgaaagacaatctgatagatctaggatgccccaaaattccattgctgggtaaaatggctatttatatttgcagaatgtcgaatcaccccaaaacaactatggctttcctcttctggttcagctttggctatgtgataacttgtgtactttgcaaggccattttttacttgttaataattgttggaacactaggaaaaaggctcaagcagtacagagagttaaaacctcagacctgcaccatatgtgagacaactcctgtgaatgcaatagatgctgagatgcatgacctcaattgcagttacaacatatgtccctattgtgcatctagactaacctcagacgggcttgctaggcatgtgacacagtgccctaagcggaaggaaaaagtggaggaaactgaattgtacttgaacttggaaagaattccttgggttgtgagaaggctgttgcaggtatcagagtccactggtgtggcattgaaaagaagcagctggctgattgtgctactggtgctgttcacggtttcattgtcaccggttcagtcagcgcccattagtagaagacccctattcttagataatatagttaaaggcatgaaaaatttgctaaactcaacaagtttggagacaagtttatcaattgaggcaccatggggagcaataaatgttcagtcaacctacaaaccaactgtatcaactgcaaacatagcgcttagttggagctcagtagaacacagaggcaataagatactggtttcgggcagatcagaatcaattatgaagctggaagaaaggacaggaataagctgggatctcggtgtagaagacgcctctgagtctaaactgcttacagtctctgtcatggacttgtcacagatgtactcacctgtcttcgagtacttatcaggagacagacaggtggaagagtggcccaaagcaacttgtacgggtgattgcccagaaagatgtggctgcacatcatcaacctgcttacataaagaatggccccattcaaggaattggagatgtaaccccacttggtgctggggtgtagggactggctgcacctgttgtggattagacgtgaaagacctctttacagattatatgtttgtcaagtggaaaattgaatacattaaaacagaagcaatagtgtgtgtagaacttactagtcaggaaagacagtgtagcttgattgaagcgggcacaaggttcaatttgggtcccgtgaccatcacattgtcagaaccaagaaacatccagcaaaagctcccttctgaaataatcacactgcatcccaggattgaggagggtttttttgacctgatgcatgtacaaaaagtgttgtcggcaagcacagtgtgtaagttgcagagttgcacacatggtgtgccaggagatctacaggtctaccacatcggaaatttattaaaaggggataaggtaaatggacacctagttcataaaattgagccacacttcaatacttcttggatgtcctgggatggttgtgatctagactattattgcaacatgggagattggccttcttgcacatacacaggagttacccagcacaatcatgcttcatttgtaaacctgctcaacattgaaactgattacacaaaaaacttccactttcactctaaaagggtcactgcacacggagacacaccacaactggatcttaaggcaagaccaacctatggtgcaggtgagatcactgtattggtggaagttgctgacatggagttacacacaaagaagattgaaatatcaggcttaaaatttacaagcctgacttgtacaggctgttatgcttgtagttctggcatctcatgcaaagttagaattcatgtggatgaaccagatgaacttacagtgcatgttaaaagtgatgatccagatgttgttgcagctagctcaagtctcatggcaagaaagcttgaatttggaacagacagtacatttaaggctttttcagccatgcctaaaacttctctatgtttctacattgtggaaagagaatactgtaagagctgcagtgaagaagacacacaaaaatgtgttaacacaaaacttgagcagccacagagcattttgatcgaacataagggtactataatcgggaagcaaaacaacacttgcaaggctagggcgggttgctggttagagtcagttaagagttttttttacggcctaaagaacatgctcagtggcatttttggcaatgtatttataggcattttcttatttcttgcccccttcatcctattaatactattctttatgtttgggtggaggatcttgttttgttttaagtgttgtagaagaactagaggcctgttcaagtatagacacctgaaagacgatgaagaaactggttatagaaagatcattgaaagactaaacaacaaaaaagggaaaaataaactgcttgatggtgaaagacttgctgatagaagaattgccgaactgttctctacaaaaacacacattggc

SEQ ID NO: 3842 - RNA, 2916 nt, synthetic construct
  misc_feature 1..2916: note = derived and/or modified CDS sequence (wt) from CCHFV(SPU415/85, Artificial)__DQ211635.1__Gn-4aa-Gc
  source 1..2916: mol_type = other RNA
tccgaggagtctgatggtgactgtatatcaagaactcaactattgaggacagagactacagaaatccacagtgacaactatggtggcccaggtgacaaaataactatctgcaatggttcaactattgtagatcaaagactaggcagtgaactggggtgttatactatcaatagggtgaagtcatttaagctttgcgaaaacagtgccacaggaaaatcttgtgaaatagatagcaccccagttaagtgcagacaaggtttttgcttgaaaatcactcaagaagggaggggccacgtgaagctgtcgagaggctcggaaattgtcttggacgcttgcgattcaaactgtgaaataatgataccaaagggcaccggagacatcttagttgactgttcaggtggacaacaacatttcttaaaagataatttgattgatcttggatgtcccaatatcccattattaggcaaaatggccatctacatttgcagaatgtccaatcatcctaaaacaaccatggcctttctcttttggtttagctttggttatgtgataacctgtatactttgtaaggtgatcttttacctattgatagttgcagggacagtaggaaaaaagttcaaacagtatagagagttgagacctcagacctgcaccatatgtgaaacaattcctgtcaatgcaatagatgctgaaatgcatgacctcaactgcagttacaatatatgtccgtattgcgcatctagattaacctcagatggtcttgccagacatgtaatgcaatgccctaagcggaaggaaaaagtagaggaaactgaattatacttaaacctagaaaggattccctgggttgttaggaaattattgcaagtttcagagtctaccggtgtggcattgaagaggagcagttggctgacagtgctgcttgtgttgcttatagtctcattgtcaccggtgcagtcagcacctattggtagaaaacccttatttttagacagtattgttaaaggcatgaagaacttgctaaactcaacaagcttggaaacaagcttatcaattgaggcaccatggggtgcaataaatgtccaatcaaccttcaaacccactgtgtcagctgcaaacatagcacttagctggagctcagtggaacacagaggcaacaagattttggtttcaggcaggtcagaatcaatcatgaagctggaggaaaggacaggaatcagctgggatctgggagtagaagacgcctctgagtccaaattgctcaccgtctctgtcatggacttgtcacaaatgtattcccccgtctttgagtacctgtcaggtgatagacaggtagaagagtggcccaaggcgacctgtacaggcgattgcccagaaagatgtggctgcacatcatcaacctgtttgcacaaggaatggccccattcaaggaactggagatgcaaccccacttggtgttggggggtcggcactggatgcacctgttgtgggctagatgtaaaagacctctttacagattacatgtttgtcaagtggaaagttgaatacataaaaacagaggccatagtgtgtgtcgaacttactagccaagaaaggcaatgtagcttgattgaagcaggcacaagattcaatttaggtcctgtgactatcacattatcggagccaagaaacattcagcaaaagctccctccagaaataattacattgcatcctagaattgaagaaggcttttttgacttaatgcatgtgcaaagagtgctgtcagcaagcacagtgtgcaagctacagagttgcacacatggtgtgccaggagacctacaggtctaccacatcggaaacttgttaaaaggagacaaggtaaacgggcatctgattcacaagattgaaccacatttcaacacttcctggatgtcttgggatggctgtgacctagattactactgcaatatgggggattggccttcttgcacatacactggagtaacccaacataaccatgctgcatttgtaaatttgctcaatatcgaaaccgattatacaaaaaactttcattttcactccaagagagttactgcacatggagacacaccacaattagacttgaaggccagaccaacttatggtgcaggggaggttactgtactagtggaggttgctgacatggagctgcacacaaagaaaattgagatatcaggcttgaagtttgcaagtctaacttgcacaggctgctatgcttgtagctctggtatctcctgtaaggtcaagatccatgtagatgaaccagatgagcttacagtacatgtgaagagtgaagacccagacatagttgctgcaggctcaagtctcatggcaaggaagcttgaatttggggcagatagtacattcaaagccttttcagccatgcccaaaacctccttgtgcttttatattgtggagagagaatactgtaagagctgcagtagagaggacacacgaaaatgtgttaacactaagcttgatcgaccacagagcattttgatcgaacataaaggaacgattattggaaagcaaaacaacacatgcacagctaaagcaagctgctggctagagtcagtcaaaagttttttctacggattgaagaatatgcttagtggcattttcggtaatgttttcatagggattttcttattcattgctccttttgtcctgttaatacttttctttatgtttgggtggaggatcctgttctgctttaagtgctgcagaagaaccagaggcctatttaagtacagacacctcaaggacgatgaagaaaccggttacaggaaaatcattgagaggctaaataacaaaaagggaaaaaacaaactacttgatggggaaaggctagctgataggaaaatcgccgagttattctccacaaaatcacatatcggc

SEQ ID NO: 3843 - RNA, 2916 nt, synthetic construct
  misc_feature 1..2916: note = derived and/or modified CDS sequence (wt) from CCHFV(Turkey200310849, Artificial)__DQ211636.1__Gn-4aa-Gc
  source 1..2916: mol_type = other RNA
tccgaagagccaggtgatgactgcatatcaagaactcagctattgaggacagaaacagcagagatccatgatgacaactatggtggtccaggtgataaaataactatctgcaacggttcaaccattgtagatcagagactgggcagtgaactagggtgttataccatcaacagggtgaagtcattcaagctatgcgaaaacagcgccacagggaaaacctgtgaggtagacagcactccggttaagtgcaggcaaggtttttgtttaaaaatcacccaagagggaaggggccacgtaaaattatctagaggctcagaggttgtcctggatgcttgcgactcaagctgtgaagtaatgatacctaaaggcactggggatatcctagtggactgttcaggtgggcagcaacatttcttaaaagacaacttaattgacctagggtgcccccatatcccgctattgggtaagatggctatttacatttgcagaatgtcaaatcatcctagaacaaccatggcttttctcttctggttcagctttggctatgttatcacctgtatatcttgcaaggctcttttttattcattgataattattggaacactaggaaaaaagatcaagcaatatagggaactgaaacctcaaacctgcaccatatgtgagacagctcctgtcaatgcaatagatgctgaaatgcatgacctcaactgtagttacaatatatgcccttattgtgcatcaagattgacctccgatgggctagccaggcatgtaacgcaatgccccaagcggaaagagaaggttgaagagactgaactgtacctgaacctggaaagaattccttggattgtcagaaagctattgcaggtgtcagagtccactggtgtggcattaaaacgaagcagctggctgattgtactgcttgtgttactaacagtttcattgtcaccggttcaatcagcacctgttggtagaaaacctcttttcttggacagtatagttaaaggtatgaaaaatttgctaaactcaacaagcttggaaacaagcttatcaattgaggcaccatggggagcaataaatgtccagtcaacctttaaaccagctgtatcgactgcaaacatagcactcagttggagctcagtggagcacagaggcaacaagatcttagtcacaggcaggtctgaatcaattatgaaactggaggaaaggacaggagtcagctgggatctaggtgtagaagatgcctctgaatccaaattacttaccgtttctatcatggatttgtcacaaatgtattctcctgtttttgagtacttgtcaggagacagacaggttgaagaatggcccaaagcaacttgtacaggtgattgcccggagaggtgtggttgcacatcatcaacctgcttacataaagaatggcctcactcaagaaactggagatgtaatcccacttggtgctggggagtaggaaccggctgcacctgctgcggggtggatgtaaaagatctttttacagatcacatgtttgtcaaatggaaagttgaatacataaaaactgaagctatagtatgtgttgaactcaccagccaagaaagacagtgcagtctgattgaggcaggtactagattcaacttgggccctgtgactattaccctgtctgagccaagaaacattcagcagaagcttcctcctgagattatcacgttgcatcccaaaattgaagaaggcttctttgacttgatgcatgtacaaaaagtgttgtctgcaagtacagtgtgtaaactgcagagttgcacacatggtataccaggagatctacaagtttaccacattggcaacttgttgaaaggggatagagtaaacgggcatctaattcacaaaattgaatcacatttcaacacctcttggatgtcctgggatggttgtgacttagactactactgcaacatgggggattggccatcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgaaatatcaggcttgaaatttgcaagtctggcttgcacgggttgctatgcttgtagctctggcatctcctgtaaagttagaattcatgtagatgaaccagatgagctcacagtacatgtaaagagcagtgatccagatgtggttgcagctagcacaagtctcatggcgaggaagcttgaatttgggacagacagcacattcaaggccttttcagctatgcccaaaacctctttatgtttttacattgtggagagagaatactgcaagagctgcagtgaagatgatacacaaaaatgtgttgacacaagacttgagcagccacagagcatactaattgagcacaaaggaacgataattggaaagcagaatgatacttgcacagccaaggcaagctgttggttagagtcagtcaagagttttttttatggattgaagaatatgcttggcagtgtttttggtaatcttttcataggcattttgttattccttgccccttttgtcctgttggtgcttttctttatgtttgggtggaaaatcttgttttgctttaaatgttgcaggaggaccagaggcttatttaagtatagacacctcaaagacgatgaggaaacaggctacagaaggattattgaaagactgaacagcaaaaaagggaaaaacaggctgcttgatggtgatagactggctgataggaaaattgctgagctgttctccacaaaaacacacattggc

SEQ ID NO: 3844 - RNA, 2916 nt, synthetic construct
  misc_feature 1..2916: note = derived and/or modified CDS sequence (wt) from CCHFV(Iran-52, Artificial)__DQ446215.1__Gn-4aa-Gc
  source 1..2916: mol_type = other RNA
tccgaagaatctggtgatgactgcatatcaagaactcagctattgaggacagagactgcagaggtccatggcgataactatggtggtccaggtgataagataaccatctgtaatggttcaactgttgtagatcaaagactgggtagtgaactggggtgttacactatcaatagagtgaggtcattcaagctatgcgaaaacagtgccacagggaagagctgtgaaatagacagtatcccagtcaagtgtaagcagggttattgcctaaaaatcactcaggaaggaaggggccatgtgaagttatctagaggctcagaagttgtcttggatgtatgtgattcaagctgtgaagtgatgatacctaagggcactggtgacattctagtagattgttcaggtgggcagcaacattttttaaaagacaacctggttgacctagggtgtcccaaaattccgttactgggcaaaatggctatttatatctgcaggatgtcgaatcaccccaagacaaccatggccttcctcttttggttcagctttggctatgtgataacttgtatactttgcaaggccatttttttcttattaataatttttggaacactagggaaaaggttcaagcagtacagagagttgaaaccccagacctgcaccatatgtgagacaacacctgtaaatgcaatagatgctgaaatgcatgatctcaactgcagttacaatatatgtccctattgtgcgtctagactgacttcagatgggcttgctaggcatgtgacacaatgtcctagacggaaggagaaagtggaggaaaccgaattatacctgaatttagagagaattccctgggttgtaagaaagctattgcaggtgtcagagtccactggtacagtattaaaaaggagcagctggctaattgtattacttgtgctgttcacagtttcattgtcaccagttcaatcagcacccattggtagaaggcccctatttctagatagtatagtcaaaggtatgaaaaatctgctaaactcaacaagtctagaaacaagcttatcaattgaggcaccatggggagcaattaatgttcagtcaacctacaaaccaactgtatcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagtcatggacttgtctcagatgtactctcctgtcttcgagtacttatcaggtgacagacaagtggaagagtggcctaaagcaacctgcacaggtgactgcccagaaagatgtggctgcacatcatcaacctgcttacacaaagagtggccccactcaaggaattggagatgtaatcctacttggtgctggggtgtagggactggctgcacctgttgtggtttagatgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagaaccaaggaacattcaacaaaagctccctcctgaaataatcacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacctgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacagctagatctgaaggcaaggccaacctatggtgcaggtgagatcaccgtgctggtggaagttgctgacatggagttacacacaaagaagattgaaatatcaggcttaaaatttgcaggcctaacttgcacaggttgttatgcttgtagttctggcatctcttgtaaagttagaattcatgtagaggaaccagatgaacttacagtacatgttaaaagtgatgacccagatgtagttgcagctagctcaagtctcatggcgaggaagcttgagtttggaacagacagtacatttaaagctttctcagccatgcctaaaacctccctatgtttctacattgtggaaagagaatactgtaagagctgcagtaaagaagatacacaaaaatgtgttaacacgaaactcgaacaaccacagagcattttgatcgaacataagggaactataattggaaagcaaaacaatacttgcacggctaaagcgagttgctggttagagtcagttaagagttttttttatggtctgaagaatatgctcggtggcatatttggcaatgtttttataggcattttcacatttcttaccccctttatcttgttaatacttttctttatgtttgggtggaggatcctgttttgcttcaagtgttgcagaagaaccagaggcctattcaagtacagacacctcaaagacgatgaagaaactggttacagaaagatcattgaaagactgaacaacaaaaagggaaaaaacaggctgcttgatggtgaaagacttgctgacagaaagattgctgaactgttctccacaaaaacacacattggc

SEQ ID NO: 3845 - RNA, 2916 nt, synthetic construct
  misc_feature 1..2916: note = derived and/or modified CDS sequence (wt) from CCHFV(Iran-53, Artificial)__DQ446216.1__Gn-4aa-Gc
  source 1..2916: mol_type = other RNA
tccgaagaatctggtgatgactgcatatcaagaactcagctattgaggacagagactgcagaggtccatggcgataactatggtggtccaggtgataagataaccatctgtaatggttcaactgttgtagatcaaagactgggtagtgaactggggtgttacactatcaatagagtgaggtcattcaagctatgcgaaaacagtgccacagggaagagctgtgaaatagacagtatcccagtcaagtgtaagcagggttattgcctaaaaatcactcaggaaggaaggggccatgtgaagttatctagaggctcagaagttgtcttggatgtatgtgattcaagctgtgaagtgatgatacctaagggcactggtgacattctagtagattgttcaggtgggcagcaacattttttaaaagacaacctggttgacctagggtgtcccaaaattccgttactgggcaaaatggctatttatatctgcaggatgtcgaatcaccccaagacaaccatggccttcctcttttggttcagctttggctatgtgataacttgtatactttgcaaggccatttttttcttattaataatttttggaacactagggaaaaggttcaagcagtacagagagttaaaaccccagacctgcaccatatgtgagacaacacctgtaaatgcaatagatgctgaaatgcatgatctcaactgcagttacaatatatgtccctattgtgcgtctagactgacttcagatgggcttgctaggcatgtgacacaatgtcctagacggaaggagaaagtggaggaaaccgaattatacctgaatttagagagaattccctgggttgtaagaaagctattgcaggtgtcagagtccactggtacagtgttaaaaaggagcagctggctaattgtattacttgtgctgttcacagtttcattgtcaccagttcaatcagcacccattggtagaaggcccctatttctagatagtatagtcaaaggtatgaaaaatctgctaaactcaacaagtctagaaacaagcttatcaattgaggcaccatggggagcaattaatgttcagtcaacctacaaaccaactgtatcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagtcatggacttgtctcagatgtactctcctgtcttcgagtacttatcaggtgacagacaagtggaagagtggcctaaagcaacctgcacaggtgactgcccagaaagatgtggctgcacatcatcaacctgcttacacaaagagtggccccactcaaggaattggagatgtaatcctacttggtgctggggtgtagggactggctgcacctgttgtggtttagatgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagaaccaaggaacattcaacaaaagctccctcctgaaataatcacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacctgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacagctagatctgaaggcaaggccaacctatggtgcaggtgaggtcaccgtgctggtggaagttgctgacatggagttacacacaaagaagattgaaatatcaggcttaaaatttgcaggcctaacttgcacaggttgttatgcttgtagttctggcatctcttgtaaagttagaattcatgtagatgaaccagatgaacttacagtacatgttaaaagtgatgacccagatgtagttgcagctagctcaagtctcatggcgaggaagcttgagtttggaacagacagtacatttaaagctttctcagccatgcctaaaacctccctatgtttctacattgtggaaagagaatactgtaagagctgcagtaaagaagatacacaaaaatgtgttaacacgaaactcgaacaaccacagagcattttgatcgaacataagggaactataattggaaagcaaaacaatacttgcacggctaaagcgagttgctggttagagtcagttaagagttttttttatggtctgaagaatatgctcggtggcatatttggcaatgtttttataggcattttcacatttcttaccccctttatcttgttaatactcttctttatgtttgggtggaggatcctgttttgcttcaagtgttgcagaagaaccagaggcctattcaagtacagacacctcaaagacgatgaagaaactggttacagaaagatcattgaaagactgaacaacaaaaagggaaaaaacaggctgcttgatggtgaaagacttgctgacagaaagattgctgaactgttctccacaaaaacacacattggc

SEQ ID NO: 3846 - RNA, 2916 nt, synthetic construct
  misc_feature 1..2916: note = derived and/or modified CDS sequence (wt) from CCHFV(Kosova Hoti, Artificial)__EU037902.1__Gn-4aa-Gc
  source 1..2916: mol_type = other RNA
tccgaagagccaggtgatgattgcatatcaaggactcagctattgaggacagaaacagcagagatccatgacgataactatggtggtccaggtgacaaaataactatctgcaatggttcaaccattgtagatcagagactgggcagtgaactagggtgttacaccatcaacagggtgaagtcattcaagctatgcgaaaacagcgccacagggaaaacctgtgagatagacagcactccagttaagtgcaggcaaggtttttgtttaaaaatcacccaaaagggaaggggccacgtaaaattatctagaggctcagaggttgtcttggacgcttgcgactcaaactgtgaagtaatgatacctaaaggcactggagatatcctagtggactgttcaggtggacagcagcatttcttaaaagacaacttgattgacctggggtgccctcatatcccactattgggtaagatggccatttacatttgcagaatgtcaaatcatcctaaaacaaccatggcttttctcttctggttcagctttggttatgtgatcacctgtatattttgcaaggctcttttttattcattgataattattgggacactaggaaaaaagatcaagcaatatagggaactgaaacctcaaacttgcaccatatgtgaaacagctcctgtcaatgcaatagatgctgaaatgcatgacctcaactgtagttacaatatatgcccttattgtgcatcaagattgacctccgatgggctagctaggcatgtaaagcaatgccctaagcgaaaggagaaagtcgaggagactgagctgtacctgaacctggaaagaattccttgggtcgtcagaaagctattgcaagtgtcagagtccactggtgtggcattgaaacgaagcagttggctgattgtgctgcttgtgttactcacagtttcattgtcaccggttcaatcagcacctgttggtaggaaacctcttttcttagacagtatagtcaaaggtatgaaaaatttgctaaactcaacaagcttagaaacaagcttatcaattgaggcaccatggggagcaataaatgtccagtcaaccttcaaaccaacagtgtcgactgcgaacatagcactcagttggagctcagtggaacacagaggcaacaagatcttagtcacaggcaggtctgagtcaattatgaaactagaggaaaggacaggaatcagctgggatctaggcgtagaagatgcctctgaatccaaattacttaccgtctctatcatggatttgtcacagatgtattccccagtttttgagtacttgtcaggggacagacaggttgaagaatggcccaaagcaacttgcacaggtgactgcccacaaaggtgtggctgcacatcatcaacctgcttgcataaagaatggcctcattcaagaaactggagatgtaatcccacttggtgctggggagtgggaactggctgcacctgctgcggggtggatgtaaaagacctttttacagatcacatgtttgtcaaatggaaggttgaatatataaaaactgaagccatagtgtgtgttgagctcaccagccaagaaagacagtgcagtctgattgaggcaggtactagattcaacttgggccctgtgactattaccctgtctgagccaagaaacattcagcagaagctcccccctgagatcattacgttgcatcccaaaattgaggaaggcttctttgacttgatgcatgtacaaaaagtgttgtccgcaagtacagtgtgtaaactgcagagttgcacacatggtataccaggagatctacaagtttaccacattggcaatttgttgaaaggggatagagtgaacgggcatctaattcacaaaattgaaccacatttcaacacctcttggatgtcctgggatggttgtgacttagactactactgcaacatgggggactggccttcttgtacatacacaggagtgacccagcataatcatgctgcatttgtaaacttgctcaacattgaaactgattacacaaaaaccttccacttccactctaaaagagtcacagcacatggtgacacaccacaattggacttaaaagcaaggccgacctacggtgcaggagagatcactgtgctggttgaggttgctgacatggagttgcataccaagaaagttgagatatcgggcttgaaatttgcaagtctggcttgcacaggttgctatgcctgtagctctggtatctcctgtaaagtcaggattcatgtagatgaaccagatgagctcacagtgcatgtaaagagcagtgatccagatgtggttgcagctggcacaagcctcatggcaaggaagcttgaatttgggacagacagcacattcaaggccttttcagctatgcccaaaacctctttatgtttttacattgtggagaaagaatactgcaagagctgcagtgaagatgatacaaaaaaatgtgttgacacaaaacttgagcagccacagagcatactaattgagcacagagggacgataattggaaagcagaatgatacttgcacagccaaggcaagctgttggctagagtcagtcaagagttttttttatggattgaagaatatgcttggcagtgtttttggtaattttttcataggtattttgttattccttgccccttttgtcctgttggtgcttttctttatgtttggatggaaaatcttgttttgctttaaatgttgcaggaggaccagaggcttgtttaagtatagacacctcaaagacgatgaggaaacaggctacagaaggattattgaaaggctgaacaacaaaaaagggaaaaatagactgcttgatggtgaaaggttggctgataggaaaattgccgagctgttttccacaaaaacacacattggc

SEQ ID NO: 3847 - RNA, 2916 nt, synthetic construct
  misc_feature 1..2916: note = derived and/or modified CDS sequence (wt) from CCHFV(YL04057, Artificial)__FJ562094.1__Gn-4aa-Gc
  source 1..2916: mol_type = other RNA
gcagaaggaggaagcagtgactgcatttcaagaactcagctagttaaaacagaggttgcagaaattcatgaggacagttacggtgggcctggtgagaaaataacaatctgcaatggttccacaattgtagatcaaaggcttggtagggaattgggctgttatacaatcaacagagtaagatcctacaagctatgcgagaacagtgcctcagggaaaagctgtgaaatagatagcatcccagtcaaatgcaaacaagggttttgcctcaaaataacccaagaaggaagaggtcatgtaaaactgtccagagggacagaaattgttctagatgtctgtgattccagctgtgagctgatgatacctaagggcactggagacattttagtggattgctcaggagggcagcagcattttttacaaaacaatctgattgacttgggatgccccaatgtcccactactgggtaaaatggccatatatgtctgcaggatgtcaaaccacccaaaaactaccatggcatttctgttctggttcagctttggctatgtcattacatgtatagcatgcagggtactcttctacttgctgattgccatcggaacagtagggaaaaagctaaaacagtatagagagctgaaaccacaaacatgcattgtttgtgaatctgtccctgttaatgcaatagatgctgaaatgcatgagcttaattgcagttacaatatatgcccatactgtgcatctagactgtctacagacgggctcatcaggcacgtaactcagtgtcccaaacggagggagaaggtggaagagactgagctattcttgaacttggaaagaataccttggctggtgagaaagctccttcaagtatcagagtcaacaggaatggctctaaagaggagctgttggatgatcacactcctcattctactattggtttcgatatcaccagtccaatctgcaccggtaggcaggaagccactcttcctggatagcatagccaagggaaagaaaagcctgttgaactccacaagcttagaaactagtctgtcaattgaagctccgtggggagcaatcaatgttcagtcaactttcaaaccaacagtttcagctgctaacatagcacttagctggagttcagttgaacacaggggcaacaaaattttagtttcaggtagatcagagtcaatcatgaaattagaagaaagaacaggagtcagctggaatctgggtgtagaagatgcttctgagtcaaagacgctcactgtttccgtcatggacctgtcacaaatgtactctcctgtttttgagtacttgtcaggtgacagacaagtggaggaatggccaaaggcaacttgcacaggtgactgtccagagagatgcggctgcacttcgtcaacctgcttacataaagagtggccacattcaagaaactggcgatgtagtcctacctggtgttggggggtggggactggctgcacttgctgtgggctggatgttaaggatttttttactgactacatgctggtaaaatggaaagtggaatatataaagacagaagctatagtgtgtgtcgagctgactagtcaagagaggcagtgtagtttaattgaagcaggcacaagatttaacctaggccctgtaacaataacactatcagagccaagaaatgtccagcagaggcttcctcccgaaattgtaacactgcatcctaaaatagaggaaggtttttttgatttgatgcatgtacaaaaaatactgtctgcaagcacagtttgcaagctacagagctgcacacacggtgtgccgggcgattttcaggtctaccatgtcggtaacctgctgaggggagacaaggttaatggacactcaattcacaagatagaaccacattttaatacttcatggatgtcatgggatggttgcgatctggactatttctgcaatatgggggactggccttcatgcacatacactggagtaacacagcataaccgtgctgcatttatcaacatgctcaacattgagactgactatacaaaaactttccactttcattcgaagagggtcacggcacatggagatactccccagctagacctgaaagcgagaccggcatatggtgctggcgaggtcactgttctagtggaggttgcagacttggagttgcacacaaagaaacttgaagtgtcaggtttgaaaattgcaagtttgacctgctctgggtgttatgcctgcagctctggcatctcctgcaaagttagaatccatgtaaatgaaccagatgaattcacagtacatgtaagaagtagcgacccagatgttgtagcagcaggatcaagtcttatggcaaggaaaatagagtttggggctgacagtacattcaaggccttttcatcaatgcccaaggactccttatgcttttacatagtagaaaaggattactgcagcagctgcaccgacgatgacacacaaaagtgtgtcaacacgaagcttgaccatccacagagcatactcattgagcacaaaggaacaataattggcaagcaaaatgacacttgttcgaccaagacaagctgctggctagaatcagttaagggttttttctatgggctcaaaaacatgctgagtggcatctttggaaatgtttttttaggcatcctcttattccttgctccttttgtactactgatattttttttcttttttgggtggaggcttctgttttgtctcaaatgttgcagaagaactagaggactgttgaaatataagcaccttaaggacgaagaggaggctggatacaaaaaaatcattgaaaggctaaatggcaaaaaaggtaaaagtcaattgtttgatggtgaaaggcttgcagacaggaagattgctgagcttttttctactaaaattcacataggt

SEQ ID NO: 3848 - RNA, 2916 nt, synthetic construct
  misc_feature 1..2916: note = derived and/or modified CDS sequence (wt) from CCHFV(V42/81, Artificial)__GU477490.1__Gn-4aa-Gc
  source 1..2916: mol_type = other RNA
tccaaagagccaggtgatgactgtatatcaagaactcagctaatgaggacagaaacagcagagatccatgatgacaactatggtggtccaggtgataaaataactatctgcaatggttcaaccattgtggatcagagactgggcagtgaactagggtgttataccatcaacagggtgaagtcattcaagctatgtgaaaacagcgccacagggaaagcctgtgaagtggacagcactccggttaagtgcaggcagggtttttgtttaaaaatcacccaagagggaaggggccatgtaaagttatctagaggctcagaggttgtcttggatgcttgcgactcaagctgtgaagtaatgatacctaaaggcactggagatatcctagtggactgttcaggtggacagcaacatttcttaaaggacaacttaattgacctagagtgccctcatatcccgctattaggtaagttggccatttacatttgcagaatgtcaaatcatcctagaacaactatggcttttctcttctggttcggctttggctatgtgatcacctgtatactctgcaaggctcttttttattcattgataattattgggacactagggaaaaagatcaagcaatatagggaactgaaacctcaaacttgcaccatatgtgagacagctcctgtcaatgcaatagatgctgaaatgcatgaccttaactgtagttacaatatatgcccttattgtgcatcaagattgacctccgatgggctagctaggcatgtaacgcaatgccccaagcgaaaagagaaagttgaggagactgaactgtacttgaatctggagagaattccttggattgtcaggaagctcctgcaagtgtcggagtccactggcgtggtattgaaacgaagcagttggctgattgtgctgcttgtgttactcacagtttcattgtcaccagttcagtcagcacctgttggtagaaaacctcttttcttagacagtatagttaaaggtaagaaaaatttgttaaactcaacaagtttggaaacaagcttatcaattgaagcaccatggggagcaataaatatccagtcaacctttaaaccaacagtatcggctgcaaacatagcactcagttggagctcagtggagcacagaggcaacaagatcttagtctcaggcaggtctgaatcaattatgaaactagaggaaagaacaggagtcagctggaatctaggtgtagaagatgcctctgaatccaaattacttaccgtctctatcatggatttgtcacaaatgtattcccctgtttttgagtacttgtcaggagacagacaggttgaagaatggcctaaagcaacttgtacaggtgactgcccagaaaggtgtggttgcacatcatcaacctgcttgcataaagaatggcctcactcaagaaactggagatgcaatcctacttggtgctggggggtaggaaccggctgcacctgctgcggagtggatgtaaaagacctttttatagatcacatgtttgttaaatggaaggttgaatatataaaaactgaagccatagtatgtgttgagctcaccagccaagaaagacagtgcagtctgattgaggcaggtactagattcaacttgggccctgtgactattaccctatccgagccaagaaacattcagcagaagcttccccctgagattatcacgttgcaccccaaaattgaagaaggcttctttgacttgatgcatgtacaaaaagtgttgtctgccagtacagtgtgtaaactgcaaagttgcacacatggtataccaggagatctgcaagtctaccacattggcaacctattgaaaggggatagagtaaacgggcatctaattcacaaaatcgaaccacattttaacacctcttggatgtcctgggatggttgtgacctagactactactgcaacatgggggattggccttcttgcacatacacaggagtgacccagcacaatcatgctgcatttgtaaacttgcttaacattgaaactgattacacgaaaactttccacttccactctaaaagagttacagcacatggtgaaacaccacaattagacttaaaagcaaggccggcatacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgaaccagatgagctcacagtacatgtgaagagcaatgatccagatgtggttgcagctagcacaagtctcatggcaaggaagcttgaatctgggacagacagcacatttaaggccttttcagctatgcccaaaacctctttatgtttttacattgtggagagagaatactgcaagagctgcagtgaagatgatacacagaaatgtgttgaaacaaaacttgaacagccacaaagcatactaattgaacacaaaggaacgataattggaaagcagaatgatacttgcacagccaaggcaagctgttggctggaatcagtcaagagttttttttatggattgaagaacatgcttggcagtgtttttggtaattttttcataggcattttgttattccttgccccctttgtcctgttagtacttttctttatgtttggatggaaaatcttgttttgctttaaatgttgcaggaggaccagaggcttgtttaagtatagacacctcaaagaagatgaggaaacaggctacagaaggattattgagagactgaacagcaaaaaagggaaaaacagactgcttgatggtgaaaggttggctgataggaaaattgctgagctgttctctacaaaaacacacattggc

SEQ ID NO: 3849 - RNA, 2916 nt, synthetic construct
  misc_feature 1..2916: note = derived and/or modified CDS sequence (wt) from CCHFV(79121M18, Artificial)__GU477493.1__Gn-4aa-Gc
  source 1..2916: mol_type = other RNA
gcagaaggaggaagcagtgactgcatttcaagaactcagctagttaaaacggaggttgcagaaattcatgaggacagttacggtgggcctggtgagaaaataacaatctgcaatggttccacaattgtagatcaagggcttggtagtgaattgggctgttatacaatcaacagagtaagatcctacaagctatgcgagaacagtgcctcagggaaaagctgtgaaatagatagcatcccagtcaaatgcaaacaagggttttgcctcaaaataacccaagaaggaagaggtcatgtaaaactgtccagagggacagaaattgttctagatgtctgtgattccagctgtgagctgatgatacccaagggcactggagacattttagtggattgctcaggagggcaacagcattttttacaaaacaatctgattgacttgggatgccccaatgtcccattactgggtaaaatggccatatatgtctgcagaatgtcaaaccacccaaaaactaccatggcatttctgttctggttcagctttggctatgtcatcacatgtatagcatgcagggtactcttctacttgctgattgccatcggaacagtagggaaaaagctaaaacagtatagagagctgaaaccacaaacatgcattgtctgtgaatctgtccctgttaatgcaatagatgctgaaatgcatgagcttaattgcagttacaatatatgcccatactgtgcatctagactgtctacagacgggctcatcaggcacgtaactcagtgtcccaaacggagggagaaggtggaagagactgagctattcttgaacttggaaagaataccttggctggtgagaaagctccttcaagtatcagagtcaacaggaatggctctaaagagaagctgttggatgatcacactcctcattctactattggtttcgatatcaccagtccaatctgcaccggtaggcaggaagccactcttcctggatagcacagccaagggaatgaaaagcctgttgaactccacgagcttagaaacaagtctgtcaattgaagctccgtggggagcaatcaatgtccagtcaactttcaaaccaacagtttcagctgctaacatagcacttagctggagttcagttgaacacaggggcaacaaaattttagtttcaggtagatcagagtcaatcatgaaattagaagaaagaacaggagtcagctggaatctgggtgtagaagatgcttctgagtcaaagacgcttactgtttccgtcatggacctgtcacaaatgtactctcctgtttttgagtacttgtcaggtgacagacaagtggaggaatggccaaaggcaacttgcacaggtgactgtccagagagatgcggctgcacttcgtcaacctgcttacataaagagtggccacattcaagaaactggcgatgtaatcctacctggtgttggggggtggggactggctgcacttgctgtgggctggatgtaaaggatttttttactgactacatgctggtaaaatggaaagtggaatatataaagacagaagctatagtgtgtgtcgagctgactagtcaagagaggcagtgtagtttaattgaagcaggcacaagatttaacctaggccctgtaacaataaccctatcagagccaagaaatgtccagcagaggcttcctcccgaaattgtaacactgcatcctaaaatagaggaaggtttttttgatttgatgcatgtacaaaaaatactgtctgcaagcacagtttgcaagctacagagctgcacacacggtgtgccgggcgattttcagatctaccatgtcggtaacctgctgaggggagacaaggttaatggacactcaattcacaagatagaaccacattttaatacttcatggatgtcatgggatggttgcgatctggactatttctgcaatatgggggactggccttcatgcacatacactggagtgacacagcataaccgtgctgcatttatcaacatgctcaacattgagactgactatacaaaaactttccactttcattcgaagagggtcacggcacatggagatactccccagctagacctaaaagcgagaccggcatatggtgctggcgaggtcactgttctagtggaggttgcagacttggagttgcacacaaagaaacttgaagtgtcaggtttgaaaattgcaagtttgacctgctctgggtgttatgcctgcagctctggcatctcctgcaaagttagaatccatgtaaatgaaccagatgaatttacagtacatgtaagaagtagcgacccagatgttgtagcagcaggatcaagtcttatggcaaggaaaatagagtttggggctgacagtacattcaaggccttttcatcaatgcccaaggactccttatgcttttacatagtagaaaaggattactgcagcagctgcaccgacgatgacacacaaaagtgtgtcaacacgaagcttgaccatccacagagcatactcattgagcacaaaggaacaataattggcaagcaaaatgacacttgttcgaccaagacaagctgctggctagaatcagttaagggttttttctatgggctaaaaaacatgctaagtggcatctttggaaatgtttttttaggcatcttcttattccttgctccttttgtgctactgatattttttttcttttttgggtggaggcttctgttttgtctcaaatgttgcagaagaactagaggactgttgaaatacaagcaccttaaggatgaagaggaggctggatacaaaaaaatcattgaaaggctaaatggcaaaaaaggtaaaagtcaattgtttgatggtgaaaggcttgcagacaggaagattgctgagcttttttctactaaaattcacataggt

SEQ ID NO: 3850 - RNA, 2916 nt, synthetic construct
  misc_feature 1..2916: note = derived and/or modified CDS sequence (wt) from CCHFV(Afg09-2990, Artificial)__HM452306.1__Gn-4aa-Gc
  source 1..2916: mol_type = other RNA
tccgaagaatctggtgatgactgcatatcaagaactcagctattgaggacagagactgcagaggtccatggcgataactatggtggtccaggtgataagataaccatctgtaatggttcaactgttgtagatcaaagactgggtagtgaactggggtgttacactatcaatagagtgaggtcattcaagctatgcgaaaacagtgccacagggaagagctgtgaaatagacagtatcccagtcaagtgtaagcagggttattgccttaaaatcactcaggaaggaaggggccatgtgaagttatctagaggctcagaagttgtcttggatgtatgtgattcaagctgtgaagtgatgatacctaagggcactggtgacattctagtagattgttcaggtgggcagcaacattatttaaaagacaacctggttgacctagggtgtcccaaaattccgttactgggcaaaatggctatttatatctgcaggatgtcgaatcaccccaagacaaccatggccttcctcttttggttcagctttggctatgtgataacttgtatactttgcaaggccatttttttcttattgataatttttggaacactagggaaaaggttcaagcagtacagagagttgaaaccccagacctgcaccatatgtgagacaacacctgtaaatgcaatagatgctgaaatgcatgatctcaactgcagttacaatatatgtccctattgtgcgtctagactgacttcagatgggcttgctaggcatgtaacacaatgtcctagacggaaggagaaagtggaggaaaccgaattatacctgaatttagagagaattccctgggttgtaagaaagctattgcaggtgtcagagtccactggtacagtattaaaaaggagcagctggctaattgtattacttgtgctgttcacagtttcattgtcaccagttcaatcagcacccattggtagaaggcccctatttctagatagtatagtcaaaggtatgaaaaatctgctaaactcaacaagtctagaaacaagcttatcaatagaggcaccgtggggagcaattaatgttcagtcaacctacaaaccaactgtatcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagttatggacttgtctcagatgtactctcctgtcttcgagtacttatcaggtgacagacaagtggaagagtggcctaaagcaacctgtacaggtgactgcccagaaagatgtggctgcacatcatcaacctgcttacacaaagagtggccccactcaaggaattggagatgtaatcctacttggtgctggggtgtagggactggctgcacctgttgtggtttagatgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagaaccaaggaacattcaacaaaagctccctcctgaaataattacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacctgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacaactagatctgaaagcaaggccaacctatggtgcaggtgagatcaccgtgctggtggaagttgctgacatggagttacacacaaagaagattgaaatatcaggcttaaaatttgcaggcctaacttgcacaggttgttatgcttgtagttctggcatctcttgtaaagttagaattcatgtagatgaaccagatgaacttacagtacatgttaaaagtgatgacccagatgtagttgcagctagctcaagtctcatggcgaggaagcttgaatttggaacagacagtacatttaaagctttctcagccatgcctaaaacctccctatgtttctacattgtggaaagagaatactgtaagagctgcagtaaagaagatacacaaaaatgtgttaacacgaaactcgaacaaccacagagcattttgatcgaacataagggaactataattggaaagcaaaacaatacttgcacggctaaagcgagttgctggttagagtcagttaagagtttcttttatggtctgaagaatatgctcggtggcatatttggcaatgtttttataggcattttcacatttcttaccccctttatcttgttaatacttttctttatgtttgggtggaggatcctgttttgcttcaagtgttgcagaagaaccagaggcctattcaagtacagacacctcaaagacgatgaagaaactggttacagaaagatcattgaaagactgaacaacaaaaaaggaaaaaacaggctgcttgatggtgaaagacttgctgacagaaagattgctgaactgttctccacaaaaacacacattggc

SEQ ID NO: 3851 - RNA, 2916 nt, synthetic construct
  misc_feature 1..2916: note = derived and/or modified CDS sequence (wt) from CCHFV(Sudan Al-Fulah 3-2008, Artificial)__HQ378184.1__Gn-4aa-Gc
  source 1..2916: mol_type = other RNA
tccgaagaacccagtgatgactgcatatcaagaactcaactattgaggacagagactgcagaaatccacggcgacaactatggtggcccgggtgacaaaataaccatctgcaacggctcaactattgtagaccaaagactgggcagtgagttagggtgttacactatcaatagagtgaagtcattcaagctatgtgaaaatagtgccactgggaagagctgtgtgatagacagtgtcccagttaaatgcaggcagggttattgcctaaggattactcaagaaggaaggggccatgtaaaattatctaggggctcagaggttgtcttagatgcatgcgatacaagctgtgaaataatgatacctaagggcaccggtgacatcctagttgactgttcaggtgggcagcaacattttctaaaggacaatttggtagatctaggatgccccaaaatcccattactgggcaaaatggctatctacatttgcagaatgtcgaatcaccccaaaacaaccatggctttcctcttctggttcagctttggctatgtaataacttgtatactttgcaaggccatcttttacttgttaataattattggaacactagggaaaaggttcaggcagtatagagagttaaagcctcagacctgcaccatatgtgagacaactcctgtaaatgcaatagatgctgagatgcatgacctcaattgcagttacaacatttgtccctactgtgcatctagactaacctcggatgggcttgctaggcatgtgacacagtgccctaagcggaaggagaaagtggaagaaactgaactgtacttgaacttagaaagaattccttgggttgtgagaaagctgttgcaggtatcagagtccaccggtgtggcattgaaaagaagcagctggctgattgtgctgcttgtgctgttcacggtttcattgtcgccagttcaatcagcacccattggtagaaggcctctattcctagacagtatagttaaaggcatgaaaaatctgctaaactcaacaagtttagaaacaagtctgtcaattgaggcaccatggggggcaataaatgttcagtcaacctacaagccaactgtgtcgactgcaaatatagcactcagctggagctcagtggaacacagaggcaataagatcttggtttcaggcagatcagaatcaattatgaagctggaagaaaggacagggatcagctgggatctcggcgtagaagacgcctctgagtctaaactgcttacagtctctgttatggatttgtctcagatgtactctcctgtcttcgagtacttatcaggagacagacaggtggaggagtggcccaaagcaacttgcacaggtgactgcccagaaagatgtggctgcacatcatcaacatgtctgcacaaagaatggccccactcaagaaattggagatgcaatcccacttggtgctggggtgtagggactggctgcacctgctgtggattagatgtgaaagacctttttacagattatatgtttgtcaagtggaaagttgaatacatcaagacagaggccatagtgtgtgtagaactcaccagtcaggaaaggcagtgtagcttgattgaagcaggcacaaggttcaatttaggtcctgtgaccatcacactgtcagaaccaagaaacatccaacagaagctccctcctgaaataatcacactacatcctaggattgaagaaggtttttttgacctgatgcacgttcagaaagtgttatcagcaagcacagtgtgtaagttgcagagttgcacacatggtgtaccaggagacctacaggtctaccacatcggaaatttattaaaaggggacaaggtaaatggacatctaattcataaaattgagccacacttcaacacttcctggatgtcctgggatggttgtgacctagactactactgcaacatgggagattggccttcttgcacatacacaggagtcacccaacacaatcatgcttcatttgtaaacctgctcaacattgaaactgattacacaaaaaacttccactttcactctaaaagggtcactgcacacggagacacaccacaactggatcttaaggcaagaccaacctatggtgcaggtgagattactgtactggtagaagttgctgacatggagttacacacaaagaagattgaaatatcgggcttaaaatttgcaagcttgacttgcacaggttgttatgcctgtagctctggcatctcatgcaaagttagaattcatgtagacgaaccagatgaacttacagtgcatgttaaaagtgatgatccagatgtagttgcagctagctcaagcctcatggcaagaaagcttgaatttggaacagacagtacatttaaagctttttcagccatgcctaaaacttcgctatgtttctacattgttgaaaaagaatactgcaagagctgcagtgaagaagacacaaaaaaatgtgttaacacaaaacttgagcaaccacagagcattttgatcgaacacaagggaactataatcggaaagcaaaacagcacttgcacagccaaggtgagttgctggttagagtcagccaagagttttttttatggtctaaaggacatgcttagtggcatttttggcaatgtctttataggtattttcttattccttgcccccttcgtcctgttagtgctgttctttatgtttgggtggaggatcctactttgctttagatgttgtagaagaactagaggcctgttcaagtatagacacctcaaggacgatgaagaaactggttatagaaggattattgaaagactaaacaataaaaagggaaaaaacaaactgcttgatggtgaaagacttgctgatagaaaaattgctgaactgttctccacaaaaacacacattggt

SEQ ID NO: 3852 - RNA, 2916 nt, synthetic construct
  misc_feature 1..2916: note = derived and/or modified CDS sequence (wt) from CCHFV(Sudan AB1-2009, Artificial)__HQ378187.1__Gn-4aa-Gc
  source 1..2916: mol_type = other RNA
tctgaagaacccagtgatgactgtatatcaagaactcaactactgaggacagagactgcagagatccacggcgataactatggtggcccgggtgacaaaataaccatctgcaatggctcaactattgtagaccaaagactgggcagtgaactagggtgttacaccatcaatagagtaaagtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgacacaagctgtgaaataatgatacctaagggcactggtgacatcctagttgactgttcaggcgggcagcaacattttctaaaggacaatttgatagatctaggatgccccaaaattccattattgggcaaaatggctatttacatttgcagaatgtcgaaccaccccaaaacaaccatggctttcctcttctggttcagctttggctatttaataacctgcatactttgcaaggccattttttacttgttgataattattggaacactagggaaaaggctcaagcagtatagagagttgaaacctcagacctgcaccatatgtgagacaactcctgtaaatgcaatagatgctgagatgcatgacctcaattgcagttacaacatttgcccctactgtgcatctagactaacctcagatgggcttgctaggcatgtgatacaatgccctaagcggaaggagaaagtggaagaaactgaactgtacttgaacctagaaagaattccttgggttgtaagaaagctgttgcaggtgtcagagtcaactggtgtagcattgaaaagaagcagttggctgattgtgctgcttgtgctattcactgtttcattgtcaccagttcaatcagcacccattggtagaaagcctttattcttagatagtatagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatcttggcgtagaagatgcctctgagtctaaactgcttacagtctctgtcatggacttgtctcagatgtactctcctgtcttcgagtacttatcaggtgacagacaggtggaagagtggcccaaagcaacctgtacaggtgactgcccagaaagatgtggctgcacatcatcaacctgtttgcacaaagaatggcctcactcaagaaattggagatgcaatcccacctggtgctggggtgtagggactggctgcacctgttgtggattagatgtgaaggacctttttacagattacatgtttgtcaagtggaaagttgaatacatcaagacagaggccatagtgtgtgtagaacttactagtcaggaaaggcagtgtagcttgattgaagcgggcacaaggttcaatttgggtcctgtgaccatcacactgtcagaaccaagaaacatccaacaaaaactccctcctgaaataatcacactacatcctaggatcgaagaaggtttttttgacctgatgcatgtacaaaaggtgttatcggcaagcacagtgtgtaagttgcagagttgcacacatggtgtgccaggagacctacaggtctaccacatcggaaatttattaaaaggggataaggtaaatgggcatctaattcataaaattgagccacacttcaacacctcctggatgtcctgggatggttgtgacctagactactactgcaacatgggagattggccttcctgcacatacacaggggtcacccaacacaatcatgcttcatttgtaaacttactcaacattgaaactgattacacaaagaatttccactttcactctaaaagggtcactgcacacggagatacaccacaactagatcttaaggcaagaccaacctatggtgcaggtgagatcactgttctggtagaagttgctgacatggagttacatacaaagaagattgagatatcaggcttaaaatttgcaagcttgacttgcacaggttgttatgcttgcagctctggtatctcatgcaaagttagaattcatgtggatgaaccagatgaacttacagtacatgttaaaagtgatgatccagatgtggttgcagctagctcaagtctcatggcaagaaagcttgaatttggaacagacagtacatttaaagctttctcggccatgcctaaaacttctttatgtttctacattgttgaaagggaacactgtaagagctgcaatgaagaagacacaaaaaaatgtgttaacacaaaacttgagcaaccacaaagcattttgatcgaacacaagggaaccataatcggaaagcagaacagcacttgcacggctagggcgagttgctggttggagtcagtcaagagtttcttttatggcctaaagaacatgcttagtggcatttttggcaatgtctttatgggcatcttcttattccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaagactaaacaataaaaaaggaaaaaacaaactgcttgatggtgaaagacttgctgatagaagaattgccgaactgttctctacaaaaacacacattggc

SEQ ID NO: 3853 - RNA, 2916 nt, synthetic construct
  misc_feature 1..2916: note = derived and/or modified CDS sequence (wt) from CCHFV(NIVA 118595, Artificial)__JN572083.1__Gn-4aa-Gc
  source 1..2916: mol_type = other RNA
tccgaagaatctggtgatgactgcatatcaagaactcagctattaaggacagagactgcagaggtccatggcgacaactatggtggtccgggtgataagataaccatctgcaatggttcaactgttgtagatcaaagactgggtagtgaactggggtgttacactatcaatagagtgaagtcctttaagctatgcgaaaacagtgccacagggaagagctgtgaaatagacagtatcccagttaagtgtaggcagggttattgcctaaaaatcactcaggaaggaaggggccatgttaaattatctaggggttcagaagttgtcttggatgcatgtgactcaagctgtgaagtgatgatacctaagggcactggtgacattctagtagattgttcaggtgggcagcaacattttttaaaggacaacctgattgatctaggatgtcccaaaattccattattgggcaaaatggctatttatatctgcagaatgtcgaatcaccccaaaacaaccatggcctttctcttttggttcagcttcggctatgtgataacttgtatactttgcaaggtaattttttacttattaataatttttggaacactagggaaaaggttcaagcagtacagagagttgaaaccccagacctgcaccatatgtgagacaacacctgtgaatgcaatagatgctgaaatgcatgatcttaactgcagttacaatatatgtccctattgtgcgtctaggctaacttcagatgggctcgctaggcatgtaacacaatgccctaagcggaaggagaaggtggaagagaccgaattgtacttgaacttagagagaattccttgggttgtaagaaagctattgcaggtgtcagagtccactggcatagcattaaaaaggagcagctggctaattgtgctgcttgtgttattcacagtatcaataacaccggttcaatcagcgcccattggtagaaggcccctatttctagatagtatagtcaaaggtatgaaaaatctgctaaactcaacaagtctagaaacaagcttatcaattgaggcaccgtggggagcaattaatgttcagtcaacctacaaaccaactgtatcagcagcaaacatagcactcagttggagctcagtggaacacagaggcaataagattttggtctcaggcagatcagaatcaattatgaagctggaagaaaggacaggaatcagctgggatctcggcgtagaagatgcctctgagtctaagctacttacagtctcagtcatggacttgtctcagatgtactctcctgtcttcgagtatttatcaggtgacagacaagtggaagagtggcctaaagcgacctgtacaggtgactgcccagaaagatgtggctgcacatcatcaacctgcttacacaaagagtggccccactcaaggaattggagatgtaatcctacttggtgctggggtgtagggactggctgcacctgctgtggattggatgtgaaagaccttttcacagattacatgttcgtcaagtggaaagttgagtacattaagacagaggccatagtatgtgtagaactaaccagtcaggaaagacagtgtagcttgattgaggcgggcacaagatttaatttaggttctgtgaccattacattgtcagaaccaaggaacattcaacaaaagctccctcctgaaataatcacactgcatcctagaattgaggaaggtttttttgacctaatgcatgtgcaaaaagtgctatcagcaagcacagtgtgtaagttacaaagctgcacacatggtgtgccaggagatctacaggtctaccacattggaaacctattaaaaggggacagagtaaacggacacctaattcacaaaattgaacaacacctcaacacttcttggatgtcctgggatggttgtgatctagactactactgcaatatgggagactggccttcttgcacatatacaggagtcacccaacataatcatgcttcatttgtaaacctgctcaacattgaaactgattacacaaaaaccttccactttcactctaaaagggttactgcacatggagacacaccacagctagatctgaaggcaaggccaacctatggtgcaggtgagatcactgtactggtggaagttgccgatatggagttacacacaaagaagattgaaatatcaggcttgaagtttgcaagcctatcctgcacaggttgttatgcttgtagttctggcatctcctgcaaagtcagaattcatgtagatgaaccagatgaacttacagtacatgttaaaagtgatgatccagatgtagttgcagctagctcaagtctcatggcaaggaagcttgaatctggaacagacagtacatttaaagctttttcagccatgcctaaaacttccttgtgcttctacattgtagagagagaatactgtaagggctgcagtaaagaagacacacaaaaatgtgttaacacgaaactcgagcaaccacagagcattttgatcgaacacaagggaactataattggaaagcaaaacaatacttgcacagctaaggcaagttgctggttagagtcagttaagagttttttttatggtctgaagaatatgcttagtggcatttttggcaatgtttttttaggcattttctcatttcttgccccctttgtcctattaatacttttctttatgtttgggtggaggatcctgttttgcttcaagtgttgcagaagaaccagaggcctattcaagtacagacacctcaaagacgatgaagaaactggttacagaaagatcattgaaagactgaacaacaaaaaggggaaaaacaaactgcttgatggtgaaaggcttgctgacagaaaaattgccgaactgttctccacaaaaacacacattggc

SEQ ID NO: 3854 - RNA, 2916 nt, synthetic construct
  misc_feature 1..2916: note = derived and/or modified CDS sequence (wt) from CCHFV(NIV 112143, Artificial)__JN572085.1__Gn-4aa-Gc
  source 1..2916: mol_type = other RNA
tccgaagaatctggtgatgactgcatatcaagaactcagctattaaggacagagactgcagaggtccatggcgacaactatggtggtccgggtgataagataaccatctgcaatggttcaactgttgtagatcaaagactgggtagtgaactggggtgttacactatcaatagagtgaagtcctttaagctatgcgaaaacagtgccacagggaagagctgtgaaatagacagtatcccagttaagtgtaggcagggttattgcctaaaaattactcaggaaggaaggggccatgttaaattatctaggggctcagaagttgtcttggatgcatgtgactcaagctgtgaagtgatgatacctaagggcactggtgacattctagtagattgttcaggtgggcagcaacattttttaaaggacaacctgattgatctaggatgtcctaaaatcccattattgggcaaaatggctatttatatctgcagaatgtcgaatcaccccaaaacaaccatggcctttctcttttggttcagcttcggctatgtgataacttgtatactttgcaaggtaattttttacttattaataatttttgggacactagggaaaaggttcaagcagtacagagagttgaaaccccagacctgcaccatatgtgagacaacacctgtgaatgcaatagatgctgaaatgcatgatcttaactgcagttacaatatatgtccctattgtgcgtctaggctaacttcagatgggctcgctaggcatgtaacacaatgccctaagcggaaggagaaggtggaagagaccgaattgtacttgaacttagagagaattccttgggttgtaagaaagctattgcaggtgtcagagtccactggcatagcattaaaaaggagcagctggctaattgtgctgcttgtgttattcacagtatcaataacaccggttcaatcagcgcccattggtagaaggcccctatttctagatagtatagtcaaaggtatgaaaaatctgctaaactcaacaagtctagaaacaagcttatcaattgaggcaccgtggggagcaattaatgttcagtcaacctacaaaccaactgtatcagcagcaaacatagcactcagttggagctcagtggaacacagaggcaataagattttggtctcaggcagatcagaatcaattatgaagctggaagaaaggacaggaatcagctgggatctcggcgtagaagatgcctctgagtctaagctacttacagtctcagtcatggacttgtctcagatgtactctcctgtcttcgagtatttatcaggtgacagacaagtggaagagtggcctaaagcgacctgtacaggtgactgcccagaaagatgtggctgcacatcatcaacctgcttacacaaagagtggccccactcaaggaattggagatgtaatcctacttggtgctggggtgtagggactggctgcacctgctgtggattggatgtgaaagaccttttcacagattacatgttcgtcaagtggaaagttgagtacattaagacagaggccatagtatgtgtagaactaaccagtcaggaaagacagtgtagcttgattgaggcgggcacaagatttaatttaggttctgtgactattacattgtcagaaccaaggaacattcaacaaaagctccctcctgaaataatcacactgcatcctagaattgaggaaggtttttttgacctaatgcatgtgcaaaaagtgctatcagcaagcacagtgtgtaagttacaaagctgcacacatggtgtgccaggagatctacaggtctaccacattggaaacctattaaaaggggacagagtaaacggacacctaattcacaaaattgaacaacacctcaacacttcttggatgtcctgggatggttgtgatctagactactactgcaatatgggagactggccttcttgcacatatacaggagtcacccaacataatcatgcttcatttgtaaacctgctcaacattgaaactgattacacaaaaaccttccactttcactctaaaagggttactgcacatggagacacaccacagctagatctgaaggcaaggccaacctatggtgcaggtgagatcactgtactggtggaagttgccgatatggagttacacacaaagaagattgaaatatcaggcttgaagtttgcaagcctatcctgcacaggttgttatgcttgtagttctggcatctcctgcaaagttagaattcatgtagatgaaccagatgaacttacagtacatgttaaaagtgatgatccagatgtagttgcagctagctcaagtctcatggcaaggaagcttgaatttggaacagacagtacatttaaagctttttcagccatgcctaaaacttccttgtgcttctacattgtagagagagaatactgtaagggctgcagtaaagaagacacacaaaaatgtgttaacacgaaactcgagcaaccacagagcattttgatcgaacacaagggaactataattggaaagcaaaataatacttgcacagctaaggcaagttgctggttagagtcagttaagagttttttttatggtctgaagaatatgcttagtggcatttttggcaatgtttttttaggcattttctcatttcttgccccctttgtcctattaatacttttctttatgtttgggtggaggatcctgttttgcttcaagtgttgcagaagaaccagaggcctattcaagtacagacacctcaaagacgatgaagaaactggttacagaaagatcattgaaagactgaacaacaaaaaggggaaaaacaaactgcttgatggtgaaaggcttgctgacagaaaaattgccgaactgttctccacaaaaacacacattggc

SEQ ID NO: 3855 - RNA, 2916 nt, synthetic construct
  misc_feature 1..2916: note = derived and/or modified CDS sequence (wt) from CCHFV(SCT ex Afghanistan, Artificial)__KC344856.1__Gn-4aa-Gc
  source 1..2916: mol_type = other RNA
tctgaagagtctggtgacgactgtatatcgaggactcagctattgaggacagagactgcagaggtccataatgataactatggtggtccaggtgacaaaattaccatctgcaacggttcaaccattgtagatcagagacttggcagtgaactggggtgttatactatcaacagagtgaagtcattcaagctatgcgaaaatagcgccacgggaaagtcctgtaaaatagacagcaccccggttaagtgcaggcaaggtttttgcttaaaaatcactcaggaaggaaggggccatgtgaagctatcgagaggctcagaagttgtcttagatgcctgcgattcaagctgtgaaataatgataccgaagggcactggagacatcctagtggactgttcaggtgggcagcaacatttcttaaaagataatttgattgatctaggatgccctaacattccactattaggtaaaatggctatctatatttgtagaatgtcaaatcatcccaaaacaactatggcttttctcttttggttcagttttggttatgtaataacatgtatattttgcaaagtcattttttatttattgatagttgtggggacattgggaaaaaagttcaaacagtatcgagagctgaaacctcagacttgtacaatatgtgaaacaactcctaccaatgcaatagatgctgaaatgcacgatcttaactgcagttacaatatatgtccttattgtgcatctagattaacctcggacgggcttgccaggcatgtgacacaatgccctaagcgaaaggaaaaagtagaagagactgagttgtacttgaacttggaaagaattccttggattgtcagaaaactactgcaggtgtcagagtctacaggtgtggcactgaagaggagcagttggctaattgtgttacttgtgctacttacagtttcattgtcaccggttcaatcggcacccatcgggaggaaaccccttttcttaaacagtatagtcaagggcatgaaaaacctgctaaattcaactaacttggaaacaagcttatcaatcgaagcaccatggggagcaataaatgtccagtcaacctttaaacccactgtatcaactgcaaacatagcactcagctggagttcagtggaacacagaggtaataaaattctagtctcaggcagatcagagtcaattatgaagctagaagaaaggacaggaatcagctgggatttgggcgtagaagatgcctctgagtctaaatcgcttactgtttctgtcatggatttatcacagatgtattctcctgtcttcgagtatctgtcaggtgacagacaggtagaggagtggcctaaagcaacctgcacaggcgattgcccggagagatgtggctgcacatcatcaacctgcttacacaaggaatggccccattcaaggaattggagatgcaaccccacttggtgttggggagtcggcactggatgcacctgctgtgggctagatgtgaaagaccttttcacagattatatgtttgtcaagtggaaggttgaatacataaagacagaggccatagtgtgtgttgagctcactagccaagaaaggcagtgcagcttgattgaggcaggaacaaggttcaacttaggtcctgtgaccatcacgttgtcagagccaagaaacattcagcagaagcttcctcctgaaataatcacattgcatcctagaattgaggaaggctttttcgatctaatgcatgtacaaaaggtgctgtctgcaagtacagtgtgcaagctgcaaagctgcacacatggtgttccaggagacttgcaggtctaccacattggcaacttgttaaaaggggataagttaaacgggcatatgattcacaaaattgagccacacttcaatacctcttggatgtcctgggatggctgtgacctagactattactgtaatatgggggattggccctcttgcacatacactggggtgacccaacataaccatgctgcttttgttaacttacttaacatcgaaactgattacacaaagaacttccactttcactctaaaagagttactgcacatggagacacaccacaattggacttgaaagctagaccaacttacggtgcgggtgaaatcactgtactagtggaagttgctgacatggagttacacacaaaaaagattgatatatcaggtttgaaatttgcaagtctaacttgcgcgggttgctatgcttgtagctctggcatctcctgtaaagtcaggattcatgtagatgaacctgatgagcttacagtacatgtgaaaagtgaagatccggacattgttgcagctagcacaagcctcattgcaaggaagctcgaacttgggacagacagcacattcaaggccttctcagccatgcccaaaacctccttgtgcttctacattgtggagagagaatactgtaagagctgcagcaaagaggacacacagaaatgtgttaacacaaagcttgagcacccacaaggcattttaattgagcacaaaggaacaataatcggaaagcaaaatgacacctgcacagccaaagcaggctgctggttggagtcagtcaagagttttttttatggattgaagaacatgcttagtggcatcttcggcaacgtttttataggtattttcttattccttgctccttttgttctattgatactcttctttatgtttgggtggagactcctgttttgctttaagtgttgtagaagaaccagaggtttattcaagtacagacatctcaaggaagatgaagaatctggttatagaagaatcattgaaagattaaacaacaaaaaaggaaagaacaagctgcttgatggtgaaagactagctgatagaaggatcgctgagctgttctccacaaaaacacatattggt

SEQ ID NO: 3856 - RNA, 2916 nt, synthetic construct
  misc_feature 1..2916: note = derived and/or modified CDS sequence (wt) from CCHFV(Zahedan 2007, Artificial)__KC867273.1__Gn-4aa-Gc
  source 1..2916: mol_type = other RNA
tccgaagaatctggtgatgactgcatatcaagaactcagctattgaggacagagactgcagaggtccatggcgataactatggtggtccaggtgataagataaccatctgtaatggttcaactgttgtagatcaaagactgggtagtgaactggggtgttacactatcaatagagtgaggtcattcaagctatgcgaaaacagtgccacagggaagagctgtgaaatagacagtatcccagtcaagtgtaagcagggtttttgcctaaaaatcactcaggaaggaaggggccatgtgaagttatctagaggctcagaagttgtcttggatgtatgtgattcaagctgtgaagtgatgatacctaagggcactggtgacattctagtggattgttcaggtgggcagcaacattttttaaaagacaacctggttgacctagggtgtcccaaaattccgttactgggcaaaatggctatttatatctgcaggatgtcgaatcatcccaagacaaccatggccttcctcttttggttcagctttggctatgtgataacttgtatactttgcaaggccatttttttcttattaataatttttggaacactagggaaaaggttcaagcagtacagagagttgaaaccccagacctgcaccatatgtgagacaacacctgtaaatgcaatagatgctgaaatgcatgatctcaactgcagttacaatatatgtccctattgtgcgtctagactgacttcagatggacttgctaggcatgtgacacaatgtcctagacggaaggagaaagtggaggaaaccgaattatacctgaatttagaaagaattccctgggttgtaagaaagctattgcaggtgtcagagtccactggtacagtattaaaaaggagcagctggctaattgtattacttgtgctgttcacagtttcattgtcaccagttcaatcagcacccattggtagaaggcccctatttctagatagtatagtcaaagatatgaaaaatctgctaaactcaacaagtctagaaacaagcttatcaattgaggcaccatggggagcaattaatgttcagtcaacctacaaaccaactgtatcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagtcatggacttgtctcagatgtactctcctgtcttcgagtacttatcaggtgacagacaagtggaagagtggcctaaagcaacctgcacaggtgactgcccagaaagatgtggctgcacatcatcaacctgcttacacaaagagtggccccactcaaggaattggagatgtaatcctacttggtgctggggtgtagggactggctgcacctgttgtggtttagacgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagagccaaggaacattcaacaaaagctccctcctgaaataatcacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacttgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacaactagatctgaaggcaaggccaacctatggtgcaggtgagatcaccgtgcttgtggaagttgctgacatggagttacacacaaagaagattgaaatatcaggcttaaaatttgcaggcctaacttgcacaggttgttatgcttgtagttctggcatctcttgtaaagttagaattcatgtagatgaaccagatgaacttacagtacatgttaaaagtgatgacccagatgtagttgcagctagctcaagtctcatggcgaggaagcttgaatttggaacagacagtacatttaaagctttctcagccatgcctaaaacctccctatgtttctacattgtggaaagagaatactgtaagagctgcagtaaagaagatacacaaaaatgtgttaacacgaaactcgaacaaccacagagcattttgatcgaacataagggaactataattggaaagcaaaacaatacttgcacggctaaagcgagttgctggttagagtcagttaagagttttttttatggtctgaagaatatgctcggtggcatatttggcaatgtttttataggcattttcacatttcttaccccctttatcttgttaatatttttctttatgtttgggtggaggatcctgttttgcttcaagtgttgcagaagaaccagaggcctattcaagtacagacacctcaaagacgatgaagaaactggttacagaaagatcattgaaagactgaacaacaaaaagggaaaaaacaggctgcttgatggtgaaagacttgctgacagaaagattgctgaactgttctccacgaaaacacacattggc

SEQ ID NO: 3857 - RNA, 2916 nt, synthetic construct
  misc_feature 1..2916: note = derived and/or modified CDS sequence (wt) from CCHFV(SPU 44/08, Artificial)__KJ682805.1__Gn-4aa-Gc
  source 1..2916: mol_type = other RNA
tctgaagagtctaatgatgactgtttatcaaggactcagctattgaggacagagaatgcggaaattcacagtgacaactatggtggtccaggtgacaagataactatctgcaacggttcaactattgtagatcagagattgggcagtgaactagggtgttacactatcaatagagtgaaatcatttaagctctgcgaaaacagtgctacaggtaaatcttgtgaaatagatagcaccccagtcagatgtaggcagggtttttgcttgaaaattactcaggagggaaggggccacgtgaagctatcaagaggctcagaagttgtcttggacgcctgtgactcaagctgtgaaataatgataccaaagggcactggggacatcctagttgactgctcaggtgggcagcaacatttcctaaaagataacctggttgatttaggatgccccaacatcccactgttaggcaaaatggccatctacatttgtagaatgtcaaatcatcccaagacaactatggctttccttttttggtttagctttggttatgtgataacctgtatactttgtaaagcaatcttctatctattaatagttgtagggacattaggaaaaaagttcaaacagtacagagagttaaaacctcagacctgtaccatatgtgaaacaaatcctgttaatgcaatagatgctgagatgcacgacctcaactgcagttacaatatatgtccttattgtgcatctaggttaacctcagatggtcttgccagacatgtaatgcaatgccccaaacggaaggaaaaaatagaagaaaccgaattatatttaaacttagaaagaatcccttgggttgttaggaaattactgcaggtgtcagaatccaccggtgtagcactaaagaggagtagttggctggttatactacttgtgctgctcacagtttcattgtcaccagtacaatcagcacccatcagcaggaaacccttgtttttggacagtattgttaaaggcatgaagaacttgctaaattcaacaagcctagaaacaagcttatcaattgaggcaccatggggggcaataaatgtccaatcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaattgctcactgtctctgtaatggacttgtcacaaatgtattctcctgtctttgagtacctatcaggtgatagacaagtggaagaatggcccaaggcaacctgcacaggagattgcccagaaagatgcggctgcacgtcatcaacctgcctacacaaggaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgaccatcacattgtcagagccaagaaacattcagcagaagctccctccagaaatagttacattgcatcctaggattgaagaaggcttctttgacttaatgcatatacaaaaagtgctatcagcaagtacagtatgtaagctacagagttgcacacatggcgtgccaggagacctacagatctaccacattggaaacttgttaaaaggagacaaggtgaacgggcacctgattcacaaaattgaaccacacttcaacacctcctggatgtcttgggacggctgtgacctagactactactgtaatatgggggattggccgtcttgctcatatactggcgtaacccaacacaatcatgctgcatttgtaaacatgctcaacatcgaaactgattatacaaaaaacttccactttcactctaagagagttacagcacatggggacacaccacaattagatttaaaagctagaccaacttatggtgcaggtgaaatcactgtgctggtagaggttgctgacatggagttgcatacaaagaaaattgagatatcaggtttgaagtttgcaagcttaacttgcacaggctgttatgcttgtagttctggcatctcctgtaaggttaggatccatgtagatgaaccagatgagcttacagtacatgtgaagagcgaggatccagacatagttgctgctagttcaagtctcatggctaggaagcttgaatttgggacagatagcacatttaaagccttttcagccatgcccaaaacctccttgtgcttttacattgtggagagggaatactgcaaaagctgtagtaaagaagacacacaaaaatgtgtcaacacaaagcttgaacaaccacaaagcattttaatcgagcacaaagggacgataatcggaaagcagaacgacacttgtacagccaaagcaagttgctggttagagtcaattaagagttttttttatggactaaagaatatgcttagtggcatttttggcaatgttttcatagggattttcttattcctcgctccttttatcatgctaatacttttcttcatgtttggatggaggatcctgttctgcttcaagtgttgcagaagaactagaggcttatttaagtatagacacctcaaagacgatgaagaaatcggttacaggaaaatcattgagaggctaaacaacaaaaaagggaaaaacaaactacttgacggtgaaagactagctgataggaagatcgctgagctgttctctacaaaaacacacattggc

SEQ ID NO: 3858 - RNA, 2916 nt, synthetic construct
  misc_feature 1..2916: note = derived and/or modified CDS sequence (wt) from CCHFV(SPU 383/87, Artificial)__KJ682806.1__Gn-4aa-Gc
  source 1..2916: mol_type = other RNA
tctgaagagtctaatgatgactgtttatcaaggactcagctattgaggacagagaatgcggaaattcacagtgacaactatggtggtccaggtgacaagataactatctgcaacggttcaactattgtagatcagagattgggcagtgaactagggtgttacactatcaatagagtgaaatcatttaagctctgcgaaaacagtgctacaggtaaatcttgtgaaatagatagcaccccagtcagatgtaggcagggtttctgcttgaaaattactcaggagggaaggggccacgtgaagctatcaagaggctcagaagttgtcttggacgcctgcgactcaagctgtgaaataatgataccaaagggcactggggacatcctagttgactgttcaggtgggcagcaacatttcctaaaagataacctggttgatttaggatgccccaacatcccactgttaggcaaaatggcaatctacatttgtagaatgtcaaatcatcccaagacaactatggctttccttttttggtttagctttggttatgtgataacctgtatactttgtaaagtaatcttctatctattagtagttgtagggacattagggaaaaagttcaaacagtacagagagttaaaacctcagacctgtaccatatgtgaaacgaatcctgttaatgcaatagatgctgagatgcacgacctcaactgcagttacaatatatgtccttattgtgcatctaggttaacctcagatggtcttgccagacatgtaatacaatgccccaaacggaaggaaaaaatagaagaaaccgaattatatttaaacttggaaagaatcccttgggttgttaggaaattactgcaggtgtcagaatccaccggtgtagcactaaagaggagtagttggctggttatactacttgtgctactcacagtttcattgtcaccagtacaatcagcacctatcagcaggaaacccttgtttttggacagtattgttaagggcatgaagaacttgctaaattcaacaagcctagaaacaagcttatcaattgaggcaccatggggggcaataaatgtccagtcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaattgctcactgtctctgtaatggacttgtcacaaatgtattctcctgtctttgagtacctatcaggtgatagacaagtggaggaatggcccaaggcaacctgcacaggagattgcccagaaagatgcggctgcacgtcatcaacctgcctacacaaggaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgactatcacattgtcagagccaagaaacattcagcagaagctccctccagaaatagtcacattgcatcctaggattgaagaaggcttctttgacttaatgcatatacaaaaagtgctatcagcaagtacagtatgtaagctacagagttgcacacatggcgtgccaggagacctacagatctaccacattggaaacttgttaaaaggagacaaggtgaacgggcacctgattcacaaaattgaaccacacttcaacacctcctggatgtcttgggacggctgtgacctagactactactgtaatatgggggattggccatcttgctcatatactggcgtaacccaacacaatcatgctgcatttgtaaacatgctcaacatcgaaactgattatacaaaaaacttccactttcactctaagagagttacagcacatggagacacaccacaattagatttaaaagctagaccaacttatggtgcaggtgaaatcactgtgctggtagaggttgctgacatggagttgcatacaaagaaaattgagatatcaggtttgaagtttgcaagcttaacttgcacaggctgttatgcttgtagttctggtatctcctgtaaggttaggatccatgtagatgaaccagatgagcttacagtacatgtgaagagcgaggatccagacatagttgctgctagttcaagtctcatggctaggaagcttgaatttgggacagatagcacatttaaagccttttcagccatgcccaaaacctccttgtgcttttacattgtggagagggaatactgcaaaagctgtagtaaagaagacacacaaaaatgtgtcaacacaaagcttgaacaaccacaaagcattttaatcgagcacaaagggacgatatttggaaagcagaacgacacttgtacagccaaagcaagttgctggttagagtcagttaagagttttttttatggactaaagaatatgcttagtggcatttttggcaatgttttcataggggttttcttattcctcgctccttttatcatgctaatacttttcttcatgtttggatggaggatcctgttctgctttaagtgttgcagaagaactagaggcttatttaagtatagacacctcaaagacgatgaagaaatcggttacaggaaaatcattgagaggctaaacaacaaaaaagggaaaaacaaactgcttgacggtgaaagactagctgataggaagattgctgagctgttctctacaaaaacacacattggc

SEQ ID NO: 3859 - RNA, 2916 nt, synthetic construct
  misc_feature 1..2916: note = derived and/or modified CDS sequence (wt) from CCHFV(SPU 130/89, Artificial)__KJ682807.1__Gn-4aa-Gc
  source 1..2916: mol_type = other RNA
tctgaagagcctaattatgactgtttatcaaggactcagctattgaggacagagaatgcggaaattcacagtgacaactatggtggtccaggtgacaagataactatctgcaacggttcaactattgtagatcagagattgggcagtgaactagggtgttacactatcaatagggtgaaatcatttaagctctgcgaaaacagtgctacaggtaaatcttgtgaaatagatagcaccccagtcagatgtaggcagggtttttgcttgaaaattactcaggagggaaggggccacgtgaagctatcaagaggctcagaagttgtcttggacgcctgtgactcaagctgtgaaataatgataccaaagggcactggggacatcctagttgactgttcaggtgggcagcaacatttcctaaaagataacctggttgatttaggatgccccaacatcccactgttaggcaaaatggccatctacatttgtagaatgtcaaatcatcccaagacaaccatggctttccttttttggtttagctttggttatgtgataacctgcatactttgtaaagtaatcttctatctattaatagttgtagggacattaggaaaaaagttcaaacagtacagagagttaaaacctcagacctgtaccatatgtgaaacgaatcctgttaatgcaatagatgctgagatgcatgacctcaactgcagttacaatatatgtccttattgtgcatctaggttaacctcagatggtcttgccagacatgtaatgcaatgccccaaacggaaggaaaaaatagaagaaaccgaattatatttgaacttagaaagaatcccttgggttgttaggaaattactgcaggtgtcagaatccaccggtgtagcactaaagaggagtagttggctggttgtactacttgtgctactcacagtttcattgtcaccagtacaatcagcacctatcagcaggaaacccttgtctttggacagtattgttaaaggcatgaagaacttgctaaattcaacaagcctagaaacaagcttatcaattgaggcaccatggggggcaataaatgtccagtcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaattgctcactgtctctgtaatggacttgtcacaaatgtattctcctgtctttgagtacctatcaggtgatagacaagtggaggaatggcccaaggcaacctgtacaggagattgcccagaaagatgcggctgcacgtcatcaacctgcctacacaaagaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgaccatcacattgtcagagccaagaaacattcagcagaagctccctccagaaatagtcacattgcatcctaggattgaagaaggcttctttgacttaatgcatatacaaaaagtgctatcagcaagtacagtatgtaagctacagagttgcacacatggcgtgccaggagacctacagatctaccacattggaaacttgttaaaaggagacaaggtgaacgggcacctgattcacaaaattgaaccacacttcaacacctcctggatgtcttgggacggctgtgacctagactactactgtaatatgggggattggccatcttgctcatacactggcgtaacccaacacaaccatgctgcatttgtaaacatgctcaacatcgaaactgattatacaaaaaacttccactttcactctaagagagttacagcacatggggacacaccacaattagatttaaaagctagaccaacttatggtgcaggtgaaatcactgtgctggtagaggttgctgacatggagttgcatacaaagaaagttgagatatcaggtttgaagtttgcaagcttaacttgcacaggctgttatgcttgtagttctggtatctcctgtaaggtcaggatccatgtagatgaaccagatgagcttacagtacatgtgaagagcgaggatccagacatagttgctgctagttcaagtctcatggctaggaagcttgaatttgggacagatagcacatttaaagccttttcagccatgcccaaaacctccttgtgcttttacattgtggagagggaacactgcaaaagctgtagtaaagaagacacacaaagatgtgtcaacacaaagcttgaacaaccacaaagcattttaatcgagcacaaagggacgataattggaaagcagaacgacacttgtacagccaaagcaagttgctggttagagtcaattaagagttttttttatggactaaagaatatgcttagtggcatttttggcaatgttttcataggggttttcttattcctcgctccttttatcatactaatacttttcttcatgtttggatggaggatcctgttctgctttaagtgttgcagaagaactagaggcttacttaagtatagacacctcaaagacgatgaggaaatcggttacaggaaaatcattgagaggctaaacaacaaaaaagggaaaaacaaactgcttgacggtgaaagactagctgataggaagatcgctgagctgttctctacaaaaacacacattggc

SEQ ID NO: 3860 - RNA, 2916 nt, synthetic construct
  misc_feature 1..2916: note = derived and/or modified CDS sequence (wt) from CCHFV(SPU 497/88, Artificial)__KJ682808.1__Gn-4aa-Gc
  source 1..2916: mol_type = other RNA
tctgaagagtctaacgatgactgtttatcaaggactcagctattgaggacagagaatgcggaaattcacagtgacaactatggtggtccaggtgacaagataactatctgcaacggttcaactattgtagatcagagactgggcagtgaactagggtgttacaccatcaatagagtgaaatcatttaagctctgcgaaaacagtgctacaggtaaatcttgtgaaatagatagcaccccagtcagatgtaggcagggtttttgcttgaaaattactcaggagggaaagggccacgtgaagctatcaagaggctcagaggttgtcctggacgcctgtgattcaagctgtgaaataatgataccaaagggcacaggggacatcctagttgactgttcaggtgggcagcaacatttcctaaaagataacctggttgatctaggatgccccaacatcccactgttaggcaaaatggccatctacatttgtagaatgtcaaatcatcccaagacaactatggttttccttttttggtttagctttggctatgtgataacctgtatactttgtaaagtaatcttctatctattaatagttgtagggacgttaggaaaaaagttcaaacagtacagagagttaaaacctcagacctgtaccatatgtgaaacaaaccctgttaatgcaatagatgctgagatgcacgacctcaactgcagttacaatatatgtccttattgtgcatctaggttaacctcagatggtcttgccagacatgtaatgcaatgccccaaacggaaggaaaaaatagaagaaaccgaattatatttaaacttagaaagaatcccttgggttgttaggaaattactgcaggtgtcagaatccaccggtgtagcactaaagaggagtagttggctggttatactacttgtgctactcacagtttcattgtcaccagtacaatcagcacctatcagcaggaaacccttgtttttggacagtattgttaaaggcatgaggaacttgctaaattcaacaagcctagaaacaagcttatcaattgaggcaccatggggggcaataaatgtccagtcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaactgctcactgtctctgttatggacttgtcacaaatgtattctcctgtctttgaatacctatcaggtgatagacaagtggaggaatggcccaaggcaacctgcacaggagattgcccagaaagatgcggctgcacgtcatcaacctgcctacacaaggaatggccccattcaagaaactggagatgcaaccctacttggtgttggggagtcggcactggatgcacctgttgtgggttggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgaccatcacattgtcagaaccaaggaacattcagcaaaagctccctccagaaatagtcacattgcatcctaggattgaagaaggcttctttgacttaatgcatatacaaaaagtactatcagcaagtacagtatgtaagctacagagttgcacacatggcgtgccaggagacctacagatctaccacattggaaacttgttaaaaggagacaaggtgaacgggcacctgattcacaaaattgaaccacacttcaacacctcctggatgtcttgggacggctgtgacctagactactactgtaacatgggggattggccatcttgctcatatactggcgtaacccaacacaatcatgctgcatttgtaaacatgctcaacatcgaaactgattatacaaaaaacttccactttcactctaagagagttacagcacatggagacacaccacaattagatttaaaagctagaccaacttatggtgcaggtgaaatcactgtgctggtagaggttgctgacatggagttgcatacaaagaaaattgagatatcaggtttgaagtttgcaagcttaacttgcacaggctgttatgcttgtagttctggtatctcctgtaaggttaggatccatgtagatgaaccagatgagcttacagtacatgtgaagagcgaggatccagacatagttgctgctagttcaagtctcatggctaggaagcttgaatttgggacagatagcacatttaaagccttttcagccatgcccaaaacctccttgtgcttttacattgtggagagggaatactgcaaaagctgtagtaaagaagacacacaaaaatgtgtcaacacaaagcttgaacaaccacaaagcattttaatcgagcacaaagggacgataattggaaaacagaacgacacttgtacagccagagcaagttgctggttagagtcaatcaagagttttttttatggactgaagaatatgcttagtggcatttttggcaatgttttcatagggattttcttattcttcgctccttttatcatgctaatacttttctttatgtttggatggaggatcctgttctgctttaagtgttgcagaagaactagaggcttgtttaagtatagacacctcaaagacgatgaagaagtcggttacaggaaaatcattgagaggctaaacaacaaaaaagggaaaaacaaactgcttgacggtgaaagactagctgataggaagatcgctgagctgttctctacaaaaacacacattggc

SEQ ID NO: 3861 - RNA, 2916 nt, synthetic construct
  misc_feature 1..2916: note = derived and/or modified CDS sequence (wt) from CCHFV(SPU 18/88, Artificial)__KJ682810.1__Gn-4aa-Gc
  source 1..2916: mol_type = other RNA
tctgaagagtctaatgatgactgtttatcaaggactcagctattgaggacagaaaatgcggaaattcacagtgacaactatggtggtccaggtgacaagataactatctgcaacggttcaactattgtagatcagagactgggcagtgaactaggatgttacactatcaatagagtgaaatcatttaagctctgtgaaaacagtgctacaggtaaatcttgtgaaatagatagcaccccagtcagatgtaggcagggtttttgcttgaaaattactcaggagggaaggggccacgtgaagctatcaagaggctcagaagttgtcttggacgcctgtgattcaagctgtgaaataatgataccaaagggcactggggacatcctagttgactgttcaggtgggcagcaacatttcctaaaagataacctggttgatctaggatgccccaacatcccactgttaggcaaaatggccatctacatttgtagaatgtcaaatcatcccaagacaactatgggtttccttttttggtttagctttggttatgtgataacctgtatactttgtaaagtaatcttctatctattaatagttgtagggacattagggaaaaagttcaaacagtacagagagttaaaacctcagacctgtaccatatgtgaaacgaatcctgttaatgcaatagatgctgagatgcacgacctcaactgtagttacaatatatgtccttattgtgcatctaggctgacctcagatggtcttgccagacatgtaatgcaatgccccaaacggaaggaaaaaatagaagaaaccgaattatatttaaacttagaaagaatcccctgggttgttaggaaattactgcaggtgtcagaatccaccggtgtagcactaaagaggagtagttggctggttatactacttgtgctactcacagtttcattgtcaccagtacaatcagcacctatcagcaggaaacccttgtttttggacagtattgttaaaggcaagaagaacttgctaaattcaacaagcctagaaacaagcttatcaattgaggcaccatggggggcaataaatgtccagtcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaattgctcactgtctctgttatggacttgtcacaaatgtattctcctgtctttgagtacctatcaggtgatagacaagtggaggaatggcccaaggcaacctgcacaggagattgcccagagagatgcggctgcacgtcatcaacctgcctacacaaggaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgaccatcacattgtcagagccaagaaacattcagcaaaagctccctccagaaatagtcacattgcatcctaggattgaagaaggcttctttgacttaatgcatatacaaaaagtgctatcagcaagtacagtatgcaagctacagagttgcacacatggcgtgccaggagacctacagatctaccacattggaaacttgttaaaaggagacaaggtgaacgggcacctgattcacaaaattgaaccacacttcaacacttcctggatgtcttgggacggctgtgacctagactactactgtaatatgggggattggccatcttgctcatatactggcgtaacccaacacaatcatgctgcatttgtaaacatgctcaacatcgaaactgattatacaaaaaacttccactttcactctaagagagttacagcacatggagacacaccacaattagatttaaaagctagaccaacttatggtgcaggtgaaatcactgtgctggtagaggttgcagacatggagttgcatacaaagaaaattgagatatcaggtttgaagtttgcaagcttaacttgcacaggctgttatgcttgtagttctggtatctcctgtaaggttaggatccatgtagatgaaccagatgagcttacagtacatgtgaagagcgaggacccagacatagttgctgctagttcaagtctcatggctaggaagcttgaatttgggacagatagcacatttaaagccttttcagccatgcccaaaacctccttgtgcttttacattgtggagagggaatactgcaaaagctgtagtaaagaagacacacaaaaatgtgtcaacacaaagcttgaacaaccacaaagcattttaatcgagcacaaagggacgataattgggaagcagaacgacacttgtacaggcaaagcaggttgctggttagagtcaatcaagagttttttttatggactaaagaatatgcttagtggcatttttggcaatgttttcatagggattttcttattcctagctccttttatcatgctaatacttttcttcatgtttggatggaggatcctgttctgctttaagtgttgcagaagaactagaggcctatttaagtatagacacctcaaagacgatgaagaaatcggttacaggaaaatcattgagaggctaaaaaacaaaaaagggaaaaacaaactgcttgatggtgaaagactagctgataggaagatcgctgagctgttctctacaaaaacacacattggc

SEQ ID NO: 3862 - RNA, 2916 nt, synthetic construct
  misc_feature 1..2916: note = derived and/or modified CDS sequence (wt) from CCHFV(SPU 431/85, Artificial)__KJ682812.1__Gn-4aa-Gc
  source 1..2916: mol_type = other RNA
tccgaggagtctgatggtgactgtatatcaagaactcaactattgaggacagagactacagaaatccacagtgacaactatggtggcccaggtgacaaaataactatctgcaatggttcaactattgtagatcaaagactaggcagtgaactggggtgttatactatcaatagggtgaagtcatttaagctttgcgaaaacagtgccacaggaaaatcttgtgaaatagatagcaccccagttaagtgcagacaaggtttttgcttgaaaatcactcaagaagggaggggccacgtgaagctgtcgagaggctcggaaattgtcttggacgcttgcgattcaaactgtgaaataatgataccaaagggcaccggagacatcttagttgactgttcaggtggacaacaacatttcttaaaagataatttgattgatcttggatgtcccaatatcccattattaggcaaaatggccatctacatttgcagaatgtccaatcatcctaaaacaaccatggcctttctcttttggtttagctttggttatgtgataacctgtatactttgtaaggtgatcttttacctattgatagttgcagggacagtaggaaaaaagttcaaacagtatagagagttgagacctcagacctgcaccatatgtgaaacaattcctgtcaatgcaatagatgctgaaatgcatgacctcaactgcagttacaatatatgtccgtattgcgcatctagattaacctcagatggtcttgccagacatgtaatgcaatgccctaagcggaaggaaaaagtagaggaaactgaattatacttaaacctagaaaggattccctgggttgttaggaaattattgcaagtttcagagtctaccggtgtggcattgaagaggagcagttggctgacagtgctgcttgtgttgcttatagtctcattgtcaccggtgcagtcagcacctattggtagaaaacccttatttttagacagtattgttaaaggcaggaagaacttgctaaactcaacaagcttggaaacaagcttatcaattgaggcaccatggggtgcaataaatgtccaatcaaccttcaaacccactgtgtcagctgcaaacatagcacttagctggagctcagtggaacacagaggcaacaagattttggtttcaggcaggtcagaatcaatcatgaagctggaggaaaggacaggaatcagctgggatctgggagtagaagacgcctctgagtccaaattgctcaccgtctctgtcatggacttgtcacaaatgtattcccccgtctttgagtacctgtcaggtgatagacaggtagaagagtggcccaaggcgacctgtacaggcgattgcccagaaagatgtggctgcacatcatcaacctgtttgcacaaggaatggccccattcaaggaactggagatgcaaccccacttggtgttggggggtcggcactggatgcacctgttgtgggctagatgtaaaagacctctttacagattacatgtttgtcaagtggaaagttgaatacataaaaacagaggccatagtgtgtgtcgaacttactagccaagaaaggcaatgtagcttgattgaagcaggcacaagattcaatttaggtcctgtgactatcacattatcggagccaagaaacattcagcaaaagctccctccagaaataattacattgcatcctagaattgaagaaggcttttttgacttaatgcatgtgcaaagagtgctgtcagcaagcacagtgtgcaagctacagagttgcacacatggtgtgccaggagacctacaggtctaccacatcggaaacttgttaaaaggagacaaggtaaacgggcatctgattcacaagattgaaccacatttcaacacttcctggatgtcttgggatggctgtgacctagattactactgcaatatgggggattggccttcttgcacatacactggagtaacccaacataaccatgctgcatttgtaaatttgctcaatatcgaaaccgattatacaaaaaactttcattttcactccaagagagttactgcacatggagacacaccacaattagacttgaaggccagaccaacttatggtgcaggggaggttactgtactagtggaggttgctgacatggagctgcacacaaagaaaattgagatatcaggcttgaagtttgcaagtctaacttgcacaggctgctatgcttgtagctctggtatctcctgtaaggtcaagatccatgtagatgaaccagatgagcttacagtacatgtgaagagtgaagacccagacatagttgctgcaggctcaagtctcatggcaaggaagcttgaatttggggcagatagtacattcaaagccttttcagccatgcccaaaacctccttgtgcttttatattgtggagagagaatactgtaagagctgcagtagagaggacacacgaaaatgtgttaacactaagcttgatcgaccacagagcattttgatcgaacataaaggaacgattattggaaagcaaaacaacacatgcacagctaaagcaagctgctggctagagtcagtcaaaagttttttctacggattgaagaatatgcttagtggcattttcggtaatgttttcatagggattttcttattcattgctccttttgtcctgttaatacttttctttatgtttgggtggaggatcctgttctgctttaagtgctgcagaagaaccagaggcctatttaagtacagacacctcaaggacgatgaagaaaccggttacaggaaaatcattgagaggctaaataacaaaaagggaaaaaacaaactacttgatggggaaaggctagctgataggaaaatcgccgagttattctccacaaaatcacatatcggc

SEQ ID NO: 3863 - RNA, 2916 nt, synthetic construct
  misc_feature 1..2916: note = derived and/or modified CDS sequence (wt) from CCHFV(SPU 48/90, Artificial)__KJ682813.1__Gn-4aa-Gc
  source 1..2916: mol_type = other RNA
tccgaagaacccagtgatgactgcatatcaagaactcagctattgaggacagagactgcagagatccacggcgacaactatggtggcccgggtgacaaaataactatctgcaatggctcaactattgtagaccaaagactgggcagtgagctagggtgttacactatcaacagagtgaagtcattcaagctatgcgaaaatagtgccacagggaagagctgtgtaatagacagtgtcccagttaaatgcaggcaaggttattgtctaagaatcactcaggaaggaaggggccatgtaaaattatctaggggctcagaggttgtcttagatgcatgcgatacaagctgtgaaataatgatacctaagggcaccggtgacatcctagttgactgttcaggtgggcagcaacattttctaaaggacaatttgatagatctaggatgccccaaaattccattattgggcaaaatggctatctacatttgcagaatgtcgaatcaccccacaacaaccatggctttcctcttctggttcagctttggctatgtaataacttgtatactttgcaaggccatcttttacttgttaataattattggaacactagggaaaaggttcaggcagtatagagagttaaaacctcagacctgcaccatatgtgagacaactcctgtaaatgcaatagatgctgagatgcatgacctcaattgcagttacaacatttgtccctactgtgcatctagactaacctcagatgggcttgctaggcatgtgacacagtgccctaagcggaaggagaaagtggaagaaactgaactgtacttgaacttagaaagaattccttgggttgtaagaaagctattgcaggtatcagagtccaccggtgtggcattgaaaagaagcagctggctgattgtgctgcttgtgctgttcacggtttcattgtcgccagttcaatcagcacccattggtagaaagcctctattccgagacagtatagttaaaggcatgaaaaatctgctaaactcaacaagtttagaaacaagtctatcaattgaggcaccatggggggcaataaatgttcagtcaacctacaagccaactgtgtcgactgcaaacatagcactcagctggagctcagtggaacacagaggcaataagatcttggtttcaggcagatcagaatcaattatgaagctggaagaaaggacagggatcagctgggatctcggcgtagaagacgcctctgagtccaaactgcttacagtctctgtcatggacttgtctcagatgtactctcctgtcttcgagtacttatcaggagacagacaggtggaagagtggcccaaagcaacttgtacaggtgactgcccagaaagatgtggctgcacatcatcaacatgtttgcacaaagaatggccccactcaagaaattggagatgcaatcctacttggtgctggggtgtagggactggctgcacctgttgtggattagatgtgaaagacctttttacagattatatgtttgtcaagtggaaagttgaatacatcaagacagaggccatagtgtgtgtagaacttaccagtcaggaaaggcagtgtagcttgattgaagcgggcacaaggttcaatttaggtcctgtgaccatcacactgtcagaaccaagaaacatccaacagaagctccctcctgaaataatcacactacatcctaggattgaagaaggtttttttgacctgatgcacgttcagaaagtgttatcagcaagcacagtgtgtaagttgcagagttgcacacatggtgtaccaggagacctacaggtctaccacatcggaaatttattaaaaggggacaaggtaaatggacatctaattcataaaattgagccacacttcaacacttcctggatgtcctgggatggttgtgacctagactactactgcaacatgggagattggccttcttgcacatacacaggagtcacccaacacaatcgtgcttcatttgtaaacctgctcaacattgaaactgattacacaaaaaacttccattttcactctaaaagggtcactgcacacggagacacaccacaactggatcttaaggcaagaccaacctatggtgcaggtgagattactgtactggtagaagttgctgacatggagttacacacaaagaagattgaaatatcaggcttaaaatttgcaagcttgacttgcacaggttgttatgcttgtagctctggcatctcatgcaaagttagaattcatgtggacgaaccagatgaacttacagtgcatgttaaaagtgatgatccagatgtagttgcagctagctcaagcctcatggcaagaaagcttgaatttggaacagacagcacatttaaagctttctcagccatgcctaaaacttcgctatgtttctacattgttgaaaaagaatactgcaagagctgcagtgaagaagacacaaaaaaatgtgttaacacaaaacttgagcaaccacaaagcattttgatcgaacacaagggaactataatcggaaagcaaaacagcacttgcacagccaaagtgagttgctggttagagtcagccaagagttttttttatggtctaaaggacatgcttagtggcatttttggcaatgtctttataggtattttcttgttccttgcccccttcatcctgttaatactattctttatgtttgggtggaggatcctactttgctttaaatgttgtagaagaactagaggcctgttcaagtatagacacctcaaggacgatgaagaaactggttatagaaggattattgaaagactaaacaataaaaaaggaaaaaacaaattgcttgatggtgaaagacttgctgatagaagaattgctgaactgttctccacaaaaacacacattggc

SEQ ID NO: 3864 - RNA, 2916 nt, synthetic construct
  misc_feature 1..2916: note = derived and/or modified CDS sequence (wt) from CCHFV(SPU 187/90, Artificial)__KJ682814.1__Gn-4aa-Gc
  source 1..2916: mol_type = other RNA
tccgaagaacctagtgatgactgcatatcgagaactcaactattgaggacagagactgcagagatccacggcgacaactatggtggcccgggtgacaaaataaccatctgcaacggctcaactattgtagaccaaagactgggcagtgagctagggtgttacactatcaatagagtgaagtcattcaagctatgcgaaaatagtgccacagggaagagctgtgaaatagacagtgtcccagttaaatgcaggcagggttattgcctaagaatcactcaggaagggaggggccatgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcgaatcaccccaaaacaaccatggctttccttttctggttcagctttggctacgtaataacttgtatactttgcaaggccatcttttacttgttaataattattggaacgctagggaagaggttcaagcagtatagagagttaaaacctcagacctgcaccatatgtgagacaactcctgtaaatgcaatagatgctgagatgcatgacctcaactgcagttacaacatttgtccctactgtgcatctagactaacctcagatgggcttgctaggcatgtgacacaatgccctaagcggaaggagaaagtggaagaaactgaactatacttgaacttagaaagaattccttgggttgtaagaaagctgttgcaggtatcagagtccactggtgtggcattgaaaagaagcagctggctgattgtgctgcttgtgctgttcacggtttcattgtcaccagttcaatcagcacccattggtagaaggcctctattcctagatagtatagttaaaggtatgaaaaatctgctaaattcaacaagtttagaaacaagtttatcaattgaggcaccatggggggcaataaatgttcagtcaacctacaaaccaactgtgtcaactgcaaacatagcactcagttggagctctgtggaacacagaggcaataagatcttggtttcaggcagatcagaatcaattatgaagctggaagaaaggacaggaatcagctgggacctcggcgtggaagacgcctctgagtctaaactgcttacagtctctgtcatggacttgtctcagatgtactctcctgtcttcgagtacttatcaggagacagacaggtggaagagtggcccaaggcaacttgtacaggtgactgcccagaaagatgtggctgcacatcatcaacatgtttacacaaagaatggccccactcaagaaattggaggtgcaatcccacttggtgctggggtgtagggactggctgcacctgttgtggattagatgtgaaggacctttttacagattatatgtttgtcaagtggaaagttgaatatattaagacagaagccatagtgtgtgtagaacttaccagtcaggaaaggcagtgtagcttgattgaagcaggcacaaggttcaatttaggtcctgtaaccatcacactgtcagaaccacgaaacatccaacagaagctccctcctgaaataatcacactgcatcccaggatcgaagaaggtttttttgacctgatgcatgtacagaaagtgttatcggcaagcacagtgtgtaagttgcagagttgcacacatggtgtgccaggagacctacaggtctaccacatcgggaatttattaaaaggggataaggtgaatggacatctaattcataaaattgagccacacttcaacacttcctggatgtcctgggatggttgtgacctagactactactgcaacatgggagattggccttcttgcacatacacaggagtcacccaacacaatcatgcttcatttgtaaacctgctcaacattgaaactgattacacaaaaaacttccactttcactctaaaagggtcactgcacacggagacacaccacaactagatcttaaggcaagaccaacctatggtgcaggtgagatcactgtactggtagaagttgctgacatggagttacacacaaagaagattgaaatatcaggcttaaaatttgcaagcttgacttgcacaggctgttatgcttgtagctctggcatctcatgcaaagttagaattcatgtggatgaaccagatgaacttacagtacatgttaaaagtgatgatccagatgtagttgcagctagctcaagtctcatggcaagaaagcttgaatttggaacagacagtatatttaaagctttctcagccatgcctaaaacttctctatgtttctacattgttgaaagagaacactgtaagagctgcagcgaagaagacactaaaaaatgtgttaacacaaaacttgagcaaccacaaagcattttgatcgaacacaagggaactataatcggaaagcaaaacagcacttgcacagccaagacgagttgctggttagagtcagtcaaaagttttttttatggtctaaagaacatgcttagtggcatttttggaaatgtttttataggtattttcttgttccttgcccccttcatcctgttaatactgttctttatgtttgggtggaggatcctattttgctttaaatgttgcagaagaactagaggcctgttcaagtatagacacttaaaggacgatgaagaaactggttatagaaggattattgaaagattaaacaataaaaaaggaaaaaacaaactgcttgatggtgaaagacttgctgatagaagaattgccgaactgttctctacaaaaacacacattggc

SEQ ID NO: 3865 - RNA, 2916 nt, synthetic construct
  misc_feature 1..2916: note = derived and/or modified CDS sequence (wt) from CCHFV(Haskovo-V46/13, Artificial)__KR092379.1__Gn-4aa-Gc
  source 1..2916: mol_type = other RNA
tccgaagagctaggtgatgactgtatatcaagaactcagctattgaggacagaaacagcagagatacatgatgacaactatggtggtccaggtgataaaataactatctgcaatggttcaaccattgtagatcagagactgggcagtgaactaggatgttataccatcaacagggggaagtcattcaagctatgcgaaaacagcgctacagggaaaacctgtgagatagacagcactccggttaagtgcaggcaaggtttttgtttaaaaatcacccaagagggaaggggccacgtaaaattatctagaggctcagaggttgtcctggatgcttgcgactcaagctgtgaagtaatgatacctaaaggcactggagatatcctagtggactgttcaggtgggcagcaacatttcttaaaagacaacttaattgacctagggtgcccccatatcccgctattgggtaagatggctatttacatttgcagaatgtctaatcatcctagaacaaccatggcttttctcttctggtttagctttggctatgtgatcacttgtatattttgcaaggctcttttttattcattgataattattgggacactagggaaaaaaatcaagcaatatagggaactgaaacctcaaacctgcaccatatgtgagacaactcctgtcaatgcaatagatgctgaaatgcatgacctcaactgtagttacaatatatgcccttattgtgcatcaagattgacctccgatgggctagccaggcatgtaacacaatgccccaagcggaaagagaaagttgaggagactgaactgtacctgaacctggaaagaattccttggattgtcagaaagctattgcaggtgtcagagtccaccggtgtggcattgaaacgaagcagctggctgattgtactgcttgtgttactcccagtttcattgtcgccggttcaatcagcacctgttggtagaaagccccttttcttagacagtatagttaaaggtatgaaaaatttgctaaactcaacaagcttggaaacaagcttatcaattgaggcaccatggggagcaataaatgtccagtcaacctttaaaccaacagtatcgactgcaaacatagcactcagttggagctcagtggagcacagaggcaacaagatcttagtcacaggcaggtctgaatcaatcatgaaactagaggaaaggacaggagtcagctgggatctaggcgtagaagatgcctcagaatccaaattacttaccgtttctatcatggatttatcacaaatgtattcccctgtttttgagtacttgtcaggggacagacaggttgaagaatggccaaaagcaacttgtacaggtgattgcccagaaaggtgtggctgcacatcatcaacctgcttacataaagaatggcctcactcaagaaactggagatgcaatcccacttggtgctggggagtaggaaccggctgcacctgttgcggggtggatgtaaaagacctttttacggatcacatgttcgtcaaatggaaagttgaatacataaaaactgaagccatagtatgtgttgagctcaccagccaagaaagacagtgcagtctgattgaggcaggtactagattcaacttgggccctgtgactattaccctgtctgagccaagaaacattcagcagaagcttccccctgaaattatcacgttgcatcccaaaattgaagaaggcttctttgacttgatgcatgtacaaaaagtgttgtctgcaagtacagtgtgtaaactgcagagttgcacacatggtataccaggagatctacaagtttaccacattggcaacttgttgaaaggggatagagtaaacgggcatctaattcacaaaattgaaccacatttcaacacctcttggatgtcctgggatggttgtgatttagattactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattggacttaaaagcaaggccgacctacggtgcaggtgagatcactgtgctggttgaggttgctgacatggagttgcataccaagaaagttgaaatatcaggcttgaaatttgcaagtttgacttgcacgggttgctatgcttgtagctctggcatctcctgcaaagttaggattcatgtagatgaaccagatgagcttacagtacatgtaaagagcagtgatcctgatgtggttgcagctggcacaagtcttatggcgaggaagcttgaatttggaacagacagcacattcaaggccttttcagctatgcccaaaacctctttatgtttttacattgtggagagagaatactgcaagagctgcagtgaagatgatacacaaaaatgtgttgacacaaaacttgagcagccacagagcatactaattgagcacaaaggaacaataattggaaagcagaatgatacttgcacagccagggcaagctgttggctagagtcagtcaagagttttttttatggattgaagaatatgcttggcagtgtttttggtaattttttaataggcattttgttattccttgccccttttgtcctgttggtgcttttctttatgtttgggtggaaaatcttgttttgctttaaatgttgcaggaggaccagaggcttattcaaatatagacacctcaaagacgatgaggaaacaggctacagaaggattattgaaagactgaacagcaaaaaagggaaaaacagactgcttgatggtgaaaggctggctgataggaaaattgctgagctgttctccacaaaaacacacattggc

SEQ ID NO: 3866 - RNA, 2916 nt, synthetic construct
  misc_feature 1..2916: note = derived and/or modified CDS sequence (wt) from CCHFV(24-R-2012, Artificial)__KR814856.1__Gn-4aa-Gc
  source 1..2916: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgacacaagctgcgaagtaatgatacctaaaggcactggagatatcctggtggactgttcaggtggacagcaacatttcttaaaagacaatttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacttgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 3867 - RNA, 2916 nt, synthetic construct
  misc_feature 1..2916: note = derived and/or modified CDS sequence (wt) from CCHFV(36-ST-2014, Artificial)__KR814857.1__Gn-4aa-Gc
  source 1..2916: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtaaagtcattcaagctatgcgaaaacagtgccacagggaaaacctgtgagatagacagcactccggtcaagtgcaggcaaggtttttgtttgaaaatcacccaagaggggaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaagctcttttttattcattgataattattgggacactaggaaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgaagcagctggctgattgtgctgcttgtgttactcacagtctcattgtcaccggttcaatcagcacctgttggtaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccattctaaaagagtcacagcacatggagacacaccacaattagacttaaaagcaaggccgacttacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgatcagccacagagcatactaattgagcacaaagggaccataattggaaagcagaatgacacttgcacagccaaggcaagttgttggctagagtcagtcaagagttttttttatggattgaagaatatgcttggcagtgtttttggtaattttttcgtaggcattttgttattccttgccccctttgtcttgttggtgcttttctttatgtgtggatggaaattcttgttttgctttaagtgttgcaggaggaccagaggcttgtttaagtatagacacctcaaagatgatgaggaaacaggctacagaaggattattgaaagactgaacagcaaaaaaggaaagaacagactgcttgatggtgagaggttggctgataggaaaattgctgagctgttctctacaaaatcacacattggc

SEQ ID NO: 3868 - RNA, 2916 nt, synthetic construct
  misc_feature 1..2916: note = derived and/or modified CDS sequence (wt) from CCHFV(37-R-2013, Artificial)__KR814858.1__Gn-4aa-Gc
  source 1..2916: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgacacaagctgcgaagtaatgatacctaaaggcactggagatatcctggtggactgttcaggtggacagcaacatttcttaaaagacaatttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagatgatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacttgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgttacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 3869 - RNA, 2916 nt, synthetic construct
  misc_feature 1..2916: note = derived and/or modified CDS sequence (wt) from CCHFV(44-ST-2010, Artificial)__KR814859.1__Gn-4aa-Gc
  source 1..2916: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtaaagtcattcaagctatgcgaaaacagtgccacagggaaaacctgtgagatagacagcactccggtcaagtgcaggcaaggtttttgtttgaaaatcacccaagaggggaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaagatggccatttacatttgcagaatgtcaaatcatcccaggacaaccatggctttcctcctctggttcagttttggctatgtaatcacctgtatattttgcaaagctcttttttattcattgataattattgggacactaggaaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgaagcagctggctgattgtgctgcttgtgttactcacagtctcattgtcaccggttcaatcagcacctgttggtaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccattctaaaagagtcacagcacatggagacacaccacaattagacttaaaagcaaggccgacttacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgatcagccacagagcatactaattgagcacaaagggaccataattggaaagcagaatgacacttgcacagccaaggcaagttgttggctagagtcagtcaagagttttttttatggattgaagaatatgcttggcagtgtttttggtaattttttcgtaggcattttgttattccttgccccctttgtcttgttggtgcttttctttatgtgtggatggaaaatcttgttttgctttaagtgttgcaggaggaccagaggcttgtttaagtatagacacctcaaagatgatgaggaaacaggctacagaaggattattgaaagactgaacagcaaaaaaggaaagaacagactgcttgatggtgagaggttggctgataggaaaattgctgagctgttctctacaaaatcacacattggc

SEQ ID NO: 3870 - RNA, 2916 nt, synthetic construct
  misc_feature 1..2916: note = derived and/or modified CDS sequence (wt) from CCHFV(46-ST-2012, Artificial)__KR814860.1__Gn-4aa-Gc
  source 1..2916: mol_type = other RNA
tccgaagagccaggtgatgactgcatatcaagaactcagctattgaggacagaaacagcggagatccatgatgacaactatggtggtccaggtgataaaataactatctgcaacggttcaaccattgtagatcagagactgggcagtgaactagggtgttataccatcaacagagtgaagtcattcaagctatgcgaaaacagcgccacagggaaaacctgtgagatagacagcactccggttaagtgcaggcaaggcttttgtttaaaaatcacccaagagggaaggggccacgtaaaattatctagaggctcagaggttgtcttggatgcctgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaactgaaacctcaaacttgtaccatatgtgagacagctcctgtcaatgcaatagatgctgaaatgcatgaccttaactgcagttacaatatatgcccttattgtgcatcaagattgacctccgatgggctagctaggcatgtgccacagtgccccaagcgaaaggaaaaagttgaggagactgagctgtacttgaacctggaaagaattccttggatcgtcagaaagctattgcaagtgtcagaatccactggtgtggcattgaaacgaagcagctggctgattgtactgcttgtgttactcacagtttcattgtcaccggttcaatcagcacctgttggtagaaaacctctgttcttagacagtatagttaaaggcatgaaaaatttgctaaactcaacaagcttagaaacaagcttatcaatcgaggcaccatggggagcaataaatgtccagtcaacctttaaaccaacagtatcgactgcaaacatagcactcagttggagctcagtggagcacagaggcaacaagatcttagtcacaggcaggtctgaatcaattatgaaactggaggaaaggacaggagtcagctgggatctaggcgtagaggatgcctctgaatccaaattacttaccgtctctatcatggatctgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaagtggaaggttgaatatataaaaactgaagccatagtatgtgttgagctcaccagccaagaaagacagtgcagtctgattgaggcaggtaccagattcaacttgggccctgtgactattaccctgtctgagccaagaaacatacagcagaagcttccccctgagattatcacattgcatcccaaagttgaagagggcttctttgacttgatgcatgtgcaaaaagtgttgtctgcaagtacagtgtgtaaactgcagagttgcacacacggtataccaggagatctacaagtttaccacattggcaacttactgaaaggagataggataaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcacaccaaaaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagccagcacaagtctcatggcgaggaagcttgagtttgggacagacagtaccttcaaggccttttcagctatgcccaaaacctctttatgtttttacattgtggagagagaatactgtaagagctgcagtgaagaggacacacaaaaatgtgttgacacaagacttgagcagccgcagagcatactaattgagcacaaaggaacgataattggaaagcagaatgatacttgcacagccaaggcaagctgttggttagagtcagtcaagagttttttttatggattgaagaatatgcttggtagtgtctttggtaattttttcataggcattctgttattccttgccccttttgtcctgttggtgcttttctttatgtttgggtggaaaatcttgttttgctttaaatgttgcaggaggaccagaggcttacttaagtatagacacctcaaagacgatgaggaaacaggctacagaaggattattgaaagactgaacaacaaaaaagggaaaaacagactgcttgatggtgaaaggttggctgataggaagattgctgagctgttctccacaaaaacacacattggt

SEQ ID NO: 3871 - RNA, 2916 nt, synthetic construct
  misc_feature 1..2916: note = derived and/or modified CDS sequence (wt) from CCHFV(47-ST-2013, Artificial)__KR814861.1__Gn-4aa-Gc
  source 1..2916: mol_type = other RNA
tccgaagagccaggtgacgactgcatatcaagaactcagctgttgaagacagaaacagcagagatccatgacgacaactatggtggtccaggtgacaaaataactatctgcaatggttcaaccattgtagatcagagactgggtagtgaactagggtgttataccatcaacagggtgaagtcattcaagctatgcaaaaacagtgccacagggaaaacctgtgagatagacagcactccggtcaagtgcaggcaaggtttttgtttgaaaatcacccaagagggaaggggccacgttaaattatccaggggctcagaggttgttttggatgcttgcgactcgagctgtgaaataatgatacctaaaggcactggagatatcctagtagactgctcaggtggacagcaacatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagattgacctctgatgggctagctagacatgtgacacaatgccctaagcgaaaggagaaagttgaggagactgaactgtatttgaacctggaaagaattccttggatagtcagaaagttattgcaagtgtcagagtccactggtgtggcattgaaacgaagcagttggctgattgtgctgcttgtgttactcacagtctcattgtcaccggttcaatcagcacctgttggtaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcctggtcacaggcaggtctgaatcaattatgaaactagaggaaaggacaggagtcagctgggatctaggtgtagaagatgcctctgaatccaaattacttaccgtctctatcatggatttgtcacaaatgtattcccctgtttttgagtacttatcaggagatagacaggttgaagaatggcccaaggcaacctgcacaggtgaatgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttaggtcctgtgactatcaccctgtctgagccaagaaacattcagcagaagcttccccctgagatcattacgctgcatcccaaaattgaagaaggcttctttgacttgatgcatgtacaaaaagtgttatctgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactactgcaacatgggggattggccttcttgcacatacacaggagtgacccaacataatcatgctgcatttgtaaacttgcttaacattgaaactgattacacaaaaaccttccacttccactctaaaagagtcacagcacatggagacacaccacaattagacttaaaagcaaggccgacctacggtgcaggtgagatcaccgtgctggttgaggttgctgacatggagttgcataccaagaaagttgaggtatcaggcttgaaatttgcaagtctggcttgcacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagtacattcaaggcattttcagctatgcctaaaacctctttatgcttttacattgtggagagggaatactgcaaaagctgcagtgaagatgatacaaaaaaatgtgttgacacaaaacttgaacagccacagagcatactaattgagcacaaagggacaataattggaaagcagaatgatacttgcacagccaaggcaagttgttggctagagtcagtcaagagttttttttatggattgaagaatatgcttggcagtgtttttggtaatttttttgtaggcattttgttattccttgccccttttgtcttgttggtgcttttctttatgtttggatggaaaatcttgttttgctttaagtgttgcaggaggaccagaggcttgtttaagtatagacacctcaaagatgatgaggaaacaggctacagaaggattattgaaagactgaacagcaaaaaagggaaaaacagactgcttgatggtgagaggttggctgataggaaaattgctgagctgttctctacgaaaacacacattggc

SEQ ID NO: 3872 - RNA, 2916 nt, synthetic construct
  misc_feature 1..2916: note = derived and/or modified CDS sequence (wt) from CCHFV(52-R-2014, Artificial)__KR814862.1__Gn-4aa-Gc
  source 1..2916: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttatactatcaacagggtgaagtcattcaagctatgcgaaaacagcgccacagggaaaacctgtgagatagacagcactccggttaagtgcaggcaaggtttttgtttaaaaatcacccaagagggaagaggccacgtaaaattatctagaggctcagaggttgttttggatgcttgcgacacaagctgcgaagtaatgatacctaaaggcactggagatatcctggtggactgttcaggtggacagcaacatttcttaaaagacaatttaattgacctagggtgcccccatgtcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagatgatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacttgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaggctgttggctagagtcagtcaagagttttttttatggattgaaaaatatgcttggtagtgtatttggtaactttttcataggcattttgctattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgaactgttctccacaaaaacacacattggt

SEQ ID NO: 3873 - RNA, 2916 nt, synthetic construct
  misc_feature 1..2916: note = derived and/or modified CDS sequence (wt) from CCHFV(75-R-2012, Artificial)__KR814863.1__Gn-4aa-Gc
  source 1..2916: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcgctccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaacttaattgacctagggtgcccacatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagcccctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctagaaagaattccttggattgtcagaaagctattgcaagtgtcagagtccactggtgtggcattgaagcgaagcagctggctgattgtactgcttgtgttactcacagtttcattgtcaccggttcaatcagcacctgttggtagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtccgaatcaattatgaaactggaggaaaggacaggagtcagctgggatctaggcgtagaagatgcctctgagtccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggtactggctgcacctgctgcggggtggatgtaaaagacctttttacagatcacatgtttgtcaaatggaaggttgaatatataaaaactgaagccatagtatgtgttgagctcaccagtcaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcaccgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttctttatggattgaaaaatatgcttggtagtgtatttggtaactttttcataggcattttgttattccttgccccttttgtcctgttggtgcttttctttatgtttggatggaaaatcttgttctgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 3874 - RNA, 2916 nt, synthetic construct
  misc_feature 1..2916: note = derived and/or modified CDS sequence (wt) from CCHFV(75-ST-2010, Artificial)__KR814864.1__Gn-4aa-Gc
  source 1..2916: mol_type = other RNA
tccgaagagtcaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagaaggaaggggccacgtaaaattatctagaggctcagaggttgttttggatgcttgcgactcaagctgcgaagtaatgatacctaaaggcactggagatatcttggtggactgttcaggtggacagcaacatttcttaaaagacaacttaattgacctagggtgcccccatatcccgctattgggtaaaatggccatttacatctgcagaatgtcaaatcaccctagaacaactatggcttttctcttctggttcagctttggctatgtgatcacctgtttattttgcaaggctcttttttattcattgataatcattgggacactagggaaaaagatcaagcaatatagggaattgagacctcaaacctgtaccatatgtgagacagctcctgtcaatgcaatagatgctgaaatgcatgaccttaactgcagttacaatatatgtccttattgtgcatcaagattgacctccgatgggctagctaggcatgtgccacaatgccccaagcggaaggaaaaagttgaggagactgagctgtacttgaacctggaaagaataccttggattgtcagaaagctattgcaagtgtcagagtccactggtgtggcattgaaacgaagcagctggctgattgtactgcttgtgttactcacagtttcattgtcaccggttcaatcagcacctgttggtagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaagtggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtacaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccaacctacggtgcaggtgagatcactgtgctggttgaggttgctgacatggagttgcataccaagaaagttgagatatcaggcctgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggcaactttttcataggcattttgttattccttgccccttttgtcctgttggtgcttttctttatgtttggatggaaaatcttgttttgcttcaaatgttgcaggagggccagaggcttgcttaagtatagacacctaaaagacgatgaggaaacaggctacagaaagattattgaaaggctgaacaacaaaaaaggaaaaaacagactgcttgatggtgaaaggttggctgataggaaaattgctgagctgttctccacaaaaacacacattggt

SEQ ID NO: 3875 - RNA, 2916 nt, synthetic construct
  misc_feature 1..2916: note = derived and/or modified CDS sequence (wt) from CCHFV(3756-ST-2007, Artificial)__KR814866.1__Gn-4aa-Gc
  source 1..2916: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccattaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccctggatagtcagaaagctattgcaagtgtcagagtccactggtgtggcattgaaacgaagcagttggctgattgtgctgcttgtgttactcacagtctcattgtcaccggtccaatcagcacctgttggtaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgttttcgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacaatgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggcataccaggagatctacaaatttaccacattggcaacttgttgaaaggggatagagtaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcggtcaagagttttttttatggattgaagaatatgcttggcagtgtttttggtagttttttcgtaggcattttgttattccttaccccttttgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaaggaaaaaacagactgcttgatggtgagaggttggctgataggaaaattgctgagctgttctctacaaaaacacacattggc

SEQ ID NO: 3876 - RNA, 2916 nt, synthetic construct
  misc_feature 1..2916: note = derived and/or modified CDS sequence (wt) from CCHFV(3809-ST-2007, Artificial)__KR814867.1__Gn-4aa-Gc
  source 1..2916: mol_type = other RNA
tccgaagagccaggtgatgactgcatatcaagaactcagttattgaggacagaaacagcagagatccatgatgacaactatggtggtccaggtgataaaataactatctgcaacggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgtcttggatgcctgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgtaaggctcttttttattcattgataattattgggacactagggaaaaagatcaagcaatatagggaattgaaacctcaaacttgtaccatatgtgagacagctcctgtcaatgcaatagatgctgaaatgcatgaccttaactgcagttacaatatatgcccttattgtgcatcaagattgacctccgatgggctggctaggcatgtgccacaatgccccaagcggaaggaaaaagttgaggagactgagctgtacttgaacctggaaagaatcccttggattgtcagaaagctattgcaagtgtcagagtccactggtgtggcattgaaacgaagcagctggctgattgtactgcttgtgttactcacagtttcattgtcaccggttcaatcagcacctgttggtagaaaacctctgttcttagacagtatagtcaaaggcatgaagaatttgctaaactcaacaagcttagaaacaagcttatcaattgaagcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtggaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgtacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactatcaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatcttcaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagaaagaatactgcaggagctgcagtgaagaggacacacaaaaatgtgttgacacaaaacttgagcagccacagagcatactaattgagcacaaaggaacgataattggaaagcagaatgatacttgcacagccaaagcaagctgttggctagagtcagtcaagagttttttttatggattgaagaatatgcttggtagtgtctttggtaactttttcataggcattttgttattccttaccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaagggaaaaacagactgcttgatggtgaaaggttggctgataggaaaattgctgagctgttttccacaaaaacacacattggt

SEQ ID NO: 3877 - RNA, 2916 nt, synthetic construct
  misc_feature 1..2916: note = derived and/or modified CDS sequence (wt) from CCHFV(3820-ST-2007, Artificial)__KR814868.1__Gn-4aa-Gc
  source 1..2916: mol_type = other RNA
tccgaagagccaggtgacgactgcatatcaagaactcagctattgaagacagaaacagcagagatccatgacgacaactatggtagtccaggtgacaaaatcactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcactgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctggctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcgcagtctcattgtcaccggtccaatcagcacctgttggtaggaaaccccttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggacctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagagtaaacggccatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaaaaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtagttttttcgtaggcattttgttattccttgcccctttcgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaaggaaaaaacagactgcttgatggtgagaggttggctgataggaaaattgctgagctgttctctacaaaaacacacattggc

SEQ ID NO: 3878 - RNA, 2916 nt, synthetic construct
  misc_feature 1..2916: note = derived and/or modified CDS sequence (wt) from CCHFV(4495-ST-2008, Artificial)__KR814869.1__Gn-4aa-Gc
  source 1..2916: mol_type = other RNA
tccgaagagtcaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagaaggaaggggccacgtaaaattatctagaggctcagaggttgttttggatgcttgcgactcaagctgcgaagtaatgatacctaaaggcactggagatatcttggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtaatcacctgtttattttgcaaggctcttttttattcattgataatcattgggacactagggaaaaagatcaagcaatatagggaattgagacctcaaacttgtaccatatgtgagacagctcctgtcaatgcaatagatgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggaatcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaagtggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtacaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccaacctacggtgcaggtgagatcactgtgctggttgaggttgctgacatggagttgcataccaagaaagttgagatatcaggcctgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagggaatactgcaagagctgcagtgaagaggacacacaaagatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggcaactttttcataggcattttgttattccttgccccttttgtcctgttggtgcttttctttatgtttggatggaaaatcttgttttgcttcaaatgttgcaggagggccagaggcttgcttaagtatagacacctaaaagacgatgaggaaacaggctacagaaagattattgaaaggctgaacaacaaaaaaggaaaaaacagactgcttgatggtgaaaggttggctgataggaaaattgctgagctgttctccacaaaaacacacattggt

SEQ ID NO: 3879 - RNA, 2916 nt, synthetic construct
  misc_feature 1..2916: note = derived and/or modified CDS sequence (wt) from CCHFV(4691-ST-2009, Artificial)__KR814871.1__Gn-4aa-Gc
  source 1..2916: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcagggtttttgtttgaaaatcacccaagagggaaggggccacgtaaaattatccaggggctcagaggttgttttagatgcttgcgactcgagctgtgaaataatgatacctaaaggcactggagatatcctagtagactgttcaggtggacagcaacatttcttaaaagacaacttgattgacctagggtgccctcatatcccgcttttgggtaagatggccatttacatttgcagaatgtcaaatcatcccaggacaaccatggctttcctcttctggttcagttttggctatgtaatcacctgtatattttgcaaggctcttttttattcattgataattattggaacactaggaaaaaaaatcaagcaatatagggagctaaagcctcaaacttgcaccatatgtgagacagctcctgtcaatgcaatagatgctgaaatgcatgacctcaactgtagttataatatatgcccttattgtgcatcaagactgacctctgatgggctagctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggttcaatcagcacctgttggtaggaaacctcttttcttagacagtatcgttaaaggtatgaaaaatttgctaaactcaacaagcttagaaacaagcttatcaattgaggcaccatggggagcaataaatgtccagtcaacctttaaaccagcagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacattggcaacctgttgaaaggggatagagtaaacgggcatctaattcacaaaattgaaccacattttaacacctcttggatgtcctgggatggttgtgacctagactactattgcaacatgggggattggccttcttgcacatacacaggagtgacccaacacaatcatgctgcatttgtaaacttgcttaacattgaaactgattacacgaaaaccttccacttccactctaaaagagtcacagcgcatggagacacaccacaattggacttaaaagcaaggccgacctacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcataaagggacgataattggaaagcagaatgatacttgcacagccaaggcaagttgttggctagagtcagtcaagagttttttttatggattaaagaatatgcttggcagtgtttttggtaattttttcgtaggcattttgttattccttgccccttttgtcttgttggtgctcttctttatgtttggatggaaaatcttgttttgctttaagtgttgcaggaggaccagaggcttgtttaagtatagacacctcaaagatgatgaggaaacaggctacagaaggattattgaaagactgaacagcaaaaaaggaaaaaacagactgcttgacggtgagaggttggctgataggaaaattgctgagctgttctctacaaaaacacacattggc

SEQ ID NO: 3880 - RNA, 2916 nt, synthetic construct
  misc_feature 1..2916: note = derived and/or modified CDS sequence (wt) from CCHFV(4701-ST-2009, Artificial)__KR814872.1__Gn-4aa-Gc
  source 1..2916: mol_type = other RNA
tccgaagagccaggtgacgactgcatatcaagaactcagctattgaagacagaaacagcagagatccatgacgacaactatggtggtccaggtgacaaaataactatctgcaatggttcaaccgttgtagatcagagactgggcagtgaactagggtgttataccatcaacagggtgaagtcattcaagctatgcgaaaacagtgccacagggaaaacctgtgagatagacagcactccggttaagtgcaggcaagggttttgtttgaaaatcacccaagagggaaggggccacgtaaaattatccaggggctcagaggttgttttggatgcttgcgactcaagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctggctaggcatgtgacacaatgccctaagcgaaaagagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggtaggaaaccccttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgtacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagagtaaacggccatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaatattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaaaaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtggttttttcgtaggcattttgttattccttgcccctttcgtcttgttggtacttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaaggaaaaaacagactgcttgatggtgagaggttggctgataggaaaattgctgagctgttctctacaaaaacacacattggc

SEQ ID NO: 3881 - RNA, 2916 nt, synthetic construct
  misc_feature 1..2916: note = derived and/or modified CDS sequence (wt) from CCHFV(5170-R-2011, Artificial)__KR814873.1__Gn-4aa-Gc
  source 1..2916: mol_type = other RNA
tccgaagagccaggtgacgactgcatatcaagaactcagctattgaagacagaaacagcagaaatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgtttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgaagggctagctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggtaggaaacctcttttcttagacagtatagttaaaggtatgaaaaatttgctaaactcaacaagcttagaaacaagcttatcaattgaggcaccatggggagcaataaatgtccagtcaacctttaaaccaacagtatctactgcaaacatagcactcagttggagctcagtagagcacagaggcaacaagatcttggtcacaggcaggtctgaatcaattatgaaactagaggaaaggacaggagtcagctgggatctaggcgtggaagatgcctctgaatccaaattacttaccgtctctatcatggacttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacatcggtaacttgttgaaaggggatagagtaaacgggcatctgattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcctgtagctctggcatctcttgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagccatgcccaaaacctctttatgcttttacattgtagagagggaatactgcaagagctgcagtgaagatgatacaaaaaaatgtgttgacacaaaacttgagcagccacagagcatactaattgagcacaaggggacgataattggaaagcagaatgatacttgcacagccaaggcaagttgttggctagagtcagtcaagagttttttttatggactgaagaatatgcttggcagtgtttttggtagttttttcgtaggcattttgttattccttgccccttttgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaagggaaaaacagactgcttgatggtgagaggttggctgataggaaaattgctgagctgttctctacaaaaacacacattggc

SEQ ID NO: 3882 - RNA, 2916 nt, synthetic construct
  misc_feature 1..2916: note = derived and/or modified CDS sequence (wt) from CCHFV(Oman-199809166, Artificial)__KR864901.1__Gn-4aa-Gc
  source 1..2916: mol_type = other RNA
tccgaagagtctggtgaagactgtatatcaaggactcagctgttgaggacagaaactgcagaaatccatggtgataactatggtggtccaggtgacaaaataaccatctgcaatggttcaaccattgtagatcaaaggctgggtagtgaactggggtgttacactatcaatagggtgaagtcatttaagctatgcgaaaacagtgccacaggtaagtcctgtgaaatagataacactccagtaaaatgcaagcaaggtttttgcttgaaaataacccaagaaggaaggggccacgtgaagctttcaagagactcagaagttgtcctggacgcctgcgattcaagctgtgaaataatgataccaaagggcactggagacatcctggttgactgctcaggtgggcagcagcacttcttaaaagacaacctgattgatctgggatgccccaacatcccattattaggcaaaatggcaatctacatttgtagaatgtcaaatcatcctaaaacaactatggcttttcttttttggtttagctttggttatgtgataacctgcatactttgtaaagtcattttttatctattgatagttgttggaactttagggaaaaagtttaaacagtatagagagttaaaacctcagacctgcacaatatgtgaaacaactcctgtcaatgcaatagatgctgagatgcacgatctcaattgtagttacaatatatgtccttattgtgcatctaggttaacttcagatggtcttgccagacatgtaatgcagtgtcctaagcggaaggaaaaaatagaagaaaccgaattatacctgaacttagaaagaatcccttgggttgtcagaaaactactgcaggtatcagaatccactggtgtagcactaaagaggagcagttggctgattgtgctacttgtgcttctcacagtttcattgtcaccagtacaatcagcacctatcggtagaaagcccttatttttagacagtattgctaagggtatgaagaacctgctgaattcaacaagcttagaaacaagcttatcaattgaggcaccatggggagcaataaacgtccaatctactttcaaacctactgtgtcaactgcaaacatagcacttagttggagctcagtggaacacagaggtaataagatcttggtttcaggcagatcagagtcaatcatgaagctagaagaaagaacaggaatcagctgggatttgggagtagaagatgcctctgagtccaaattacttactgtttccgtcatggacttatcacagatgtactctcctgtctttgagtacctatcaggtgacagacaagtagaggaatggccaaaggcaacctgtacaggcgattgcccggaaagatgtggctgcacatcatcaacctgcctacacaaggaatggcctcactcaagaaactggagatgcaaccccacttggtgttggggagtcggcaccggatgcacctgttgtggactagatgtaaaggacctttttacagattacatgtttgttaaatggaaggtcgaatatataaaaacagaggctatagtgtgtgttgagcttactagccaagaaagacaatgtagcttgattgaggcaggcacaagattcaacttaggtcctgtgactatcacattatcagagccaagaaacattcagcaaaagctccctccagaaattgtcacattacatcctagaattgaagaaggtttttttgacttaatgcatgtacagaaggtactatcagcaagcacagtgtgcaagctacagagttgcacacatggcgtaccaggagacttacaggtctaccacatcggaaacttactaaaaggagacaaagtgaatgggcatctgatacataaagttgaaccacatttcaacacctcctggatgtcttgggacggctgtgacctagattactactgcaatatgggggattggccctcttgcacgtatactggagttacccaacataatcatgctgcatttgtaaacctacttaacattgaaactgattacacaaagaacttccactttcactctaagagagtcactgcacatggggacactccacaattagatttaaaagccagaccaaattatggtgcaggtgaaatcactgtgctggtggaagttgctgacatggagttacacacaaagaaaattgagatatcaggtttgaagtttgcaagcctaacctgcacaggttgttatgcttgtagctctggcatctcatgtaaggttaggatccatgtagatgaaccagatgagcttacagtacatgtgaagagtgaagacccagacatagttgctgctagctcaagtctcatggcaagaaagcttgaattcgggacggatagtacattcaaagccttctcagccatgcctaaaacctccttgtgcttttacattgttgagagagaatactgtaaaagctgcagtaaagaagacacacaaaagtgtgttaacgcaaagcttgagcgaccacagagcattttaattgagcacaaaggaacgataattggaaagcagaacgacacttgcacagctaaagcaagctgctggctagagtcagtcaagagtttcttttatggactaaagaacatgcttagtggcatttttggcaatgttttcatagggattttcttattccttgctccttttatcctgttaatacttttctttatgtttgggtggagaatcctattctgctttaagtgctgcaggagaactagaggcctatttaagtacagacacctcaaagatgatgaagaaaccggttataggaaaatcattgagagactaaacaacaaaaaaggtaaaaacaagctgcttgacggtgaaagattagctgatagaaagatcgctgagctgttctctacaaaaacacacattggc

SEQ ID NO: 3883 - RNA, 2916 nt, synthetic construct
  misc_feature 1..2916: note = derived and/or modified CDS sequence (wt) from CCHFV(200406546-Turkey, Artificial)__KR864902.1__Gn-4aa-Gc
  source 1..2916: mol_type = other RNA
tccgaagagccaggtgatgactgcatatcaagaactcagctattgaggacagaaacagcagagattcatgatgataactatggtggcccaggtgataaaataactatctgcaacggttcaactattgtagatcagagactgggcagtgaactagggtgttatactatcaacagggtgaagtcattcaagctatgcgaaaacagcgccacagggaaaacctgtgagatagacagcactccagttaagtgcaggcaaggtttttgtttaaaaatcacccaagagggaaggggccacgtaaaattatctagaggctcagaggttgtcttggacgtttgcgactcaagctgtgaagtaatgatacctaaaggcactggagatatcctggtggactgttcaggtggacagcaacatttcttaaaagacaacctaattgacctagggtgcccccatgtcccgctattgggtaggatggccatttacatttgcagaatgtcaaatcatcctagaacaactatggcttttctcttctggttcagctttggctatgtgatcacctgtatattttgcaaggctcttttttattcattgataattattgggacactagggaaaaagttcaagcagtatagggaactgaaacctcaaacttgtaccatatgtgagacggctcctgtcaatgcaatagatgctgaaatgcatgaccttaactgcagttacaatatatgcccttattgtgcatcaagattgacctccgacgggctagctaggcatgtgccacaatgccccaagcggaaagaaaaagttgaggagactgaactgtacttgaacctggagagaattccttggattgtcagaaagctattgcaggtgtcagagtccactggtgtggcattgaaacgaagcagctggctgattgtactgcttgtgttactcacagtttcgttgtcaccggttcaatcggcacctgttggtagaaaacctctgttcttagacagtatagttaaaggcatgaaaaatttgctaaactcaacaagcttagaaacaagtttatcaattgaggcaccatggggagcaataaatgtccagtcaacctttaaaccaacagtatcgactgcaaatatagcactcagttggagctcaatagagcacaggggcaacaagatcttagtcacaggcaggtctgaatcaattatgaagctggaggaaaggacaggggtcagctgggatctaggcgtagaagatgcctctgaatctaaattactcactgtctctattatggatttgtcacaaatgtactcccctgtttttgagtacttgtcaggagacagacaggttgaggaatggcccaaagcaacgtgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtgaaagacctttttacagatcacatgtttgtcaaatggaaggttgaatatataaaaactgaagccatagtatgtgttgagctcaccagccaagaaagacagtgcagtctgattgaggcaggtactagattcaacttgggccctgtgactattaccctgtctgagccaagaaacattcagcagaagcttccccctgagattatcacgttgcatcccaaagttgaagaaggcttctttgacttgatgcatgtacaaaaagtgttgtctgcaagtacagtgtgtaaactgcaaagctgcacacatggtataccaggagatctacaagtttaccacattggcaacttgctgaaaggtgatagagtaaacgggcatctaattcacaaaattgaaccacatttcaacacctcttggatgtcctgggatggttgtgacttagactactactgcaacatgggggattggccttcttgcacatacacaggagtgacccagcataaccatgctgcatttgtaaacttgcttaacattgaaactgattacacgaaaaccttccacttccactctaaaagagtcacagcacatggtgacacaccacaattagacttaaaagcaaggccgacctacggtgcaggtgagatcactgtgctggttgaagttgctgatatggagctgcataccaagaaagttgagatatcaggcttgaaatttgcaagtctagcttgcacgggttgctatgcttgtagctctggcatctcctgtaaagtcaggattcatgtagatgagccagatgagctcacagtacatgtaaagagcagtgatcctgatgtggttgcagctagcacaagtctcacggcgaggaagcttgaatttgggacagacagcacattcaaggccttttcagctatgcccaagacctctttatgtttttacattgtggagaaagaatactgcaagagctgcaatgaagatgacacacaaaaatgtgttgacacaaagcttgagcagccacagagcatactaattgagcacaaaggaacgataattggaaagcagaatgatacttgcacagccaaggcaagctgttggctggagtcagtcaagagttttttttatggattaaagaatatgcttggtagtgtctttggtaattttttcataggcattttgttattccttgccccttttgtcctgttggtgcttttctttatgtttggatggaaaatcttgttttgctttaaatgttgcaggaggaccagaggcttatttaagtatagacacctcaaagacgatgaggaaacaggctacaaaaggattattgaaagattgaacaacaaaaaagggaaaaacagactgcttgatggtgaaaggttggctgataggaaaattgctgagctgttctccacaaaaacacacattggt

SEQ ID NO: 3884 - RNA, 2916 nt, synthetic construct
  misc_feature 1..2916: note = derived and/or modified CDS sequence (wt) from CCHFV(1-CR/HU-2015, Artificial)__KU161584.1__Gn-4aa-Gc
  source 1..2916: mol_type = other RNA
tccgaagagccaggtgatgactgcatatcaagaactcagctattgaggacagaaacagcagagatccatgacgacaactacggcggtccaggtgacaaaataactatctgcaatggttcaaccatcgtagatcagagactgggcagtgaactagggtgttataccatcaacagggtgaagtcattcaagctatgcgaaaacagcgctacagggaaaacctgtgagatagacagcactccggtcaagtgcaggcaaggtttctgtttaaaaatcacccaagagggaaggggccacgtaaaattatctagaggctcagaggttgtcttggatgcttgcgactcaagctgtgaagtgatgatacctaaaggcaccggagatatcctagtagactgttcaggtggacagcagcattttttaaaagacaacttgattgacctagggtgcccccacatcccgctattgggtaagatggccatttacatttgcagaatgtcaaatcatcctaggacaaccatggcttttctcttctggttcagctttggctatgtgatcacctgtatattttgcaaggctcttttttattcattaataattattgggacactagggaaaaagatcaagcagtatagagaactaaaacctcaaacttgtactatatgtgagacagctcctgtcaatgcaatagatgctgaaatgcatgacctcaactgtagttacaatatatgcccttattgtgcatcaagactgacctctgatgggctagctaggcatgtaacgcaatgccctaagcgaaaggagaaagttgaggagactgaactgtacttgaacctagaaagaattccttggatcgtcagaaagctattgcaagtgtcagagtccactggtgtggccttgaaacgaagcagttggttgattgtgctgcttgtgttactcacagtttcattgtcaccggttcaatcagcacctgttggtaggaaaccccttttcctagacagtatagttaaaggtatgaaaaatttgctaaactcgacaagcttagaaacaagcttatcaattgaggcaccatggggagcaataaatgtccagtcaacctttaaaccaacagtatcaactgcaaacatagcactcagttggagctcagtggagcacagaggcaacaagatcttagtcacaggcaggtctgaatcaattatgaaactagaggaaaggacaggagtcagctgggatctaggcgtagaagatgcctctgaatccaaattacttaccgtctctataatggatttatcacaaatgtattcccctgtttttgagtacttgtcaggagacagacaggttgaagagtggcccaaagcaacttgtacaggtgattgcccagaaaggtgtggctgcacatcatcaacctgcttgcataaagaatggcctcactcaagaaactggagatgtaatcccacttggtgctggggagtaggaaccggctgcacctgttgcggggtggatgtaaaagacctttttacagatcacatgtttgtcaaatggaaggttgaatatataaaaactgaagccatagtatgtgttgagctcaccagccaggaaagacagtgcagtcttattgaggcaggtacaagattcaacttaggccctgtgactatcaccctgtctgagccaagaaacattcagcagaagcttccccctgagatcattacgttgcatcccaaaattgaagaaggcttctttgacttgatgcatgtacaaaaagtgttgtctgcaagtacagtgtgtaaactgcagagttgcacacatggtataccaggagacctacaagtttaccacattggcaacttgttgaaaggggatagagtaaacgggcatctaattcacaaaattgaaccacattttaacacctcttggatgtcctgggatggttgtgatctagactactactgcaacatgggggactggccttcttgcacatacacaggagtgacccagcataatcatgctgcatttgtaaacttgcttaacattgaaactgattacacgaaaaccttccacttccactctaaaagagtcacagcacatggtgacacaccacaattagacttaaaagcaaggccgacctacggtgcaggtgagatcactgtgctggttgaggttgctgacatggagttgcataccaaaaaagttgagatatcaggcttgaaatttgcaagcctggcatgcacgggttgctatgcttgtagctctggcatctcctgtaaagtcagaattcatgtagatgaaccagatgagctcacagtgcatgtaaagagcagtgatccagacgtggttgcagctagcacaagtcttatggcaaggaagcttgaatttgggacagacagcacattcaaggccttttcagctatgcctaaaacctctttatgtttttacattgtggagagagaatactgcaagagctgcagtgaagatgataccaaaaaatgtgttgacacaaaacttgagcagccacagagcatactaattgagcacaaagggacgataattggaaagcagaatgatacttgcacagccaaggcaagctgttggctagagtcagtcaagagttttttttatggattgaagaatatgctcggcagtgtttttggcaatttttttataggcattttgttattccttgccccttttgtcctgttggtgcttttctttatgtttggatggaaaatcttgttttgctttaaatgttgcaggaggaccagaggcttgtttaagtatagacacctcaaagacgatgaggaaacaggctacagaaggattattgaaagactgaacaacaaaaaggggaaaaacagactgcttgatggtgaaaggttggctgataggaaaattgctgagctgttctccacaaaaacacacattggc

SEQ ID NO: 3885 - RNA, 2916 nt, synthetic construct
  misc_feature 1..2916: note = derived and/or modified CDS sequence (wt) from CCHFV(Gaib, Artificial)__KX013445.1__Gn-4aa-Gc
  source 1..2916: mol_type = other RNA
tccgaagaatccagtgatgactgcatatcaagaactcagctattaaggacagagactgcagaaatccataatgataattatggagggccaggtgacaaaataactatttgtaatggttcaactattgtagatcaaaggctaggcagtgaactgggatgttacactatcaatagagtaaagtcatttaagctatgcgaaaacagtgctacagggaaatcctgtgaaatagatagcatccctgtaaagtgcaggcaagggttttgtttaaaaattactcaggagggaagaggccatgtgaagttgtcaagaggttcagaagttgtcttagatgcctgtgattcaagctgtgaaataatgataccaaaaggcaccggagacatcctagtggactgttcaggtgggcaacaacattttttaaaggataacttgattgacttagggtgtcccaatatcccactgttaggcaaaatggctatctacatttgtagaatgtctaatcatcccaaaacaaccatggcctttctcttttggtttagttttggttatgtgataacctgtatattttgcaaagccatcttttatttgttgataatcgtggggacacttggaaaaaagttcaaacagtatagagagttaaaacctcagacctgtaccatatgtgaaacaactcctgtcaacgcaatagacgctgaaatgcatgatcttaactgcagttacaatatatgcccttattgtgcatctagattaacctcagatggacttgccagacacgttgtgcactgccctaagcggaaggagaaaatagaagagactgaactgtacttaaacttagaaagagttccttgggttgttagaaaactacttcaggtgtctgaatcaactggtgtggcactgaagaggagcagttggctaattgtgctacttgtgctacttacagtctcattgtcaccagttcaatcagcacccatcggtaggaaacccctgttctcagacagcatagttaagggcatgaaaaacctgctgaactcaacaagtttagagacaagtttatcaattgaggcaccatggggagcgataaatgtccaatcaacctttaaacctactgtatcaactgcaaatatagcactcagttggagctcaatagagcacagaggcaacaagattctggtctcaggcagatcagagtcaatcatgaagctagaagagaggacaggaatcagctgggacctaggcgtggaagatgcttccgagtctaggttacttactgtttctgttatggatttgtcacaaatgtactctcccgtttttgaatacctgtcaggtgacagacaggtggaggaatggcctaaagcaacctgcacaggcgactgtcctgaaagatgtggatgcacatcgtcaacctgcttacacaaagaatggcctcattcaagaaattggagatgcaatcccacttggtgctggggagttggtaccgggtgcacctgctgtggactagatgtaaaagacctttttacagactatatgtttgtcaaatggaaagtcgagtacataaagacagaggctatagtgtgtgttgaacttacaagccaagaaaggcaatgcagtttgattgaggcaggcacaagattcaacttaggtccagtgaccatcacattgtcagaaccgagaaacattcagcaaaagcttcctcctgaaataatcacattgcaccctagaattgaagaaggcttctttgacctaatgcacgtgcagaaagtgctgtctgctagtacggtgtgtaaactacagagttgcacacacggtgtgccgggggatctacaggtctaccacattggcaatttgttaaaaggggataaggtgaacggacatctgattcacaagattgaaccacacttcaacacttcttggatgtcctgggatggttgtgacctggactactactgcaatatgggggattggccttcctgcacgtatactggagtaacccaacataaccacgccgcatttgtgaacctgctcaacattgaaactgattataccaaaaacttccacttccactctaagagagttactgcacatggagacacaccgcaattggatttgaaggctagaccaacctatggtgcaggcgagatcactgtgctggtagaagttgctgacatggagctacacacaaaaaagattgagatatcaggcctgaaatttgcgagtctaacttgcacaggttgctatgcttgcagctctggcatctcctgtaaagttaggatccatgtagatgaaccagatgagcttacagtgcatgtgaaaagtgaagatccagacatagttgcagctagctcaagtctcatggcaaggaagcttgaatttggtacagacagtacctttaaagccttttcagctatgcccaaaacctctttatgcttttacattgtagagagagaatattgcaagagctgcagtagagaagacacacaaaaatgtgtcagcacaaaacttgagcaaccacagagcattttaattgaacacaaaggaacgataatcggaaaacagaataacacctgcacaactaaaacaacctgttggttggaatcagtaaagagtttcttttatggactaaagaacatgcttagcagtatttttggcaatgttttcgtgggcattttctcattccttgcccctttcatcttactgatacttttcttcatgtttgggtggagaatcctattttgctttaagtgttgcagaaggactagaggcttatttaagtacagacatctcaaagacgatgaagagaccggttataggaggatcattgaaagattaaacaacaaaaaaggaaagagcaagttgcttgatggtgaaaggttggctgataggaagattgctgagctgttctccacaaaaacacacattgga

SEQ ID NO: 3886 - RNA, 2916 nt, synthetic construct
  misc_feature 1..2916: note = derived and/or modified CDS sequence (wt) from CCHFV(Hodzha, Artificial)__KX013448.1__Gn-4aa-Gc
  source 1..2916: mol_type = other RNA
tctgaagaatctggtgacgactgcatatcaagaactcagctactgaggacagagactgcagagatccatggtgatgattatggtggtccgggcgacaagattaccatttgcaatggttcaactattgtagatcaaagactaggtagtgaactggggtgttacactatcaatagagtgaagtcattcaagctgtgcgaaaacagtgcaacagggaagagctgtgaaatagacagcaccccagttaaatgcaggcagggttattgcctaaaaatcactcaggaaggaaggggccatgtgaaattatccaggggctcggaggttgtcttggatgcatgcgattcaagctgtgaagtaatgatacctaagggcacaggtgacatcctagtagactgttcaggtgggcagcaacattttttgaaagacaacttaattgatctaggatgtcccagaattccattattaggtaaaatggctatttatatttgcagaatgtcgaatcaccctgagacaaccatggctttcctcttttggttcagtttcggctatgtgataacctgtatactctgcaaggccattttctacttattaataattgttggaacactagggaagaggttcaagcagtatagagagttaaaaccccagacctgtaccatatgtgagacaactcctgcaaatgcaatagatgctgaaatgcatgaccttaactgcagttacaacatatgtccctattgtgcatctagactaacctcagatgggcttgctaggcatgtgacacaatgccctaagcggaaggagaaggtagaagaaactgaattgtacttgaacttagagagaattccctggattgtaagaaagctgttgcaggtgtcggagtccactggtgttgcattaaaaagaagcagctggctgattgtgctgcttgtgctgttcgcagtttcattatcacctgttcaatcagcacccattggtagaaggcccctgttcctggatagtatagttaaaggcaagaaaaatctgttaaactccacaagtttagaaacaagcttgtcgattgaggcaccatggggggcaataaatgttcagtcaacctacaaaccaactgtatcaactgcaaacatagcacttagttggagttcagttgaacacagaggtaataagattttggtttcaggcagatcagaatcaattatgaagctggaagaaagaacaggaatcagctgggatcttggcgttgaagatgcctctgaatctaagctacttactgtctctgtcatggacttgtctcagatgtactcccctgtcttcgagtacttatcgggtgacagacaagtagaagagtggcccaaggcaacctgcacaggtgactgctcagaaagatgtggctgcacatcatcaacctgcttacataaagaatggccccattcacgaaactggagatgcaatcccacttggtgctggggggtggggactggctgcacctgttgtggattagatgtgaaagacctatttacagattatatgttcgtcaagtggaaagttgattacattaaaacagaggccatagtgtgtgtagaactcaccagtcaggaaaggcagtgtagcttggttgaggcgggcacaaggttcaatttaggtcctgtaaccatcacattgtcagaaccgaggaacatacaacaaaagctccctcctgaaataatcacattgcatcctaggattgaagaaggtttttttgacctgatgcatgtacaaaaagtgctgtcagcaagcacagtgtgtaaattgcagagttgcacacatggtgtgccaggagatctacaggtctaccacatcggaaatttattaaaaggagataaagtgaacggacacctaattcataaaattgagccgcacttcaatacttcctggatgtcctgggatggctgtgacctagactactactgcaacatgggagactggccttcttgcacatataccggagttactcaacacaatcatgcttcatttgtaaacctgctcaacattgaaactgactatacaaaaagcttccactttcactctaaaagggttactgcacatggagacacaccacaattggatctgaaggcaagaccaacctacggcgcaggagaaatcactgtactggtagaagttgctgatatggagttacacacaaagaagatcgaaataacaggcctcaaatttgcaagcctgacttgcacaggttgttatgcttgtagttcaggcatctcctgcaaagttaggattcacgtggatgaaccagatgagctaacagtacatgttaaaagtgatgatccagatgtagttgcagccagctcaagtctcatggcaaggaaacttgagtttggaacagacagtacattcaaagctttctcagccatgcctaaaacttccttatgcttctacattgtcgaaagggagtactgtaagagctgcagtaaagaagacacacagaaatgtgttaacacaaaacttgagcaaccacagagcattttgatcgaacaaaagggaactataatcggaaagcaaaacaatacttgcacagccaaggcaagttgctggttagagtcagttaaaagtttcttttatggtctaaagaacatgcttagtggcatttttggcaatgtttttgtaggcattttcttatttcttgccccctttatcttgttaatacttttcttcatgtttggatggaggatcctgttttgcttcaagtgttgcagaagaaccaggggcctgtttaagtataaacatctcaaagacgatgaagaaactggttacagaaggatcattgaaagactgaacaacaagaaggggaaaaacaagctgcttgacggtgaaagacttgccgatagaaggattgccgaactattctccacaaaaacacacattggc

SEQ ID NO: 3887 - RNA, 2916 nt, synthetic construct
  misc_feature 1..2916: note = derived and/or modified CDS sequence (wt) from CCHFV(IbAn7620, Artificial)__KX013451.1__Gn-4aa-Gc
  source 1..2916: mol_type = other RNA
tccgaagaacccagtgatgactgtatatcaagaactcaactattgaggacagagactgcagagatccacggcgacaactatggtggcccgggtgataaaataaccatctgcaatggctcaactattgtagaccaaagactgggcagtgaactagggtgttacaccatcaatagagtgaagtcattcaagctatgcgaaaacagtgccacagggaagaattgtgaaatagacagtgtcccagttaaatgcaggcagggttattgcctaagaatcactcaagaagggaggggccacgtaaaattatctaggggctcagagattgtcttagatgcatgcgatacaagctgtgaaataatgatacctaagggcactggtgacatcctagttgactgttcaggtgggcagcaacattttctaaaggacaatttgatagatctaggatgccctaaaattccattattgggcaaaatggctatttacatttgcagaatgtcgaaccaccccaaaacaaccatggctttcctcttctggttcagctttggttatgtaataacctgtatactttgcaaggccattttttacttgttaataattattggaacactagggaaaaggctcaagcagtatagagagttgaaacctcagacctgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtagaaagcctttgttcctagatagtatagctaaaggcatgaaaaatccgctaaattcaacaagtttagaaacgagtttatcaattgaggcaccatggggagcaatagatgttcagtcaacctacaaaccaactgtgtcaactgcaaacatagcactcagttggagctcagtggaacacagaggtaataagatcttggtttcaggcagatcagaatcaattatgaagctagaagaaaggacgggaatcagctgggatctcggcgtagaagatgcctctgagtctaaactgcttacagtctctgtcatggacctgtctcagatgtactctcctgtcttcgagtacttatcaggggacagacaggtggaagagtggcccaaagcaacttgtacaggtgattgcccagaaagatgtggttgcacatcatcaacctgtttgcacaaagaatggcctcactcaagaaattggagatgcaatcccacttggtgctggggagtagggactggctgcacctgttgtggattagatgtgaaagacctttttacagattatatgtttgtcaagtggaaagttgaatacatcaagacagaggccatagtgtgtgtagaacttaccagtcaggaaaggcagtgtagcttgattgaagcgggcacgaggttcaatttaggtcctgtgaccatcacactgtcagaaccaagaaacatccaacaaaaactccctcctgaaataatcacactgcatcctaggatcgaagaaggtttttttgatctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacttcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagacacaccacaactagatcttaaggcaagaccaacctatggtgcaggcgagatcactgttctggtagaagttgctaacatggagttacatacaaagaagattgaaatatcaggcttaaaatttgcaagcttgacttgtacaggttgttatgcttgtagctctggcatctcatgcaaagttagaattcatgtggatgaaccagatgaacttacagtacatgttaaaagtgatgatccagatgtggttgcagctagctcaagtctcatggcaagaaagcttgaatttggaacagacagtacatttaaagctttctcggccatgcccaaaacttctctatgtttctacattgttgaaagagaacactgtaagagctgcagtgaagaagatacaaaaaaatgtgttaacacaaagcttgagcaaccacaaagcattttgatcgaacacaagggaactataataggaaagcaaaacagcacttgcacggctaaggcgagttgctggttggagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtacagacacctcaaagacgatgaagaaactggttatagaaggattattgaaagactaaacaataaaaaaggaaaaaacaagctgcttgatggtgaaagacttgctgatagaagaattgccgaactgttctctacaaaaacacacattggc

SEQ ID NO: 3888 - RNA, 2916 nt, synthetic construct
  misc_feature 1..2916: note = derived and/or modified CDS sequence (wt) from CCHFV(K128_76, Artificial)__KX013454.1__Gn-4aa-Gc
  source 1..2916: mol_type = other RNA
tctgatgaatctggtgatgactgcatatcaaggactcagctgttgagaacagagactgcagagatccatggtgacaattatggtggtccgggtgacaagattaccatttgcaatggttcaactattgtagaccaaagactgggtagtgaactggggtgttacactatcaatagagtgaagtcattcaagctgtgcgaaaacagtgccacagggaagagctgtgaaatagacagtatcccagttaagtgcaggcagggttattgcctaaaaatcactcaagaaggaaggggccatgtgaaattatccaggggctcagaggttgtcttggatgcatgcgactcaagctgtgaagtaatgatacctaagggcacaggtgacattctagtagactgttcaggtgggcagcaacattttttgaaggacaacttgattgacctaggatgtcccaaaattccattgttgggcaaaatggctatttatatttgtagaatgtcgaatcaccccaaaacgaccatggctttcctcttttggttcagttttggctatgtgataacttgtatagtctgcaaagccattttttacttattaataattgttggaacactagggaagaggtttaagcagtatagagagttaaaaccccagacctgtaccatctgtgagacaactcctacaaatgcaatagatgctgaaatgcatgaccttaactgcagttacaacatatgtccctattgtgcatctagactaacctcagatgggcttgctaggcatgtaactcattgccctaagcggaaggagaaagtagaagaaactgaattgtacttgaacttagaaagaattccatgggttgtaagaaagctattgcaggtatcagagtccaccggtgtagcattaaaaagaagcagctggctgattgtgctgcttgtgctgtttgcagtttcattatcaccagttcaatcagcacccattagtagaaggcccctgtttcaggacagtatagtcaaaggcatgaaaaacctgctaaactcaacaagtttagaaacaagcttgtcgattgaggcaccatggggggcaataaatgttcagtcaacctacaaaccagctgtgtcagctgcaaacatagcacttagttggagttcagttgaacacagaggtagtaagattttggtttcaggcagatcagaatcaattatgaagctggaagaaaggacaggaatcagctgggatcttggcgtagaagatgcctctgaatctaagctacttacagtctctgtcatggacttgtctcagatgtactcccctgtcttcgagtacttgtcaggtgacagacaagtagaagagtggcccaaggcaacctgtacaggtgactgcccagagagatgtggttgtacatcatcaacctgtttgcataaagaatggccccattcaagaaactggaggtgtaatcccacttggtgctggggggtagggactggctgcacctgttgtggtttagatgtgaaagacctttttacagactatatgttcgtcaagtggaaagttgaatatattaagacagaggccatagtgtgtgtagaacttaccagtcaggaaaggcagtgtagtttaattgaggcaggtacaaggttcaatttaggtcctgtgaccatcacattgtcagaaccgaggaacatccaacaaaagctccctcctgaaataatcacactgcatcctaggattgaagaaggtttttttgacctgatgcatgtgcaaaaggtgctgtcagcaagcacagtgtgtaagttgcagagttgcacacatggtgtgccaggagatctacaagtctaccacatcgggaatttactaaaaggagatagagttaacggacacctaattcataaaattgagccacactttaacacttcttggatgtcctgggatggctgtgacctagactattactgcaacatgggagactggccttcttgcacatataccggagttacccagcacaatcatgcttcatttgtgaacctgctcaacattgaaactgactatacaaaaagcttccattttcactctaaaagggttactgcacatggagacacaccacaattagatctgaaggcaaggccaaactatggcgcaggagagatcaccgtactggtagaggttgccgatatggagttacacacaaagaagattgaaatatcaggcctaaagtttgcaagcttgacttgtacaggttgttatgcttgtagttccggtatctcctgtaaagttaggattcatgtggatgaaccagatgaacttacagtacatgttaaaagtgatgatccagatgtagttgcagctagctcaagtctcatggcaaggaagcttgaatttggaacagacagtacatttaaggctttctcagccatgcccaaaacctccttatgtttctacattgtcgaaagggagtactgcaagagctgcagtaaagaagacacacaaaaatgtgttaacacaaaacttgagcagccacagagcattttaatcgaacataagggaactataatcggaaagcaaaacaatacctgcacagcaaagacaagttgctggttagagtcagttaaaagtttcttttatggtttaaagaacatgcttagtggcatttttggcaatgtttttgtgggtattttcttatttcttgcccccttcatcttgctaatacttttctttatgtttgggtggaggatcctgttttgcttcaagtgctgtagaagaaccagaggcctgttcagatataagcatctcgaaaacgatgaagaaactggttacagaagaatcattgaaagactgaacaacaaaaaaggaaaaaacaagctgcttgatggtgaaagacttgctgatagaagaatcgccgaactattctccacaaaaacacacattggc

SEQ ID NO: 3889 - RNA, 2916 nt, synthetic construct
  misc_feature 1..2916: note = derived and/or modified CDS sequence (wt) from CCHFV(K168_40, Artificial)__KX013457.1__Gn-4aa-Gc
  source 1..2916: mol_type = other RNA
tctgatgagtctggtgatgactgcatatcaaggactcagctactgagaacagagactgcagagatccatggtgacaattatggtggtccgggtgacaagattaccatttgcaatggttcaactattgtagaccaaagactgggcagtgaactggggtgttacactatcaatagagtgaagtcattcaagctgtgcgaaaacagtgccacagggaagagctgtgaagtagacagtatcccagtaaaatgcaggcagggttattgcctaaaaatcactcaggaaggaaggggccacgtgaaattatccagaggttcagaggttgtcttggatgcatgcgattcaagctgtgaagtaatgatacctaagggcacaggtgacatcctagtggactgttcaggtgggcagcaacatttcttgaaggacaacttaattgacctaggatgtcccaaaattccattgttgggcaaaatggctatttatatttgcagaatgtcgaatcaccccaagacaaccatggctttcctcttttggttcagttttggctatgtgataacttgtatagtctgcaaggccattttttacttattaataattgttggaacactagggaagaggtttaagcagtatagagagttaaaaccccagacctgcaccatctgtgagacaactcctacaaatgcaatagatgctgaaatgcatgaccttaactgcagttacaacatatgtccctattgtgcatctagactaacctcagatgggcttgctaggcatgtaactcattgccctaagcggaaagagaaagtagaagaaactgaattgtacttgaacttagagagaattccctgggttgtaagaaagctgttgcaggtatcagagtccaccggtgtagcattaaaaagaagcagctggctgattgtgctgcttgtgctgtttgcagtttcattatcaccagttcaatcagcacctattggtagaaggcccctgtttctggacggtatagtcaaaggcatgaaaaacctgctaaactcaacaagtttggaaacaagcttgtcgattgaggcaccatggggggcaataaatgttcagtcaacctacaaaccaactgtatcagctgcaaacatagcacttagttggagttcagttgaacacagaggtaataagattttggtttcaggcagatcagaatcaattatgaagctggaagaaaggacaggaatcagctgggatcttggcgtagaagatgcctctgaatctaagctactcacagtctctgtcatggacttgtctcagatgtactctcctgtcttcgagtacttgtcaggtgacagacaagtagaagagtggcccaaggcaacctgtacaggtgactgcccagagagatgtggctgtacatcatcaacctgtttgcataaagaatggccccattcaagaaactggaggtgtaatcccacttggtgctggggggtagggactggctgcacctgttgtggtttagatgtgaaagacctttttacagactatatgtttgtcaagtggaaagtcgaatacattaagacagaggccatagtgtgtgtagaacttaccagtcaggaaaggcagtgtagcttaattgaggcgggtacaaggttcaatttaggtcccgtgaccatcacattgtcagaaccgaggaacatccaacaaaaactccctcctgaaataatcacactgcatcctaggattgaagaaggtttttttgacctgatgcatgtacaaaaggtgctgtcagcaagcacagtgtgtaagttgcagagttgcacacatggtgtgccaggagatctacaggtctaccacatcggaaatttactaaaaggagataaagttaacggacacctaattcataaaattgaaccacacttcaacacttcttggatgtcttgggatggctgtgacctagactactactgcaacatgggagattggccttcttgcacatataccggggttacccagcacaatcatgcttcatttataaacctgctcaacattgaaactgactatacaaaaagcttccattttcactctaaaagggttactgcacatggagacacaccacaattagatctgaaggcaaggccaaactatggcgcaggagagatcaccgtactggtagaggttgccgatatggagttacacacaaagaagattgaaatatcaggactaaagtttgcaagcttgacttgtacaggttgttatgcttgtagttccggtatctcctgtaaagttaggattcatgtggatgaaccagatgaacttacagtacatgttaaaagtgatgatccagatgtagttgctgctagctcaagtctcatggcaaggaagcttgaatttggaacagacagtacatttaaggctttctcagccatgccaaaaacctccttatgtttctatattgtcgaaagggaatactgcaagagctgcagtaaagaagacacacaaaaatgtgttaacacgaagcttgagcatccacagagcattttgatcgaacataagggaactataatcggaaagcagaacaatacctgcacagcaaagacaagttgctggttagagtcagttaagagtttcttttatggtttaaagaacatgcttagtggcattttcggcaacgtttttgtaggcattttcttatttcttgcccccttcatcttgctaatacttttctttatgtttgggtggaggatcctattttgcttcaagtgctgtagaagaaccagaggcctgtttagatataaacatctcgaagacgatgaagaaactggttacagaagaatcattgaaagactgaacaacaaaaaaggaaaaaacaagctgcttgatggtgaaagacttgctgatagaagaattgccgaactattctccacaaaaacacacattggc

SEQ ID NO: 3890 - RNA, 2916 nt, synthetic construct
  misc_feature 1..2916: note = derived and/or modified CDS sequence (wt) from CCHFV(K168_125, Artificial)__KX013460.1__Gn-4aa-Gc
  source 1..2916: mol_type = other RNA
tctgatgagtctggtgatgactgcatatcaaggactcagctactgagaacagagactgcagagatccatggtgacaattatggtggtccgggtgacaagattaccatttgcaatggttcaactattgtagaccaaagactgggcagtgaactggggtgttacactatcaatagagtgaagtcattcaagctgtgcgaaaacagtgccacagggaagagctgtgaagtagacagtatcccagtaaaatgcaggcagggttattgcctaaaaatcactcaggaaggaaggggccacgtgaaattatccagaggttcagaggttgtcttggatgcatgcgattcaagctgtgaagtaatgatacctaagggcacaggtgacatcctagtggactgttcaggtgggcagcaacatttcttgaaggacaacttaattgacctaggatgtcccaaagttccattgttgggcaaaatggctatttatatttgcagaatgtcgaatcaccccaagacaaccatggctttcctcttttggttcagttttggctatgtgataacttgtatagtctgcaaggccattttttacttattaataattgttggaacactagggaagaggtttaagcagtatagagagttaaaaccccagacctgcaccatctgtgagacaactcctacaaatgcaatagatgctgaaatgcatgaccttaactgcagttacaacatatgtccctattgtgcatctagactaacctcagatgggcttgctaggcatgtaactcattgccctaagcggaaagagaaagtagaagaaactgaattgtacttgaacttagagagaattccctgggttgtaagaaagctgttgcaggtatcagagtccaccggtgtagcattaaaaagaagcagctggctgattgtgctgcttgtgctgtttgcagtttcattatcaccagttcaatcagcacctattggtagaaggcccctgtttctggacagtatagtcaaaggcaagaaaaacctgctaaactcaacaagtttggaaacaagcttgtcgattgaggcaccatggggggcaataaatgttcagtcaacctacaaaccaactgtatcagctgcaaacatagcacttagttggagttcagttgaacacagaggtaataagattttggtttcaggcagatcagaatcaattatgaagctggaagaaaggacaggaatcagctgggatcttggcgtagaagatgcctctgaatctaagctactcacagtctctgtcatggacttgtctcagatgtactctcctgtcttcgagtacttgtcaggtgacagacaagtagaagagtggcccaaggcaacctgtacaggtgactgcccagagagatgtggctgtacatcatcaacctgtttgcataaagaatggccccattcaagaaactggaggtgtaatcccacttggtgctggggggtagggactggctgcacctgttgtggtttagatgtgaaagacctttttacagactatatgtttgtcaagtggaaagtcgaatacattaagacagaggccatagtgtgtgtagaacttaccagtcaggaaaggcagtgtagcttaattgaggcgggtacaaggttcaatttaggtcccgtgaccatcacattgtcagaaccgaggaacatccaacaaaaactccctcctgaaataatcacactgcatcctaggattgaagaaggtttttttgacctgatgcatgtacaaaaggtgctgtcagcaagcacagtgtgtaagttgcagagttgcacacatggtgtgccaggagatctacaggtctaccacatcggaaatttactaaaaggagataaagttaacggacacctaattcataaaattgaaccacacttcaacacttcttggatgtcttgggatggctgtgacctagactactactgcaacatgggagattggccttcttgcacatataccggggttacccagcacaatcatgcttcatttataaacctgctcaacattgaaactgactatacaaaaagcttccattttcactctaaaagggttactgcacatggagacacaccacaattagatctgaaggcaaggccaaactatggcgcaggagagatcaccgtactggtagaggttgccgatatggagttacacacaaagaagattgaaatatcaggcctaaagtttgcaagcttgacttgtacaggttgttatgcttgtagttccggtatctcctgtaaagttaggattcatgtggatgaaccagatgaacttacagtacatgttaaaagtgatgatccagatgtagttgctgctagctcaagtctcatggcaaggaagcttgaatttggaacagacagtacatttaaggctttctcagccatgccaaaaacctccttatgtttctatattgtcgaaagggaatactgcaagagctgcagtaaagaagacacacaaaaatgtgttaacacgaagcttgagcatccacagagcattttgatcgaacataagggaactataatcggaaagcagaacaatacctgcacagcaaagacaagttgctggttagagtcagttaagagtttcttttatggtttaaagaacatgcttagtggcattttcggcaacgtttttgtaggcattttcttatttcttgcccccttcatcttgctaatacttttctttatgtttgggtggaggatcctattttgcttcaagtgctgtagaagaaccagaggcctgtttagatataaacatctcgaagacgatgaagaaactggttacagaagaatcattgaaagactgaacaacaaaaaaggaaaaaacaagctgcttgatggtgaaagacttgctgatagaagaattgccgaactattctccacaaaaacacacattggc

SEQ ID NO: 3891 - RNA, 2916 nt, synthetic construct
  misc_feature 1..2916: note = derived and/or modified CDS sequence (wt) from CCHFV(K229_194, Artificial)__KX013463.1__Gn-4aa-Gc
  source 1..2916: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaaggcaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtatcagagtccactggtgtggcattgaaacgaagcagctggctgattgtgctgcttgtgttactcacagtctcattgtcaccggttcaatcagcacctgttggtaggaaacctctttttttagacagtatagttaaaggtaagaaaaatctgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggacctgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacctgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctattcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttatgtttttacattgtggagagggaatactgcaagagctgcagtgaagatgatacaaaaaaatgtgttgacacaaaacttgagcagccacagagcatactaattgagcacaaagggacgataattggaaagcaaaatgacacttgcacagccaaggcaagttgttggctagagtcagtcaagagttttttttatggattgaagaatatgcttggcagtgtttttggtaattttttcgtaggcattttgttattccttgccccctttgtcttgttggtgcttttctttatgtttggatggaaaatcttgttttgctttaagtgttgcaggaggaccagaggcttgtttaagtatagacacctcaaagatgatgaggaaacaggctacagaaagattattgaaagactgaacagcaaaaaaggaaaaaacagactgcttgatggtgagaggttggctgataggaaaattgctgagctgttctctacaaaaacacacattggc

SEQ ID NO: 3892 - RNA, 2916 nt, synthetic construct
  misc_feature 1..2916: note = derived and/or modified CDS sequence (wt) from CCHFV(K229_243, Artificial)__KX013466.1__Gn-4aa-Gc
  source 1..2916: mol_type = other RNA
tccgaagagccaggtgatgactgcatatcaagaactcagctattgaggacagaaacagcagagatccatgatgacaactatggtggtccaggtgataaaataactatctgcaacggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgtcttggatgcctgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgtaaggctcttttttattcattgataattattgggacactagggaaaaagatcaagcaatatagggaattgaaacctcaaacttgtaccatatgtgagacagctcctgtcaatgcaatagatgctgaaatgcatgaccttaactgcagttacaatatatgcccttattgtgcatcaagattgacctccgatgggctggctaggcatgtgccacaatgccccaagcggaaggaaaaagttgaggagactgagctgtacttgaacctggaaagaatcccttggattgtcagaaagctattgcaagtgtcagagtccactggtgtggcattgaaacgaagcagctggctgattgtactgcttgtgttactcacagtttcattgtcaccggttcaatcagcacctgttggtagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtggaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgtacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactatcaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatcttcaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagaaagaatactgcaagagctgcagtgaagaggacacacaaaaatgtgttgacacaaaacttgagcagccacagagcatactaattgagcacaaaggaacgataattggaaagcagaatgatacttgcacagccaaagcaagctgttggctagagtcagtcaagagttttttttatggattgaagaatatgcttggtagtgtctttggtaactttttcataggcattttgttattccttaccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaagggaaaaacagactgcttgatggtgaaaggttggctgataggaaaattgctgagctgttctccacaaaaacacacattggt

SEQ ID NO: 3893 - RNA, 2916 nt, synthetic construct
  misc_feature 1..2916: note = derived and/or modified CDS sequence (wt) from CCHFV(K315_14, Artificial)__KX013469.1__Gn-4aa-Gc
  source 1..2916: mol_type = other RNA
tccgaagagccaggtgacgactgcatatcaagaactcagctattgaagacagaaacagcagaaatccatgacgacaactatggtggtccaggtgacaaaataactatctgcaatggttcaaccgttgtggatcagagactgggcagtgaactagggtgttataccatcaacagggtgaagtcattcaagctatgcaaaaacagtgccacagggaaaacctgtgagatagacagcactccggtcaagtgcaggcaaggtttttgtttgaaaatcacccaagagggaaggggccacgtaaaattatccaggggctcagaggttgttttggatgtttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgaagggctagctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggtaggaaacctcttttcttagacagtatagttaaaggtatgaaaaaattgctaaactcaacaagcttagaaacaagcttatcaattgaggcaccatggggagcaataaatgtccagtcaacctttaaaccaacagtatctactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggacttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacatcggtaacttgttgaaaggggatagagtaaacgggcatctgattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcctgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagccatgcccaaaacctctttatgcttttacattgtagagagggaatactgcaagagctgcagtgaagatgatacaaaaaaatgtgttgacacaaaacttgagcagccacagagcatactaattgagcacaaggggacaataattggaaagcagaatgatacttgcacagccaaggcaagttgttggctagagtcagtcaagagttttttttatggactgaagaatatgcttggcagtgtttttggtagttttttcgtaggcattttgttattccttgccccttttgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaagggaaaaacagactgcttgatggtgagaggttggctgataggaaaattgctgagctgttctctacaaaaacacacattggc

SEQ ID NO: 3894 - RNA, 2916 nt, synthetic construct
  misc_feature 1..2916: note = derived and/or modified CDS sequence (wt) from CCHFV(K323_27, Artificial)__KX013472.1__Gn-4aa-Gc
  source 1..2916: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaagctcttttttatttattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgactgtgctgcttgtgttactcacagtctcattgtcaccggtccaatcagcacctgttggcaggaaacctcttttcttagacagtatagccaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatacataaaaaccgaagccatagtatgtgttgagctcaccggccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgttgttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctggagtcagtcaagagttttttttatggattgaagaatatgcttggcagtgtttttggtagttttttcgtaggcattttgttattccttgccccttttgtcttgttggtgcttttctttatgtttggatggaaaatcttgttttgctttaagtgttgcaggaggaccagaggcttgtttaagtatagacacctcaatgatgacgaggaaacaggctacagaaggatcattgaaagactgaacagcaaaaaaggaaaaaacagactgcttgatggtgagaggttggctgataggaaaattgctgagctgttctctacaaaaacacacattggc

SEQ ID NO: 3895 - RNA, 2916 nt, synthetic construct
  misc_feature 1..2916: note = derived and/or modified CDS sequence (wt) from CCHFV(K340_6, Artificial)__KX013475.1__Gn-4aa-Gc
  source 1..2916: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtctttcaagctatgcgaaaacagtaccacagggaaaacctgtgagatagacagcactccggtcaagtgcaggcaaggcttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgccattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctggctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggtaggaaacccctttccttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagagtaaacggccatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttactgacatggagttgcataccaaaaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtagttttttcgtaggcattttgttattccttgcccctttcgtcttgttggtgcttttctttatgtttggatggaaaatcttgttttgctttaagtgttgcaggaggaccagaggcttgtttaagtatagacacttcaaagatgacgaggaaacaggctacagaaggattattgaaagactgaacagcaaaaaaggaaaaaacagactgcttgatggtgagaggttggctgataggaaaattgctgagctgttctctacaaaaacacacattggc

SEQ ID NO: 3896 - RNA, 2916 nt, synthetic construct
  misc_feature 1..2916: note = derived and/or modified CDS sequence (wt) from CCHFV(Mamon, Artificial)__KX013478.1__Gn-4aa-Gc
  source 1..2916: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgtttcggatgcttgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactgtggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattaaaacgaagcagctggctgattgtactgcttgtgttactcacagtttcattgtcaccggttcaatcagcacctgttggtagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtgtgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggtgatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctcgttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaagacaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 3897 - RNA, 2916 nt, synthetic construct
  misc_feature 1..2916: note = derived and/or modified CDS sequence (wt) from CCHFV(Min, Artificial)__KX013481.1__Gn-4aa-Gc
  source 1..2916: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcgttcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtactatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtagaaaacctctgttcttagacagtatagttaaaggcacgaagaatttgctaaactcaacaagcttagaaacaagcttatcaattgaggcaccatggggagcaataaatgtccagtcaacctttaaaccaacagtgtcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcctacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggataggataaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 3898 - RNA, 2916 nt, synthetic construct
  misc_feature 1..2916: note = derived and/or modified CDS sequence (wt) from CCHFV(Nakiwogo, Artificial)__KX013484.1__Gn-4aa-Gc
  source 1..2916: mol_type = other RNA
gcagaaggagtgagcaatgactgcgtttcaaggacccagctaatcaaaacagaagttgcagagattcacgaagatagctacggtgggcctggagaaaaaataacaatctgcaacggctccacaatcgtggaccaaaggcttggtagcgaactaggttgctacacaattaaccgcgtgaagacttataagctttgtgagaacagtgccacagaaaagggttgtgagatcgatagtgttccagtcaaatgcaaacaagggttctgcctcaaagtaacccaagagggcaggggccatgtgaaactatctagaggaacggaaattgtcctggatgtgtgtgacaccagttgtgagttgatgatacctaaaggcactggagacatattggtggattgctcaggaggacagcagcacttcttgcaggacaacttgattgacttaggttgcccaaatgtaccattactaggcaagatggcaatatatatctgcaggatgtcgaaccatcctaagaccaccatggcttttttgttctggttcagttttggctatgtcatcacatgcgtagtatgcaaagtgctcttctatctgctaattgtcattgggacactaggaaagaaacttaaacagtatagggaactaaaacctcagacatgcattgtctgtgaatcaatccctgtcaatgtaatagatgctgaaatgcacgagctcaattgcaattacaatatatgcccatactgtgcgtccagactgacttcagatggactagttagacatgtgactcaatgtcccaaaaggaaggaaaaggtcgaggagactgagctgtacttgaacctggagaggataccttggttggtaagaagactactgcaagtgtcagagtcaacagggatggctctaaagagaagttgctggatgaccacactcctcattctgctagtagtttcattgtctccagttcaatctgctccagttggtagaaagcccctttacctggatagcatagccaaggggatgaaaagtctgttaaattctacgaacttagagacaagcctgtcgattgaggccccatggggagcaatcaatgttcagtcaacttttaaaccaacagtttcagctgccaacatagcacttagctggagttcagttgaacacaggggcaacaaaatcctagtttcgggcaggtcagagtcaattatgaaactggaagaacggaccggcatcagctggagcctaggtgtagaggatgcttctgagtcaaagacgcttactgtttctgtcatggatctgtctcaaatgtattctcctgtctttgagtatctgtcaggtgatagacaagtagaagagtggccaaaggccacttgcacaggcgactgcccagagagatgtggctgcacctcctcaacctgcttgcataaagaatggccgcactcgagaaactggcgatgcaaccccacttggtgttggggagtagggactggctgcacctgctgcggactggatgttagagaccttttcacggactacatgatggtcaagtggaaagtggaatatgtaaaaacagaagctataatgtgtgttgagctaactagtcaggaaaggcagtgtagtttaattgaggcaggtacaaggtttaacctgggccctgtgacaataaccctgtcagagccaagaaatgtccagcaaaggctcccttccgaaatcgttacactgcaccctaagatagaggaaggattctttgatttgatgcatgtgcaaaaagtactattctgcaagcacagtttgcaagctacaagctgcacacacggtgtcccaggcgatttgcaggtctaccatgttggcaacctactgaaaggagacaaggttaatgggcactcaattcacaagatagagtctcatttcaacacttcatggatgtcatgggatggatgtgacctagactacttttgcaacatgggtgactggccttcatgtacatatactggagtgacacagcacaaccgtgcggcattcgtcaacatgctcaatattgagactgattacacaaagacttttcacttccattccaagagggttacggcacacggtgacacccctcaactggatctgaaggcaagaccaacatatggtgcaggcgaggtcactgttctagtggaggttgcagatctggagctacacactaagaaaatagaagtgtcagggttgaagtttgcaagtctgacctgctctggttgttatgcctgcagttccggcatctcctgcaaagttagaattcatgtgaatgaaccagatgagttcacagtacacgtgaaaagcaatgatccagacgttgtggcagcaggatcaagtctgatggcaaggaaaatagagttaggggctgacagcacctttaaagccttttcatcaatgcctaaaaactctttgtgcttttatatagtggaaagagactactgcagcagctgcaccgatgatgacactcagaagtgtgttaacacaaagctcgaacatccacaaagcatattaattgagcataagggaacaataattggtaagcaaaatgacacctgtccgaccaaaacaagctgctggctagaatcagtcaagagttttttttatggactgaaaaacatgctgggtggcatcttcggtaatgtcttcttaggcatcttcctattccttgctccttttgcactgctgatactcttcttcttcttcgggtggaggcttctgttctgtctgaagtgttgcagaaggaccaggggtctgctaaagtataaacaacttaaggatgaagaagaagccgggtacaagaaaatcatcgagaggctgaatgacaaaaagggcaaaagtcgactttttgacggagagaggctcgctgacaggaagattgctgaactcttttcaaccaaaactcatataggg

SEQ ID NO: 3899 - RNA, 2916 nt, synthetic construct
  misc_feature 1..2916: note = derived and/or modified CDS sequence (wt) from CCHFV(Saf, Artificial)__KX013487.1__Gn-4aa-Gc
  source 1..2916: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacattacttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacggctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtagaaaacctctgttctcagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgagactgattacatgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgtaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 3900 - RNA, 2916 nt, synthetic construct
  misc_feature 1..2916: note = derived and/or modified CDS sequence (wt) from CCHFV(Ast199, Artificial)__KX056051.1__Gn-4aa-Gc
  source 1..2916: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttacaccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgcgaaataatgatacctaaaggcactggagatatcctagtagactgttcaggtggacagcaacatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgatgcagctggctgattgtgctgcttgtgttactcacagtctcattgtcaccggttcaatcagcacctgttggtaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaaggaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgaggtatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttgtgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggtgcttttctttatatttggatggaaaatcttgttttgctttaagtgttgcaggaggaccagaggcttgtttaagtatagacacctcaaagatgatgaggaaacaggctacagaaagattattgaaagactgaacagcaaaaaaggaaaaaacagactgcttgatggtgagaggttggctgataggaaaattgctgagctgttctctacaaaaacacacattggc

SEQ ID NO: 3901 - RNA, 2916 nt, synthetic construct
  misc_feature 1..2916: note = derived and/or modified CDS sequence (wt) from CCHFV(Ast149, Artificial)__KX056054.1__Gn-4aa-Gc
  source 1..2916: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttattcgttgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgaagcagctggctgattgtgctacttgtgttactcacagtctcattgtcaccggttcaatcagcacctgttggtaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaaggaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgaggtatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttgtgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggcgcttttctttatatttggatggaaaatcttgttttgctttaagtgttgcaggaggaccagaggcttgtttaagtatagacacctcaaagatgatgaggaaacaggctacagaaagattattgaaagactgaacagcaaaaaaggaaaaaacagactgcttgatggtgagaggttggctgataggaaaattgctgagctgttctctacaaaaacacacattggc

SEQ ID NO: 3902 - RNA, 2916 nt, synthetic construct
  misc_feature 1..2916: note = derived and/or modified CDS sequence (wt) from CCHFV(Ast137, Artificial)__KX056057.1__Gn-4aa-Gc
  source 1..2916: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtggatcagagactgggcagtgaactagggtgttataccatcaacagggtgaagtcattcaagctatgcgaaaacagtgccacagggaaaacctgtgagatagacagcactccggtcaagtgcaggcaagggttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaagatggccattcacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgaagcagctggctgattgtgctgcttgtgttactcacagtctcattgtcaccggttcaatcagcacctgttggtaggaaacctcttttcttagacagtatagttaaaggtacgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaaggaacattcagcagaagcttccccctgagatcattacgctgcatcctaaaattgaagaaggcttctttgacttaatgcatgtgcaaaaagtgttatctgcaagtacagtgtgtaaactgcagagttgcacacatggtataccgggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagggtcacagcacatggagacacaccacaattagacttaaaagcaaggccgacctacggtgcaggtgagatcactgtgctggttgaggttgctgacatggagttgcataccaagaaagttgaggtatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttgtgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggtgcttttctttatatttggatggaaaatcttgttttgctttaagtgttgcaggaggaccagaggcttgtttaagtatagacacctcaaagatgatgaggaaacaggctacagaaagattattgaaagactgaacagcaaaaaaggaaaaaacagactgcttgatggtgagaggttggctgataggaaaattgctgagctgttctctacaaaaacacacattggc

SEQ ID NO: 3903 - RNA, 2916 nt, synthetic construct
  misc_feature 1..2916: note = derived and/or modified CDS sequence (wt) from CCHFV(Ast133, Artificial)__KX056060.1__Gn-4aa-Gc
  source 1..2916: mol_type = other RNA
tccgaagagccagatgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacttgtgagatagacagcactccggtcaagtgcagacaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttatttattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggtaggaaacctcttttctcagacagtatagttaaaggtatgaaaaatttgctaaactcaacaagcttagaaacaagcttatcaattgaggcaccatggggagcaataaatgtccaatcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactattaccctgtctgagccaagaaacattcagcagaagcttccccctgagatcattacgctgcatcccaaaattgaagaaggcttctttgacttgatgcatgtgcaaaaagtgttatccgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaagaaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtagtttttttgtaggcattttgttattccttgccccttttgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaaggaaaaaacagactgcttgatggtgagaggttggctgataggaaaattgctgagctgttctcttcaaaaacacacattggc

SEQ ID NO: 3904 - RNA, 2916 nt, synthetic construct
  misc_feature 1..2916: note = derived and/or modified CDS sequence (wt) from CCHFV(SK/2015/human, Artificial)__KX458183.1__Gn-4aa-Gc
  source 1..2916: mol_type = other RNA
tctgaagaatctggtgatgactgcatatcaagaactcgcctattgagaacagagactgcagagatccatggtgatagctatggtggtccaggtgacaagattactatttgcaatggttcaactattgtagatcaaagactgggtagtgagatggggtgttacactatcaatagagtgaagtcattcaagctgtgcgaaaacagtgcaacagggaagagctgtgaaatagacagtatcccagttaggtgcaggcagggttattgcctaaaaatcactcaggagggaaggggccatgtgaaattatccaggggctcagaggttgtcttggatgcatgcgactcaagctgtgaagtaatgatacctaagggcacaggtgacatccttgtagactgttcaggtgggcagcaacattttttgaaggacaacttaattgatctaggatgtcccaatattccattattaggtaaaatggctatttatatttgcagaatgtcgaatcaccctaagacaaccatggcttttctcttttggttcagttttggctatgtgataacctgtatactctgcaaggctattttctacttattaataattgttggaacactagggaagaggtttaagcagtacagagagttaaaaccccagacctgcaccatatgtgagacaactcctgcaaatgcaatagatgctgaaatgcatgaccttaactgcagttacaccatatgcccctattgtgcatctagactaacctcagatgggcttgctaggcatgtgacacaatgccctaagcggaaggagaaagtagaagaaactgaattgtacctgaacttagagagaattccctgggttgtaagaaagctgttgcaggtatcggagtccactggtgttgcattaaaaagaagtagctggctgattgtgctgcttgtgttgttcacagtttcattatcaccagttcaatcagcacccatcggtagaaggcccttgttcctggatagtatagtaagaggcatgaaaaatctgctaaactcaacaagtttggagacaagcttatcgattgaggcaccatggggagcaataaatgttcagtcaacctacaagccaactgtgtcaactgcaaacatagcacttagttggagttcagttgaacacagaggtaataagattttggtttcaggcagatcagaatcaattatgaagctagaagaaaggacaggagtcagctgggaccttggcgtagaagatgcctctgaatctaagctacttacagtctctgtcatggacttatctcagatgtactctcctgtcttcgagtacttatcaggtgacagacaagtagaagagtggcccaaggcaacctgtacaggtgactgcccagaaagatgtggctgcacaacgtcaacctgcttgcataaagaatggcctcattcaagaaactggagatgtaatcccacttggtgctggggagtggggactggctgcacttgttgtggattagatgtgaaagacctttttactgattatatgttcgtcaagtggaaagttgaatacattaaaacagaggccatagtgtgtgtggaactcaccagtcaaggaaggcaatgcagcttgattgaggcgggcacaaggttcaatttaggttctgtgaccatcacattgtcggaaccgaggaacattcaacataagctccctcctgaaataatcacattgcatcctaggattgaagaaggtttctttgacctgatgcatgtacaaaaagtgttgtcagctagcacagtgtgtaagttgcagagttgcacacacggtgtgccaggtgatctacaggtctatcatatcggaaatttattaaaaggggataaagtgaatggacacctaattcataaaattgagccacacttcaacacttcctggatgtcctgggatggctgtgacttagactactactgcaacatgggagactggccttcttgtacatataccggagttacccaacacaatcatgcttcatttgtaaacctactcaacattgaaactgactatacaaaaaacttccactttcactctaaaagggttactgcgcatggagacacaccacaattagatctgaaagcaagaccaacttacggcgcaggagaaatcactgtactggtagaagttgctgacatggagttacacacgaagaaaattgaaatatcaggcctaaaatttgcaagcctgacttgcacaggctgttatgcttgtagttctggcatttcctgcaaagttaggattcatgtggatgaaccagatgaacttacagtacacgttaagagtgatgatccagatgtagtggcagctagctcaagtctcatggcaaggaagcttgagtttggaacagacagtacgtttaaagctttctcagccatgcccaaaacctccttatgtttctacattgtagaaagggagtactgtaagagctgcagtaaagaagacacacaaaaatgtgttaacacaaaacttgagcaaccacagagcatcttgatcgaacataggggaactataatcggaaagcagaacaatacctgcatagccaaagcaagttgctggttagagtcagttaaaagtttcttttatggtctaaagaacatgcttagtggcatttttggcaatctctttctgggcatcttcttatttcttgccccctttatcttgttaatactttttttcatgtttggatggaggatcctgttttgctttaagtgttgcagaagaaccaggggcctgttcaagtatagacatctcaaagacgatgaagaaactggttacagaaggatcattgaaagactgaacaacaagaaagggaagaacaagctgcttgatggtgaaagacttgccgatagaagaattgccgaactattctccacaaagacacacattggc

SEQ ID NO: 3905 - RNA, 2916 nt, synthetic construct
  misc_feature 1..2916: note = derived and/or modified CDS sequence (wt) from CCHFV(YL16070, Artificial)__KY354081.1__Gn-4aa-Gc
  source 1..2916: mol_type = other RNA
gcagaaggaggaagcagtgactgcatttcaagaactcagctagttaaaacagaggttgcagaaattcatgaggacagttacggtgggcctggtgagaaaataacaatctgcaatggttccacaattgtagatcaaaggcttggtagtgaattgggctgctatacaatcaacagagtaaaatcctacaagctatgcgagaacagtgcctcagggaaaagctgtgaaatagatagcatcccagtcaaatgcaaacaagggttttgcctcaaaataacccaagaaggaagaggtcatgtaaaactgtccagagggacagaaattgttctagatgtctgtgattccagctgtgagctgatgatacctaagggcactggagacattttagtggattgctcaggagggcaacagcattttttacaaaacaatctgattgacttgggatgccccaatgtcccattactgggtaaaatggccatatatgtctgcaggatgtcaaaccacccaaaaactaccatggcatttctgttctggttcagctttggctatgtcattacatgtatagtatgcagggtactcttctacttgctgattgccatcggaacagtagggaaaaagctaaaacagtatagagagctgaaaccacaaacatgcattgtttgtgaatctgtccctgttaatgcaatagatgctgaaatgcatgagcttaattgcagttacaacatatgcccatactgtgcttctagactgtctacagacgggctcatcaggcacgtaactcagtgtcccaaacggagggagaaggtggaagagactgagctattcttgaacttggaaagaataccttggctggtgagaaagctccttcaagtatcagagtcaacaggaatggctctaaagagaagctgttggatgatcacactcctcattctactattggtttcgatgtcaccagtccaatctgcaccggtaggcaggaagccactcttcctggatagcatagccaagggaatgaaaagcctgttgaactccacgagcttagaaactagtctgtcaattgaagctccgtggggagcaatcaatgttcagtcaactttcaaaccaacagtttcagctgctaacatagcacttagctggagttcagttgaacacaggggcaacaaaattttggtttcaggtagatcagagtcaatcatgaaattagaagaaagaacaggagtcagctggaacctgggtgtagaagatgcttctgagtcaaagacgcttactgtttccgtcatggacctgtcacaaatgtactctcctgtttttgagtacttgtcaggtgacagacaagtggaggaatggccaaaggcaacttgcacaggtgactgtccagagagatgcggctgcacttcatcaacctgcttacataaagagtggccacattcaagaaactggagatgtaatcctacttggtgttggggggtggggactggctgcacttgctgtgggctggatgtgaaggatttttttactgactacatgttggtaaaatggaaagtggaatatataaagacagaagctatagtgtgtgtcgagctaactagtcaagagaggcagtgtagtttaattgaagcaggcacaagatttaacctaggccctgtaacaataaccctatcagagccaagaaatgtccagcagaggcttcctcccgaaattgtaacactgcatcctaaaatagaggaaggtttttttgatttgatgcatgtacaaaaaatactgtctgcaagcacagtttgcaagctacagagctgcacacacggtgtgccgggcgattttcaggtctaccatgtcggtaacctgctgaggggagacaaggttaatggacactcaattcacaagatagaaccacattttaatacttcatggatgtcatgggatggttgcgatctggactatttctgcaatatgggggactggccttcatgcacatacactggagtaacacagcataaccgtgctgcatttatcaacatgctcaacattgagactgactatacaaaaactttccactttcattcgaagagggtcacggcacatggagatactccccagctagacctaaaagcgagaccggcatatggtgctggcgaagtcactgttctagtggaggttgcagacttggagttgcacacaaagaaacttgaagtgtcaggtttgaaaattgcaagtttgacctgctctgggtgttatgcatgcagctctggcatctcctgcaaagttagaatccatgtaaatgaaccagacgaattcacagtgcatgtaagaagtagcgacccagatgttgtagcagcaggatcaagtcttatggcaaggaaaatagagtttggggctgacagtacattcaaggccttttcatcaatgcccaaggactccttatgcttttacatagtagaaaaggattactgcagcagctgcaccgacgatgacacacaaaagtgtgtcaacacgaagcttgaccatccacagagcatactcattgagcacaaaggaacaataattggcaagcaaaatgacacttgttcgaccaaaacaagctgctggctaaaatcatttaagggtttcttctatgggctcaaaaacatgctgagtggcatctttggaaatgtttttttaggcatcctcttattccttgctccttttgtactactgatattttttttcttttttgggtggaggcttctgttttgtctcaaatgttgcaaaaaaactaaaggactgttgaaatataagcaccttaaggacaaggaggaggctggatacaaaaaaatcattgaaaggctaaatggcaaaaaaggtaaaagtcaattgtttgatggtgaaaggcttgcaaacaggaaaattgctgagcttttttctactaaaattcacataggt

SEQ ID NO: 3906 - RNA, 2916 nt, synthetic construct
  misc_feature 1..2916: note = derived and/or modified CDS sequence (wt) from CCHFV(Oman_812956, Artificial)__KY362518.1__Gn-4aa-Gc
  source 1..2916: mol_type = other RNA
tccgaagagtctggtgaagactgtatatcaaggactcagctgttgaggacagaaactgcagaaatccatggtgataactatggtggtccaggtgacaaaataaccatctgcaatggttcaaccattgtagatcaaaggctgggtagtgaactggggtgttacactatcaatagggtgaagtcatttaagctatgcgaaaacagtgccacaggtaagtcctgtgaaatagataacactccagtaaaatgcaagcaaggtttttgcttgaaaataacccaagaaggaaggggccacgtgaagctttcaagagactcagaagttgtcctggacgcctgcgattcaagctgtgaaataatgataccaaagggcactggagacatcctggttgactgctcaggtgggcagcagcacttcttaaaagacaacctgattgatctgggatgccccaacatcccattattaggcaaaatggcaatctacatttgtagaatgtcaaatcatcctaaaacaactatggcttttcttttttggtttagctttggttatgtgataacctgcatactttgtaaagtcattttttatctattgatagttgttggaactttagggaaaaagtttaaacagtatagagagttaaaacctcagacctgcacaatatgtgaaacaactcctgtcaatgcaatagatgctgagatgcacgatctcaattgtagttacaatatatgtccttattgtgcatctaggttaacttcagatggtcttgccagacatgtaatgcagtgtcctaagcggaaggaaaaaatagaagaaaccgaattatacctgaacttagaaagaatcccttgggttgtcagaaaactactgcaggtatcagaatccactggtgtagcactaaagaggagcagttggctgattgtgctacttgtgcttctcacagtttcattgtcaccagtacaatcagcacctatcggtagaaagcccttattttttgacagtattgctaagggtatgaagaacctgctgaattcaacaagcttagaaacaagcttatcaattgaggcaccatggggagcaataaacgtccaatctactttcaaacctactgtgtcaactgcaaacatagcacttagttggagctcagtggaacacagaggtaataagatcttggtttcaggcagatcagagtcaatcatgaagctagaagaaagaacaggaatcagctgggatttgggagtagaagatgcctctgagtccaaattacttactgtttccgtcatggacttatcacagatgtactctcctgtctttgagtacctatcaggtgacagacaagtagaggaatggccaaaggcaacctgtacaggcgattgcccggaaagatgtggctgcacatcatcaacctgcctacacaaggaatggcctcactcaagaaactggagatgcaaccccacttggtgttggggagtcggcaccggatgcacctgttgtggactagatgtaaaggacctttttacagattacatgtttgttaaatggaaggtcgaatatataaaaacagaggctatagtgtgtgttgagcttactagccaagaaagacaatgtagcttgattgaggcaggcacaagattcaacttaggtcctgtgactatcacattatcagagccaagaaacattcagcaaaagctccctccagaaattgtcacattacatcctagaattgaagaaggtttttttgacttaatgcatgtacagaaggtactatcagcaagcacagtgtgcaagctacagagttgcacacatggcgtaccaggagacttacaggtctaccacatcggaaacttactaaaaggagacaaagtgaatgggcatctgatacataaagttgaaccacatttcaacacctcctggatgtcttgggacggctgtgacctagattactactgcaatatgggggattggccctcttgcacgtatactggagttacccaacataatcatgctgcatttgtaaacctacttaacattgaaactgattacacaaagaacttccactttcactctaagagagtcactgcacatggggacactccacaattagatttaaaagccagaccaaattatggtgcaggtgaaatcactgtgctggtggaagttgctgacatggagttacacacaaagaaaattgagatatcaggtttgaagtttgcaagcctaacctgcacaggttgttatgcttgtagctctggcatctcatgtaaggttaggatccatgtagatgaaccagatgagcttacagtacatgtgaagagtgaagacccagacatagttgctgctagctcaagtctcatggcaagaaagcttgaattcgggacggatagtacattcaaagccttctcagccatgcctaaaacctccttgtgcttttacattgttgagagagaatactgtaaaagctgcagtaaagaagacacacaaaagtgtgttaacgcaaagcttgagcgaccacagagcattttaattgagcacaaaggaacgataattggaaagcagaacgacacttgcacagctaaagcaagctgctggctagagtcagtcaagagtttcttttatggactaaagaacatgcttagtggcatttttggcaatgttttcatagggattttcttattccttgctccttttatcctgttaatacttttctttatgtttgggtggagaatcctattctgctttaagtgctgcaggagaactagaggcctatttaagtacagacacctcaaagatgatgaagaaaccggttataggaaaatcattgagagactaaacaacaaaaaaggtaaaaacaagctgcttgacggtgaaagattagctgatagaaagatcgctgagctgttctctacaaaaacacacattggc

SEQ ID NO: 3907 - RNA, 2916 nt, synthetic construct
  misc_feature 1..2916: note = derived and/or modified CDS sequence (wt) from CCHFV(UCCR4405, Artificial)__KY484029.1__Gn-4aa-Gc
  source 1..2916: mol_type = other RNA
tctgaagagccaggtgacgactgcatatcaagaactcagctattgaagacagaaacagcagagatccatgacgacaactatggtggtccaggtgacaaaataactatctgcaatggttcaaccattgtggatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaagtaatgatacctaaaggcactggagatatcctagtagactgttcaggtggacagcagcatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttactcattgataattattgggacactagggaaaaaaatcaagcaatatagggagctgaaacctcaaacttgcaccatatgtgagacagctcctgtcaatgcaatagatgctgaaatgcatgacctcaaatgtagttacaatatatgcccttattgtgcatcaagattgacctctgatgggctagctaggcatgtgacacaatgccctaagcgaaaggagaaagttgaggagactgaactgtacttgaacctggaaagaattccttggatagtcagaaagctattgcaagtgtcagagtccactggtgtagcattgaaacgaagcagttggctgattgtgctgcttgtgttactcacagtctcattgtcaccggttcaatcagcacctgttggtaggaaacctcttttcttagacagtacagttaaaggtatgaaaaatttgctaaactcaacaagcttggaaacaagcttatcaattgaggcaccatggggagcaataaatgtccagtcaacctttaaaccaacagtatcgactgcaaacatagcactcagttggagctcagtggagcacagaggcaacaagatcttggtcacaggcaggtctgaatcaattatgaaactagaggaaaggacaggagtcagctgggatctaggcgtagaagatgcctctgaatccaaattacttaccgtctccatcatggatttgtcacaaatgtattcccctgtttttgagtacttatcaggagatagacaggttgaagaatggcccaaggcaacctgtacaggtgattgcccagaaaggtgtggctgcacatcatcaacctgcttgcataaagaatggcctcactcaagaaactggagatgtaaccccacttggtgctggggagtaggaaccggctgcacatgctgcggagtggatgtaaaagacctttttacagatcacatgtttgtcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtacaaaaagtgttatctgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactattgcaacatggggaattggccttcttgcacatacacaggagtgacccaacataatcatgctgcatttgtaaatttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctggtttgcacgggttgctatgcttgtagctctggcatttcctgtaaagtcagaattcatgtagatgaaccagatgagctcacagtgcatgtaaagagcagtgatccagatgtggttgcagctagcacaagccttatggcaaggaagcttgaatttgggacagatagcatattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggtgcttttctttatgtttggatggaaaatcttgttttgctttaagtgttgcaggaggaccagaggcttgtttaagtatagacacctcaaagacgatgaggaaacaggctacagaaggattattgaaagactgaatagtaaaaaaggaaaaaacagactgcttgatggtgagaggttggctgataggaaaattgctgagctgttctccacaaaaacacacattggc

SEQ ID NO: 3908 - RNA, 2916 nt, synthetic construct
  misc_feature 1..2916: note = derived and/or modified CDS sequence (wt) from CCHFV(UCCR4401, Artificial)__KY484035.1__Gn-4aa-Gc
  source 1..2916: mol_type = other RNA
tcagaagaacccagtgatgactgtatatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggccattttttacttgttaataattgttggaacactagggaaaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctggcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatagaagaattgccgaactgttctctacaaaaacacacattggc

SEQ ID NO: 3909 - RNA, 2916 nt, synthetic construct
  misc_feature 1..2916: note = derived and/or modified CDS sequence (wt) from CCHFV(UCCR4448, Artificial)__KY484042.1__Gn-4aa-Gc
  source 1..2916: mol_type = other RNA
tccgaagaaaccagtgatgactgcatatcaagaactcaactattgaggacagagactgcagagatccacggcgacaactatggtggcccgggtgacaaaataaccatctgcaacggctcaactattgtagaccaaagactaggcagtgagctagggtgttacactatcaacagagtgaagtcattcaagctatgcgaaaatagtgccacagggaagagctgtgaaatagacagtgtcccagttaaatgcaggcagggttattgcctaagaatcactcaggaagggaggggccatgtaaaattatctaggggctcagaggttgtcttagatgcatgtgatacaagctgtgaaataatgatacctaagggcactggtgacatcttggttgactgttcaggtgggcagcaacattttctaaaggacaatttgatagatctaggatgccccaaaattccattattgggcaaaatggctatttacatttgcagaatgtcgaatcaccccaaaacaaccatggctttcctcttctggttcagctttggctacgtgataacttgtatactttgcaaggccatcttctacttgttaataattattggaacactagggaaaaggttcaagcagtatagagagttaaaaccccagacctgcaccatatgtgagacaactcctgtaaatgcaatagatgctgagatgcacgacctcaattgcagttacaacatttgtccctactgtgcatctagactaacctcagatgggcttgctaggcatgtaacacaatgccctaagcggaaggagaaagtggaagaaactgaactgtacttgaacttagaaagaattccttgggttgtaagaaagctgttgcaggtatcagagtccactggtgtggcattgaaaagaagcagctggctgattgtgctgcttgtgctgttcacgatttcattgtcaccagttcaatcagcacccattagtagaaagcctctattcctagatagtatagttaaaggcatgaaaaatctgctaaactcaacaagtttagaaacaagtttatcaattgaggcaccatggggggcaataaatgttcagtcaacctacaaaccaactgtgtcaactgcaaacatagcactcagttggagctctgtggaacacagaggtaataagatcttggtttcaggcagatcagaatcaattatgaagctggaagaaaagacaggaatcagctgggatctcggcgtagaagacgcctctgagtctaaactgcttacagtctctgtcatggacttgtctcagatgtactctcctgtcttcgagtacttatcaggagacagacaggtggaagagtggcccaaagcaacttgtacaggtgactgcccagaaagatgcggctgcacatcatcaacgtgtttgcacaaagaatggccccactcaagaaattggagatgcaatcccacttggtgctggggtgtagggactggctgcacctgttgtggattagatgtgaaagacctttttacagattatatgtttgtcaagtggaaagttgaatatattaagacagaggccatagtgtgtgtagaacttaccagtcaggaaaggcagtgtagcttgattgaagcgggcacaaggttcaatttaggtcctgtgaccatcacactgtcagaaccaagaaacatccaacagaagctccctcctgaaataatcacactgcatcccaggatcgaagaaggtttttttgacctgatgcatgtacaaaaagtgttatcggcaagcacagtatgtaagttgcagagttgcacacatggtgtaccaggagacctacaggtctaccacatcggaaatttattgaaaggggataaggtaaatggacatctaattcataaaattgagccacacttcaacacttcctggatgtcctgggatggttgtgacctggactactactgcaacatgggagattggccttcttgcacatatacaggagtcacccaacacaatcatgcttcatttgtaaacctgctcaacattgaaactgattacacaaaaaacttccactttcactctaaaagggtcactgcacatggagacacaccacaactagatcttaaggcaagaccaacctatggtgcaggtgagatcactgtactggtagaagttgctgacatggaattacacacaaagaagattgaaatatcaggcttaaaatttgcaagcttgacttgcacaggttgttatgcttgtagctctggcatctcatgcaaagttagaattcatgtggatgaaccagatgaacttacagtacatgttaaaagtgatgatccagatgtagttgcagctagctcaagtctcatggcaagaaagcttgaatttggaacagacagtacatttaaagctttctcagccatgcctaaaacttctctatgtttctacattgttgaaagagaacactgtaagagctgcagcgaagaagacacaaaaaaatgtgttaacacaaaacttgagcaaccacaaagcattttgatcgaacacaagggaactataatcggaaagcaaaacagcacttgcacagccaaggcgagttgctggttagagtcagtcaaaagtttcttttatggtctaaagaacatgcttagtggtatttttggcaatgtttttataggtattttcttgttccttgcccccttcatcctattaatactattctttatgtttgggtggaagatcctattttgctttaaatgttgtagaagaactagaggcctattcaagtatagacacctcaaggacgatgaagaaactggttatagaaggattattgaaagactaaacaataaaaaaggaaaaaacaaactgcttgatggtgaaatacttgctgatagaagaattgccgaactgttctctacaaaaacacacattggc

SEQ ID NO: 3910 - RNA, 2916 nt, synthetic construct
  misc_feature 1..2916: note = derived and/or modified CDS sequence (wt) from CCHFV(SPU 45/88, Artificial)__KJ682809.1__Gn-4aa-Gc
  source 1..2916: mol_type = other RNA
tctgaagagtctagtgatgactgtttatcaaggactcagctattgaggacagagaatacggaaattcacagtgacaactatggtggtccaggtgacaagataactatctgcaacggttcaactattgtagatcagagactgggcagtgaactagggtgttacactatcaatagagtgaaatcatttaagctttgcgagaacagtgctacaggtaaatcttgtgaaatagatagcaccccagttagatgtaggcagggtttttgcttgaaaatcactcaggagggaaggggccacgtgaagctatcaagaggctcagaagttgtcttggacgcctgtgattcaagctgtgaaataatgataccaaagggcactggggacatcctagttgactgttcaggtgggcagcaacatttcttaaaagataacttggttgatctaggatgccccaacattccactattaggcaaaatggccatctacatttgtagaatgtcaaatcatcccaagacaactatgggttttcttttttggtttagctttggttatgtgataacctgtatactttgtaaggtaatcttctatctattaatagttgtagggacattagggaaaaagtttaaacagtacagagagttgaaacctcagacctgtaccatatgtgaaacgactcctgttaatgcaatagatgctgagatgcacgacctcaactgcagttacaatatatgtccttattgtgcatctaggttaacctcagatggtcttgccagacatgtaatgcaatgccccaaacggaaggaaaaaatagaagaaaccgaattatatttaaacttagaaagaatcccctggattgttaggaaattactgcaggtgtcagaatccaccggtgtagcactaaagaggagtagttggttggttgtactacttgtgctactcacagtttcattgtcaccagtacaatcagcacctatcggcaggaaacccttatttttggacagtattgttaaaggcaagaagaacttgctaaattcaacaagcctagaaacaagcttatcaattgaggcaccatggggggcaataaatgtccagtcaactttcaaaccaactgtgtcagctgcaaacatagcacttagttggagctcagtagaacatagaggtaacaagattttggtttcaggcaggtcagagtcaatcatgaaattagaggaaaggacaggaattagctgggatctgggtgtggaagacgcctctgaatccaaattgctcactgtctctgttatggacttgtcacagatgtattctcctgtctttgaatacctatcaggtgatagacaagtggaggaatggcccaaggcaacctgcacaggagattgcccagaaagatgtggctgtacgtcgtcaacctgcctacacaaggaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtatgtgttgagcttactagccaggaaagacaatgtagcttgattgaggcaggcacaagattcaacttgggtcctgtgactatcacattgtcagagccaagaaacattcagcaaaagctccctccagaaatagtcacattgcatcctaggattgaagaaggcttctttgacttaatgcatgtacaaaatgtgctatcagcaagtacagtgtgcaagctacaaagttgtacacatggtgtgccaggagacctacagatttaccacattggaaacttgttaaaaggagacaaggtgaatgggcacctgattcacaagattgaaccacacttcaacacttcctggatgtcttgggacggctgtgacctagactactactgtaatatgggggattggccatcttgctcatacactggcgtaacccaacacaatcatgctgcatttgtaaacatgctcaacatcgaaactgattatacaaaaaacttccactttcactctaagagagttacagcacatggagacacaccacaattagatttaaaagccagaccaacttatggtgcaggtgaaatcactgtgctggtggaggttgctgacatggagttgcatacaaagaaaattgagatatcaggtttgaagtttgcaagcttaacttgcacaggctgttatgcttgtagttctggtatctcctgtaaggttagaatccatgtggatgaaccagatgagctcacagtacatgtgaagagtgaggatccagacatagttgctgctagctcaagtctcatggctaggaagcttgaatttgggacagatagcacatttaaagccttttcagccatgcccaaaacctccttatgcttttacattgtggagagggaatactgcaaaagctgcagtaaagaagacacacaaaaatgtgtcaacacaaagcttgagcaaccacaaagcattttaatcgagcacaaagggacgataattgggaagcagaacgacacttgtacagccaaagcaagttgctggctagagtcagtcaagagttttttttatggactaaagaatatgcttagtggcatttttggcaatgttttcatagggattctcttattcctcgctccttttatcatgctaatacttttcttcatgtttggatggaggatcctgttctgctttaagtgttgcagaagaactagaggcctatttaagtatagacacctcaaagacgatgaagaaatcggttacaggaaaatcattgagaggctaaacaacaaaaaagggaaaaacaaactgcttgacggtgaaaggctagctgataggaaaatcgctgagctgttctccacaaaaacacacattggc

SEQ ID NO: 3911 - RNA, 2916 nt, synthetic construct
  misc_feature 1..2916: note = derived and/or modified CDS sequence (wt) from CCHFV(3010, Artificial)__DQ019222.1__Gn-4aa-Gc
  source 1..2916: mol_type = other RNA
gcagaaggagtgagcaatgactgtgtttcaaggacccagctaatcaaaacagaagttgcagagattcatgaagatagttatggtgggcctggagaaaaaataacaatctgcaacggctccacaatcgtggaccaaagactcggtagcgaactaggctgctacacaatcaaccgtgtgaagacttataagctttgtgagaatagtgctacagagaagggttgtgagatcgatagtgtcccagtcaaatgcaaacaagggttctgcctcaaagtaacccaagagggcaggggccatgtaaaactgtccagaggaacggaaattgtcctagatgtatgtgacaccagttgtgagttgatgatacccaaaggcactggggacatattggtggactgctcaggaggacagcagcactttttgcaggataacttgattgacttaggttgtccaaatgtaccattattaggcaagatggcaatatatatctgcaggatgtcaaatcatcctaaaactaccatggcttttttgttctggtttagctttggctatgtcatcacatgcatagtatgtaaagtgcttttctatctgctaattgtcatcgggacactaagtaagaaacttaaacagtatagggaattaaaacctcaaacatgcattgtctgtgaatcaacccctgttaatgcaatagatgctgaaatgcacgagctcaattgtaattacaacatatgcccatactgcgcgtccagactaacttcagatggactagtcagacatgtgaatcaatgtcccaaaaggaaagaaaaggtcgaggagactgaactatacttgaacctggagaggataccttggctagtaaggaggctactacaagtgtcagagtcaacggggatggctctaaagagaagttgctggatgaccacactcctcattctgctagtagtttcattatcgccagttcaatctgctccagttggtagaaggcccctatttctagatagtatagtcaaaggtatgaaaaatctgctaaactcaacaagtctagaaacaagcttatcaattgaggcaccatggggagcaattaatgttcagtcaacctacaaaccaactgtatcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagtcatggacttgtctcagatgtactctcctgtcttcgagtacttatcaggtgacagacaagtggaagagtggcctaaagcaacctgcacaggtgactgcccagaaagatgtggctgcacatcatcaacctgcttacacaaagagtggccccactcaaggaattggagatgtaatcctacttggtgttggggtgtagggactggctgcacctgttgtggtttagatgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagaaccaaggaacattcaacaaaagctccctcctgaaataatcacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacctgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacagctagatctgaaggcaaggccaacctatggtgcaggtgaggtcaccgtgctggtggaagttgctgacatggagttacacacaaagaagattgaaatatcaggcttaaaatttgcaggcctaacttgcacaggttgttatgcttgtagttctggcatctcttgtaaagttagaattcatgtagatgaaccagatgaacttacagtacatgttaaaagtgatgacccagatgtagttgcagctagctcaagtctcatggcgaggaagcttgagtttggaacagacagtacatttaaagctttctcagccatgcctaaaacctccctatgtttctacattgtggaaagagaatactgtaagagctgcagtaaagaagatacacaaaaatgtgttaacacgaaactcgaacaaccacagagcattttgatcgaacataagggaactataattggaaagcaaaacaatacttgcacggctaaagcgagttgctggttagagtcagttaagagttttttttatggtctgaagaatatgctcggtggcatatttggcaatgtttttataggcattttcacatttcttaccccctttatcttgttaatactcttctttatgtttgggtggaggatcctgttttgcttcaagtgttgcagaagaaccagaggcctattcaagtacagacacctcaaagacgatgaagaaactggttacagaaagatcattgaaagactgaacaacaaaaagggaaaaaacaggctgcttgatggtgaaagacttgctgacagaaagattgctgaactgttctccacaaaaacacacattggc

SEQ ID NO: 3912 - RNA, 972 nt, synthetic construct
  misc_feature 1..972: note = derived and/or modified CDS sequence (wt) from CCHFV(10200)__U39455.2__Gn
  source 1..972: mol_type = other RNA
tcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggt

SEQ ID NO: 3913 - RNA, 972 nt, synthetic construct
  misc_feature 1..972: note = derived and/or modified CDS sequence (wt) from CCHFV(IbAr10200)__AF467768.2__Gn
  source 1..972: mol_type = other RNA
tcagaagaacccagtgatgactgtatatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggccattttttacttgttaataattgttggaacactagggaaaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggt

SEQ ID NO: 3914 - RNA, 972 nt, synthetic construct
  misc_feature 1..972: note = derived and/or modified CDS sequence (wt) from CCHFV(Turkey-Kelkit06)__GQ337054.1__Gn
  source 1..972: mol_type = other RNA
tccgaagagccaggtgatgactgcatatcaagaactcagctattgaggacagaaacagcagagatccatgatgacaactatggtggtccaggtgataaaataactatctgcaacggttcaaccattgtagatcagagactgggcagtgaactagggtgttataccatcaacagggtgaagtcattcaagctatgcaaaaacagcgccacagggaaaacctgtgaggtagacagcactccggttaagtgcaggcaaggtttttgtttaaaaatcacccaagagggaaggggccacgtaaaattatctagaggctcagaggttgtcctggatgcttgcgactcaagctgtgaagtaatgatacctaaaggcactggggatatcctagtggactgttcaggtgggcagcaacatttcttaaaagacaacttaattgacctagggtgcccccatatcccgctattgggtaggatggctatttacatttgcagaatgtcaaatcatcctagaacaaccatggcttttctcttctggttcagctttggctatgttatcacttgtatattttgcaaggctcttttttattcattgataattattggaacactaggaaaaaagatcaagcaatatagggaactgaaacctcaaacctgcaccatatgtgagacagctcctgtcaatgcaatagatgctgaaatgcatgacctcaactgtagttacaatatatgcccttattgtgcatcaagattgacctccgatgggctagccaggcatgtaacgcaatgccccaagcggaaagagaaagttgaggagactgaactgtacctgaacctggaaagaattccttggattgtcagaaagctattgcaggtgtcagagtccactggtgtggcattgaaacgaagcagctggctgattgtactgcttgtgttactgacagtttcgttgtcgccggttcagtcagcacctgttggt

SEQ ID NO: 3915 - RNA, 972 nt, synthetic construct
  misc_feature 1..972: note = derived and/or modified CDS sequence (wt) from CCHFV(SR3)__AJ538199.1__Gn
  source 1..972: mol_type = other RNA
tccgaagaatctggtgatgactgcatatcaagaactcagctattgaggacagagactgcagaggtccatggcgacaactacggtggtccaggtgataagataaccatctgtaatggttcaactgttgtagatcaaagactgggtagtgaactagggtgttacactatcaatagagtgaggtcattcaagctatgcgaaaacagtgccacagggaagagctgtgaaatagacagtatcccagtcaagtgtaagcagggttattgccttaaaatcactcaggaaggaaggggccatgtgaagttatctagaggctcagaagttgtcttggatgtatgtgattcaagctgtgaagtgatgatacctaagggcactggtgacattctagtagattgttcaggtgggcagcaacattttttaaaagacaacctggttgacctagggtgtcccaaaattccgttactgggcaaaatggctatttatatctgcaggatgtcgaatcaccccaagacaaccatggccttcctcttttggttcagctttggctatgtgataacttgtatactttgcaaggccatttttttcttattaataatttttggaacactagggaaaaggttcaagcagtacagagagttgaaaccccagacctgcaccatatgtgagacaacacctgtaaatgcaatagatgctgaaatgcatgatctcaactgcagttacaatatatgtccctattgtgcgtctagactgacttcagatgggcttgctaggcatgtaacacaatgtcctagacggaaggagaaagtggaggaaaccgaattatacctgaatttagagagaattccctgggttgtaagaaagctattgcaggtgtcagagtccactggtacagtattaaaaaggagcagctggctaattgtattacttgtgctgttcacagtttcattgtcaccagttcaatcagcacccattggt

SEQ ID NO: 3916 - RNA, 972 nt, synthetic construct
  misc_feature 1..972: note = derived and/or modified CDS sequence (wt) from CCHFV(UCCR4413)__KY484038.1__Gn
  source 1..972: mol_type = other RNA
tcagaaagcagcgctagtggttgcatttcaaggacccagatgatcaagtcagaaacagcagagatccacgacgacatctacggaggacctggtgagaagcttaccatctgtaatggtaccactgttgtagatcaaagactgggcagtgaactaggttgctacacaatcaacagaattaagacctataaattgtgtgaaaacagtgtcaaagaaaaaacttgtgagattgacagtgtaccagtcaagtgtagacaggggctttgtttgaagataactcaagaaggaagaggccatgttaagctttccagaggctcagagattgtcctggacatttgtgactctagttgtgaattgatgatacctaaaggcactggggacatattggtagattgttctggaggacagcaacattttttacaggataacctggttgacttaggttgccctaacatccccctacttgggaaagtggctatctacatatgcagaatgtcaaatcaccccaagactaccatggcatttctcttctggttcagttttggttatgtgatcacatgcatattgtgcaaaatactcttttacctactcataatcactggcacactagggaaaaaactaaagcagtatagagagctcaagccacaaacatgtaccatatgtgaatcaacacctgtgaatgcaatagatgctgagatgcatgacctcaactgtagttacaacatatgcccttattgtgcatctagactgacttcagatgggctcataaggcatgtgaatctgtgccccaagaggaaggagaaagttgaagagacagaactgtatttgaacttagaaagaataccttggtttgtgagaaagcttttacaggtgtctgaatctacaggagtagctctcaaaagaagcagttggctattgatacttgttatattgctcacagtttctatgtcaccagttcagtcggcaccaattaat

SEQ ID NO: 3917 - RNA, 972 nt, synthetic construct
  misc_feature 1..972: note = derived and/or modified CDS sequence (wt) from CCHFV(66019)__AB069669.1__Gn
  source 1..972: mol_type = other RNA
tccgaagagtctggtgacgactgcatatctagaactcagctattgaggacagagactgcagaggtccatggtgacaactatggtggtccaggtgacaaaataactatctgtaatggttcaaccattgtggatcaaagacttggcagtgaactggggtgttatactatcaatagagtgaagtcattcaagctatgcgaaaatagtggcacgggaaaatcctgtaagatagataacaccccagttaagtgcaggcagggtttttgcttaaaaattactcaggaaggaaggggccatgtgaagctatcgagaggctcagaagttgtcttagatgcctgcgactcaagctgtgaaataatgataccgaagggcacaggagacatcctagtagactgttcaggtgggcaacaacatttcttaaaagataacttggttgatctaggatgccctaacattccactattaggtaaaatggctatctacatttgcaggatgtcaaatcaccctaaaacaactatggcttttctcttttggtttagtttcggctatgtaataacatgtatattttgtaaaatcattttttacttgttgatagtcgtggggacattggggaaaaagttcaaacagtaccgggagctgaaacctcagacttgtactatatgtgaaacaactcctaccaatgcaatagatgctgaaatgcacgatcttaaatgcagttacaatatatgcccttattgtgcatctagattaacctcggacgggcttgccaggcatgtgacacaatgccctaagcgaaaagagaaagtagaagagactgaactgtacttgaacttggaaagaattccttggattgtcagaaaactactgcaagtgtcagagtctaccggtgtggcactgaaaaggagcagttggctaattgtgttacttgtgctacttacagtttcattgtcaccggttcaatcagcacccattgga

SEQ ID NO: 3918 - RNA, 972 nt, synthetic construct
  misc_feature 1..972: note = derived and/or modified CDS sequence (wt) from CCHFV(7001)__AB069670.1__Gn
  source 1..972: mol_type = other RNA
gcagaaggaggaagcagtgactgcatttcaagaactcagctagttaaaacggaggttgcagaaattcatgaggacagttacggtgggcctggtgagaaaataacaatctgcaatggttccacaattgtagatcaaaggcttggtagtgaattgggctgttatacaatcaacagagtaagatcctacaagctatgcgagaacagtgcctcagggaaaagctgtgaaatagatagcatcccagtcaaatgcaaacaagggttttgcctcaaaataacccaagaaggaagaggtcatgtaaaactgtccagagggacagaaattgttctagatgtctgtgattccagctgtgagctgatgatacccaagggcactggagacattttagtggattgctcaggagggcaacagcattttttacaaaacaatctgattgacttgggatgccccaatgtcccattactgggtaaaatggccatatatgtctgcagaatgtcaaaccacccaaaaactaccatggcatttctgttctggttcagctttggctatgtcattacatgtatagcatgcagggtactcttctacttgctgattgccatcggaacagtagggaaaaagctaaaacagtatagagagctgaaaccacaaacatgcattgtctgtgaatctgtccctgttaatgcaatagatgctgaaatgcatgagcttaattgcagttacaatatatgcccatactgtgcatctagactgtctacagacgggctcatcaggcacgtaactcagtgtcccaaacggagggagaaggtggaagagactgagctattcttgaacttggaaagaataccttggctggtgagaaagctccttcaagtatcagagtcaacaggaatggctctaaagagaagctgttggatgatcacactcctcattctactattggtttcgatatcaccagtccaatctgcaccggtaggc

SEQ ID NO: 3919 - RNA, 972 nt, synthetic construct
  misc_feature 1..972: note = derived and/or modified CDS sequence (wt) from CCHFV(75024)__AB069671.1__Gn
  source 1..972: mol_type = other RNA
tctgaagaatctggtgatgactgcatatcaagaactcagctattgaggacagagactgcagagatccatggtgataactatggcggtccgggtgacaagattactatttgcaatggttcgacaattgtagatcaaagactgggtagtgagatggggtgttacactatcaatagggtgaagtcattcaagctgtgcgaaaacagtgcaacagggaagagctgtgaaatagacagtatcccagttaagtgcaggcagggttattgcctaaaaatcactcaggaaggaaggggccatgtgaaattatccaggggctcagaggttgtcttggatgcatgcgactcaagctgtgaagtaatgatacctaagggcacaggtgacatcctggtagactgttcaggtgggcagcaacattttttgaaggacaacttaattgatctaggatgtcccagtattccattactgggtaaaatggctatttatatttgcagaatgtcgaatcaccctaagacaaccatggctttcctcttttggttcagttttggctatgtgataacttgtatactctgcaaggctattttctacttattaataattgttggaacgctagggaagaggtttaagcagtacagagagttaaaaccccagacctgtaccatatgtgagacaactcctgcaaatgcaatagatgctgaaatgcatgaccttaactgcagttacaacatatgtccctattgtgcatctagactaacctcagacgggcttgctaggcatgtgacacaatgccctaagcggaaggagaaagtagaagaaactgaattgtacttgaacttagagagaattccctgggttgtaagaaagctgttgcaggtatcggagtccaccggtgttgcattaaaaagaagcagctggctgattgtgctgcttgtgctgttcgcaatttcattatcaccagttcaatcagcacccatcggt

SEQ ID NO: 3920 - RNA, 972 nt, synthetic construct
  misc_feature 1..972: note = derived and/or modified CDS sequence (wt) from CCHFV(7803)__AB069672.1__Gn
  source 1..972: mol_type = other RNA
tctgaagaatctggtgatgactgcatatcaagaactcagctattgaggacagagactgcagagatccatggtgataactatggtggtccgggtgacaagattactatttgcaatggttcgacaattgtagatcaaagactgggtagtgagatggggtgttacactatcaatagggtgaagtcattcaagctgtgcgaaaacagtgcaacagggaagagctgtgaaatagacagtatcccagttaagtgcaggcagggttattgcctaaaaatcactcaggaaggaaggggccatgtgaaattatccaggggctcagaggttatcttggatgcatgcgactcaagctgtgaagtaatgatacctaagggcacaggtgacatcctggtagactgttcaggtgggcagcaacattttttgaaggacaacttaattgatctaggatgtcccagtattccattattgggtaaaatggctatttatatttgcagaatgtcgaatcaccctaagacaaccatggctttcctcttttggttcagttttggctatgtgataacttgtatactctgcaaggctattttctacttattaataattgttggaacgctagggaagaggtttaagcagtacagagagttaaaaccccagacctgtaccatatgtgagacaactcctgcaaatgcaatagatgctgaaatgcatgaccttaactgcagttacaacatatgtccctattgtgcatctagactaacctcagacgggcttgctaggcatgtgacacaatgccctaagcggaaggagaaagtagaagaaactgaattgtacttgaacttagagagaattccctgggttgtaagaaagctgttgcaggtatcggagtccaccggtgttgcattaaaaagaagcagctggctgattgtgctgcttgtgctgttcgcaatttcattatcaccagttcaatcagcacccatcagt

SEQ ID NO: 3921 - RNA, 972 nt, synthetic construct
  misc_feature 1..972: note = derived and/or modified CDS sequence (wt) from CCHFV(79121)__AB069673.1__Gn
  source 1..972: mol_type = other RNA
gcagaaggaggaagcagtgactgcatttcaagaactcagctagttaaaacggaggttgcagaaattcatgaggacagttacggtgggcctggtgagaaaataacaatctgcaatggttccacaattgtagatcaagggcttggtagtgaattgggctgttatacaatcaacagagtaagatcctacaagctatgcgagaacagtgcctcagggaaaagctgtgaaatagatagcatcccagtcaaatgcaaacaagggttttgcctcaaaataacccaagaaggaagaggtcatgtaaaactgtccagagggacagaaattgttctagatgtctgtgattccagctgtgagctgatgatacccaagggcactggagacattttagtggattgctcaggagggcaacagcattttttacaaaacaatctgattgacttgggatgccccaatgtcccattactgggtaaaatggccatatatgtctgcagaatgtcaaaccacccaaaaactaccatggcatttctgttctggttcagctttggctatgtcattacatgtatagcatgcagggtactcttctacttgctgattgccatcggaacagtagggaaaaagctaaaacagtatagagagctgaaaccacaaacatgcattgtctgtgaatctgtccctgttaatgcaatagatgctgaaatgcatgagcttaattgcagttacaatatatgcccatactgtgcatctagactgtctacagacgggctcatcaggcacgtaactcagtgtcccaaacggagggagaaggtggaagagactgagctattcttgaacttggaaagaataccttggctggtgagaaagctccttcaagtatcagagtcaacaggaatggctctaaagagaagctgttggatgatcacactcctcattctactattggtttcgatatcaccagtccaatctgcaccggtaggc

SEQ ID NO: 3922 - RNA, 972 nt, synthetic construct
  misc_feature 1..972: note = derived and/or modified CDS sequence (wt) from CCHFV(8402)__AB069674.1__Gn
  source 1..972: mol_type = other RNA
tccgaagagtctggtgatgactgcatatcaagaactcagctattgaggacagagactgcggaaattcacaatgataactatggtggtccaggtgacaagataaccatctgcaatggttcaactgttgtggatcagagattgggcagtgaactggggtgttacactatcaatagagtaaagtcatttaagctttgcgagaacagtgccacaggcaaatcctgtgaaatagatagcaccccagtcaaatgcaggcagggtttctgtttgaaaattactcaggagggaaggggccacgtgaagctatcgagaggttcagaagttgtcctggacgcctgcgattcaagctgtgaaataatgataccaaagggcaccggagacatcctagttgactgttcaggtggacagcaacatttcttaaaagataacttgattgatctaggatgcccaaacatcccactattaggcaagatggctatctacatttgtagaatgtcaaatcatcctaaaacgactatggcttttcttttttggtttagctttggttatgtggtgacctgtatactctgtaaggtcatcttctatctattaatagttgtggggacgttggggaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagatggtcttgccagacatgtaatgcagtgccctaagcggaaggaaaaaatagaagaaaccgaattatacttaaacttggaaagaatcccctgggttgttaggaaattactgcaggtgtcagaatccaccggtgtggcactaaagaggagtagttggctggttgtgctacttgtgttacttacagtttcattgtcaccagtacaatcagcacctatcggc

SEQ ID NO: 3923 - RNA, 972 nt, synthetic construct
  misc_feature 1..972: note = derived and/or modified CDS sequence (wt) from CCHFV(88166)__AB069675.1__Gn
  source 1..972: mol_type = other RNA
tccgaagagtctggtgatgactgcatatcaagaactcagctattgaggacagagactgcggaaattcacagtgataactatggtggtccaggtgacaagataaccatctgcaatggttcaactgttgtggatcagagattgggcagtgaactagggtgttacactatcaatagagtaaagtcatttaagctttgcgagaacagtgccacaggcaaatcctgtgaaatagatagcaccccagtcaaatgcaggcagggtttctgtttgaaaattactcaggagggaaggggccacgtgaagctatcgagaggttcagaagttgtcctggacgcctgcgattcaagctgtgaaataatgataccaaagggcactggagacatcctagttgactgttcaggtggacagcaacatttcttaaaagataacttgattgatctaggatgcccaaacatcccactattaggcaagatggctatctacatttgtagaatgtcaaatcatcctaaaacgactatgggttttcttttttggtttagctttggttatgtggtgacctgtatactctgtaaggtcatcttctatctattaatagttgtggggacgttggggaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagatggccttgccagacatgtaatgcagtgccctaagcggaaggaaaaaatagaagaaaccgaattatacttaaacttggaaagaatcccctgggttgttaggaaattactgcaggtgtcagaatccaccggtgtggcactaaagaggagtagttggctggttgtgctacttgtgttacttacagtttcattgtcaccagtacaatcagcacctatcggc

SEQ ID NO: 3924 - RNA, 972 nt, synthetic construct
  misc_feature 1..972: note = derived and/or modified CDS sequence (wt) from CCHFV(BA88166)__AF338470.1__Gn
  source 1..972: mol_type = other RNA
tccgaagagtctggtgatgactgcatatcaagaactcagctattgaggacagagactgcggaaattcacagtgataactatggtggtccaggtgacaagataaccatctgcaatggttcaactgttgtggatcagagattgggcagtgaactagggtgttacactatcaatagagtaaagtcatttaagctttgcgagaacagtgccacaggcaaatcctgtgaaatagatagcaccccagtcaaatgcaggcagggtttctgtttgaaaattactcaggagggaaggggccacgtgaagctatcgagaggttcagaagttgtcctggacgcctgcgattcaagctgtgaaataatgataccaaagggcactggagacatcctagttgactgttcaggtggacagcaacatttcttaaaagataacttgattgatctaggatgcccaaacatcccactattaggcaagatggctatctacatttgtagaatgtcaaatcatcctaaaacgactatgggttttcttttttggtttagctttggttatgtggtgacctgtatactctgtaagggcatcttctatctattaatagttgtggggacgttggggaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagatggccttgccagacatgtaatgcagtgccctaagcggaaggaaaaaatagaagaaaccgaattatacttaaacttggaaagaatcccctgggttgttaggaaattactgcaggtgtcagaatccaccggtgtggcactaaagaggagtagttggctggttgtgctacttgtgttacttacagtttcattgtcaccagtacaatcagcacctatcggc

SEQ ID NO: 3925 - RNA, 972 nt, synthetic construct
  misc_feature 1..972: note = derived and/or modified CDS sequence (wt) from CCHFV(BA66019)__AF350448.1__Gn
  source 1..972: mol_type = other RNA
tccgaagagtctggtgacgactgcatatctagaactcagctattgaggacagagactgcagaggtccatggtgacaactatggtggtccaggtgacaaaataactatctgtaatggttcaaccattgtggatcaaagacttggcagtgaactggggtgttatactatcaatagagtgaagtcattcaagctatgcgaaaatagtggcacgggaaaatcctgtaagatagataaacacccagttaagtgcaggcagggtttttgcttaaaaattactcaggaaggaaggggccatgtgaagctatcgagaggctcagaagttgtcttagatgcctgcgactcaagctgtgaaataatgataccgaagggcacaggagacatcctagtagactgttcaggtgggcaacaacatttcttaaaagataacttggttgatctaggatgccctaacattccactattaggtaaaatggctatctacatttgcaggatgtcaaatcaccctaaaacaactatggcttttctcttttggtttagtttcggctatgtaataacatgtatattttgtaaaatcattttttacttgttgatagtcgtggggacattggggaaaaagttcaaacagtaccgggagctgaaacctcagacttgtactatatgtgaaacaactcctaccaatgcaatagatgctgaaatgcacgatcttaaatgcagttacaatatatgcccttattgtgcatctagattaacctcggacgggcttgccaggcatgtgacacaatgccctaagcgaaaagagaaagtagaagagactgaactgtacttgaacttggaaagaattccttggattgtcagaaaactactgcaagtgtcagagtctaccggtgtggcactgaaaaggagcagttggctgattgtgttacttgtgctacttacagtttcattgtcaccggttcaatcagcacccattgga

SEQ ID NO: 3926 - RNA, 972 nt, synthetic construct
  misc_feature 1..972: note = derived and/or modified CDS sequence (wt) from CCHFV(BA8402)__AF350449.1__Gn
  source 1..972: mol_type = other RNA
tccgaagagtctggtgatgactgcatatcaagaactcagctattgaggacagagactgcggaaattcacaatgataactatggtggtccaggtgacaagataaccatctgcaatggttcaactgttgtggatcagagattgggcagtgaactggggtgttacactatcaatagagtaaactcttttaacctttgcgaaaacactgccacgggcaaatcctgtgaaatagatagcaccccagtcaaatgcaggcagggtttctgtttgaaaattactcaggagggaaggggccacgtgaagctatcgagaggttcagaagttgtcctggacgcctgcgaatcaagctgtgaaataatgataccaaagggcaccggagacatcctagttgactgttcaggtggacagcaacatttcttaaaagataacttgattgatctaggatgcccaaacatcccactattaggcaagatggctatctacatttgtagaatgtcaaatcatcctaaaacgactatggcttttcttttttggtttagctttggttatgtggtgacctgtatactctgtaaggtcatcttctatctattaatagttgtggggacgttggggaaaaagttcaaacagtatagagagttgaaacctcagacctgtaccatatgcgaaacaactcctgttaatgcaatagatgctgaaatgcacgacctcaattgcagttacaatatatgtccatactgtgcatctaggccaacctcagatggtcttgccagacatgttatgcagtgccctaagcggaaggaaaaaattgaagaaaccgcattatacttaaacttggaaagaatcccctgggttgttaggaaattactgcaggtgtcagaatccaccggtgtggcactaaagaggagtagttggctggttgtgctacttgtgctacttacagtttcattgtcaccagtacaatcagcacctatcggc

SEQ ID NO: 3927 - RNA, 972 nt, synthetic construct
  misc_feature 1..972: note = derived and/or modified CDS sequence (wt) from CCHFV(Matin)__AF467769.2__Gn
  source 1..972: mol_type = other RNA
tccgaagagtctggtgatgactgtatatcaagaactcagctattgaggacagagactgcggaaattcacagtgatagctatggtggaccaggtgataagataaccatctgcaatggttcaactgttgtagatcagaggttgggcagtgaactagggtgttacactataaatagagtaaagtcatttaagctttgcgagaacagtgccacaggtaaatcctgtgaaatagatagcaccccagttaaatgcaggcagggtttttgcttaaaaattactcaggagggaaggggccacgtgaagctgtcgagaggttcagaagttgtcttggatgcctgtgactcaagctgtgaaataatgataccaaagggcactggagacatcctagttgactgttcaggtgggcagcaacatttcttaaaagataacctgattgatctgggatgccccaacattccactattaggcaaaatggccatctacatttgtagaatgtcaaatcatcccaaaacaactatggtttttcttttttggtttagctttggttatgtaataacctgtatactctgtaaggtcatcttctatctattaatagttgtagggacattagggaaaaagttcaaacagtatagagagttgaaacctcagacctgtaccatatgcgaaacaactcctgttaatgcaatagatgctgaaatgcacgaccttaactgcagttacaatatatgtccttactgtgcatccaggttgacatcagatggtcttgccagacatgtaatgcagtgccccaaacggaaggaaaaaatagaagaaaccgaattatacttaaacttagaaaggatcccttgggttgttaggaaattactgcaggtgtcagaatctaccggtgtggcactaaagaggagtagctggctggttgtgctacttgtgttacttacagtttcactatcaccagtacaatcagcacctatcggc

SEQ ID NO: 3928 - RNA, 972 nt, synthetic construct
  misc_feature 1..972: note = derived and/or modified CDS sequence (wt) from CCHFV(Baghdad 12)__AJ538197.2__Gn
  source 1..972: mol_type = other RNA
tctgaagaatctggtgatgactgcatatcaagaactcggctattgagaacagagactgcagagatccatggtgacagctatggtggtccgggtgacaaaattactatttgcaacggttcaactattgtagatcaaagactgggaagtgagatggggtgttacactatcaatagagtgaagtcattcaagctgtgcgaaaacagtgcaacaggaaagagctgtaaaatagacagtatcccagttaagtgcagacagggttattgcctaaaaatcactcaggaaggaaggggccatgtgaaattatccaggggctcagaggttgtcttggatgcatgcgactcaagctgtgaagtaatgatacctaaaggcacaggtgacatcttagtagactgttcaggtgggcagcaacattttttgaaggataacttgattgatctaggatgccccaacattccattattaggtaaaatggctatttatatttgcagaatgtcaaatcaccctaagacaaccatggctttcctcttttggttcagttttggttatgtgataacctgtatactctgcaaggccatcttctacttattaataattgttgggacactagggaaaaggtttaagcagtacagagagttaaaaccccagacctgtactatatgtgagacaactcctgtaaatgcaatagatgctgaaatgcatgaccttaactgcagttacaatatatgtccctattgtgcatctagattaacctcagatgggcttgctaggcatgtgacacaatgccctaagcggaaggagaaagtggaagaaactgaattgtacttgaacttagagaggattccctgggttgtaagaaagctgttgcaggtatcagagtccacaggtgttgcattaaagagaagcagctggctgattgtgctgcttgtgctacttgcagtttcatcatcaccagttcaatcagcacccatcggt

SEQ ID NO: 3929 - RNA, 972 nt, synthetic construct
  misc_feature 1..972: note = derived and/or modified CDS sequence (wt) from CCHFV(VLG/TI29414)__AY179961.1__Gn
  source 1..972: mol_type = other RNA
tccgaggagccaggtgatgactgcatatcaagaactcagctattgagggcagaaccagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaatttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagcccctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaagagactgagctgtacttgaacctggaaagaattccttggaatgtcagaaagctattgcaagtgtcagagtccactggtgtggcattgaaacgaagcagctggctgattgtactgcttgtgttactcacagtttcattgtcaccggttcaatcagcacctgttggt

SEQ ID NO: 3930 - RNA, 972 nt, synthetic construct
  misc_feature 1..972: note = derived and/or modified CDS sequence (wt) from CCHFV(TADJ/HU8966)__AY179962.1__Gn
  source 1..972: mol_type = other RNA
tctgaagaatctggtgacgactgcatatcaagaactcagctactgaggacagagactgcagagatccatggtgatgattatggtggtccgggtgacaagattaccatttgcaatggttcgactattgtagatcaaagactgggtagtgaactggggtgttacactatcaatagagtgaagtcattcaagctgtgcgaaaacagtgcaacagggaagaactgcgaaatagacagcgtcccagttaaatgcaggcagggttattgcctaaaaattactcaggaaggaaggggccatgtgaaattatccaggggctcagaggttgttttggatgcatgcgattcaagctgtgaagtaatgatacctaagggcacaggtgacatctcagtagactgttcaggagggcagcaacattttttgaaagacaacttaattgatctgggatgtcccaagattccattattgggtaaaatggccatttatatttgcagaatgtcgaatcaccctaaaacaaccatggctttcctcttttggttcagttttggctatgtgataacccgtatactctgcaaggccattttctacttattaataattgttggaacactagggaagaggtttaagcaatatagagagttaaaaccccagacctgtaccatatgtgagacaactcctgcaaatgcaatagatgctgaaatgcatgaccttaactgcagttacaacatatgtccctattgtgcatctagactgacctcagatggactcgctaggcatgtgacacaatgccctaagcggaaggagagagtagaagaaactgaattgtacttgaacttagaaagaattccctggattgtaagaaagctgttgcaggtatcggagtccactggtgttgcattaaaaagaagcagctggctgattgtgctacttgtgctgttcacagtttcattatcaccagttcaatcagcacccattggt

SEQ ID NO: 3931 - RNA, 972 nt, synthetic construct
  misc_feature 1..972: note = derived and/or modified CDS sequence (wt) from CCHFV(Hodzha)__AY223476.1__Gn
  source 1..972: mol_type = other RNA
tctgaagaatctggtgacgactgcatatcaagaactcagctactgaggacagagactgcagagatccatggtgatgattatggtggtccgggcgacaagattaccatttgcaatggttcaactattgtagatcaaagactaggtagtgaactggggtgttacactatcaatagagtgaagtcattcaagctgtgcaaaaacagtgcaacagggaagagctgtgaaatagacagcaccccagttaaatgcaggcagggttattgcctaaaaatcactcaggaaggaaggggccatgtgaaattatccaggggctcggaggttgtcttggatgcatgcgattcaagctgtgaagtaatgatacctaagggcacaggtgacatcctagtagactgttcaggtgggcagcaacattttttgaaagacaacttaattgatctaggatgtcccagaattccattattaggtaaaatggctatttatatttgcagaatgtcgaatcaccctaagacaaccatggctttcctcttttggttcagttttggctatgtgataacctgtatactctgcaaggccattttctacttattaataattgttggaacactagggaagaggttcaagcagtatagagagttaaaaccccagacctgtaccatatgtgagacaactcctgcaaatgcaatagatgctgaaatgcatgaccttaactgcagttacaacatatgtccctattgtgcatctagactaacctcagatgggcttgctaggcatgtgacacaatgccctaagcggaaggagaaggtagaagaaactgaattgtacttgaacttagagagaattccctggattgtaagaaagctgttgcaggtgtcggagtccactggtgttgcattaaaaagaagcagctggctgattgtgctgcttgtgctgttcgcagtttcattatcacctgttcaatcagcacccattggt

SEQ ID NO: 3932 - RNA, 972 nt, synthetic construct
  misc_feature 1..972: note = derived and/or modified CDS sequence (wt) from CCHFV(Kosovo/9553/2001)__AY675511.1__Gn
  source 1..972: mol_type = other RNA
tccgaagagccaggtgatgactgcatatcaaggactcagctattgaggacagaaacagcagagatccatgacgataactatggtggtccaggtgacaaaataactatctgcaatggttcgaccattgtagatcagagactgggcagtgaactagggtgttataccatcaacagggtgaagtcattcaagctatgcgaaaacagcgccacagggaaaacctgtgagatagacagcactccagttaagtgcaggcaaggtttttgtttaaaaatcacccaagagggaaggggccacgtaaaattatctagaggctcagaggttgtcttggacgcttgcgactcaagctgtgaagtaatgatacccaaaggcactggagatatcctagtagactgctctggtggacagcagcatttcttaaaagacaacttgattgacctagggtgccctcatatcccactattgggtaagatggccatttacattgccagaatgtcaaatcatcctaaaacaaccatggcttttctcttctggttcagtttgggctatgtgatcacctgtatactttgcaaggctcttttttattcattgataattattgggacactagggaaaaaaatcaagcaatatagggaactgaaacctcaaacttgcaccatatgtgagacagctcctgtcaatgcaatagatgctgaaatgcatgacctcaactgtagttacaatatatgcccctattgtgcatcaagattgacctctgatgggctagctaggcatgtaaagcagtgccctaagcgaaaggagaaagtcgaggagactgagctgtacctgaacctggaaagaattccttgggtcgtcagaaagctattgcaagtgtcagagtccactggtgtggcattgaaacgaagcagttggctgattgtgctgcttgtgttactcacagtttcattgtcaccggttcaatcagcacccgttggt

SEQ ID NO: 3933 - RNA, 972 nt, synthetic construct
  misc_feature 1..972: note = derived and/or modified CDS sequence (wt) from CCHFV(SPU41/84)__AY900142.1__Gn
  source 1..972: mol_type = other RNA
tccgaggagtctagcgacgactgcatatcaagaactcaactattgaggacagagactgcagagatccacggcgataactatggtggcccaggtgacaagataaccatctgcaatggctcaactgttgtagaccagagactgggtagtgagctggggtgttacactatcaatagagtaaagacattcaaactatgcgaaaacagtgctacagggaagagttgtgagatagatagtgtcccagttaaatgcaggcagggttattgcctaaaaatcactcaggaaggaaggggccatgtaaaattatctagaggctcagaggttgtcttggatgcatgtgatacaagctgtgaagtaatgatacccaaaggcactggtgacatcctagttgactgttcaggtgggcagcaacattttctaaaagacaatctaatagacctaggatgccccaaaattccattactgggtaaaatggctatttacatttgcagaatgtcgaatcaccccaaaacaactatggctttcctcttctggttcagctttggctatgtgataacttgtataatttgtaaggtcattttttacttgttaataattgttggaacactaggaaaaaggttcaagcagtacagagagttaaaacctcagacctgcaccatatgtgagacaactcctgtgaatgcaatagatgctgagatgcatgacctcaattgcagttacaacatatgtccctattgtgcatctagactaacctcagacgggcttgctaggcatgtgacacagtgccctaagcggaaggaaaaagtggaggaaactgaattgtacttgaacttggagagaattccctgggttgtgagaaagctgttgcaggtatcagagtccactggtgtggcattgaaaaggagcagctggctggttgtgctgctggtgctgttgacggtttcattgtcaccggttcagtcagcgcccattagt

SEQ ID NO: 3934 - RNA, 972 nt, synthetic construct
  misc_feature 1..972: note = derived and/or modified CDS sequence (wt) from CCHFV(UG3010)__AY900143.1__Gn
  source 1..972: mol_type = other RNA
gcagaaggagtgagcaatgactgtgtttcaaggacccagctaatcaaaacagaagttgcagagattcatgaagatagttatggtgggcctggagaaaaaataacaatctgcaacggctccacaatcgtggaccaaagactcggtagcgaactaggctgctacacaatcaaccgtgtgaagacttataagctttgtgagaatagtgctacagagaagggttgtgagatcgatagtgtcccagtcaaatgcaaacaagggttctgcctcaaagtaacccaagagggcaggggccatgtaaaactgtccagaggaacggaaattgtcctagatgtatgtgacaccagttgtgagttgatgatacccaagggcactggggacatattggtggactgctcaggaggacagcagcactttttgcaggataacttgattgacttaggttgtccaaatgtaccattattaggcaagatggcaatatatatctgcaggatgtcaaatcatcctaaaactaccatggcttttctgttctggtttagctttggctatgtcatcacatgcatagtatgtaaagtgcttttctatctgctaattgtcatcgggacactaagtaagaaacttaaacagtatagggaattaaaacctcaaacatgcattgtctgtgaatcaacccctgttaatgcaatagatgctgaaatgcacgagctcaattgtaattacaacatatgcccatactgcgcgtccagactaacttcagatggactagtcagacatgtgaatcaatgtcccaaaaggaaagaaaaggtcgaggagactgaactatacttgaacctggagaggataccttggctagtaaggaggctactacaagtgtcagagtcaacggggatggctctaaagagaagttgctggatgaccacactcctcattctgctagtagtttcattatcgccagttcaatctgctccagttggt

SEQ ID NO: 3935 - RNA, 972 nt, synthetic construct
  misc_feature 1..972: note = derived and/or modified CDS sequence (wt) from CCHFV(Hy13)__AY900145.1__Gn
  source 1..972: mol_type = other RNA
tccgaagagtctggtgatgactgcatatcaagaactcagctatcgaggacagagactgcggaaattcacagtgataactatggtggtccaggtgacaagataaccatctgcaatggttcaactattgtagatcagagattgggcagtgaactagggtgttacactatcaatagagtaaagtcatttaagctttgcgagaacagtgccacaggtaaatcctgtgaaatagatagcaccccaattaaatgcaggcagggtttttgtttaaaaattactcaggagggaaggggccacgtgaagctatcaagaggttcagaagttgtcttggacgcctgtgattcaagctgtgagataatgataccaaagggcactggagacatcctagttgactgttcaggtggacagcaacatttcttaaaagataacttgattgatctgggatgcccaaacatcccactattaggtaagatggctatctacatttgtagaatgtcaaatcatcctaaaacgactatggcttttcttttttggtttagctttggttatgtgataacctgtatactctgtaaggtcatcttctacctattaatagttgtggggacgttgggaaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagacggtcttgccagacatgtaatgcagtgccctaagcggaaggaaaaagtagaagaaaccgaattatacttaaacttagaaagaatcccctgggttgttaggaaattactgcaggtatcagaatccaccggtgtggcactaaagaggagtagttggctggttgtgctacttgtgttacttacagtttcattgtcaccagtacaatcagcacctatcggc

SEQ ID NO: 3936 - RNA, 972 nt, synthetic construct
  misc_feature 1..972: note = derived and/or modified CDS sequence (wt) from CCHFV(Semunya)__DQ094832.1__Gn
  source 1..972: mol_type = other RNA
gcagaaggagtgagcaatgactgcgtttcaaggacccagctaatcaaaacagaagttgcggagattcatgaagatagctacggtgggcctggagaaaaaataacaatctgcaacggctccacaatcgtggaccaaaggcttggtagcgaactaggttgctacacaattaaccgcgtgaagacttataagctttgtgagaacagtgccacagaaaagggttgtgagatcgatagtgttccagtcaaatgcaaacaagggttctgcctcaaagtaacccaagagggcaggggccatgtgaaactatctagaggaacggaaattgtcctggatgtgtgtgacaccagttgtgagttgatgatacctaaaggcactggagacatattggtggactgctcaggaggacagcagcacttcttgcaggacaacttgattgacttaggttgcccaaatgtaccattactaggcaagatggcaatatatatctgcaggatgtcgaaccatccaaagaccaccatggcttttttgttctggttcagttttggctatgtcatcacatgcgtagtatgcaaagtgctcttctatctgctaattgtcatcgggacactaggaaagaaacttaaacagtatagggaactaaaacctcagacatgcattgtctgtgaatcaatccctgtcaatgcaatagatgctgaaatgcacgagctcaattgcaattacaatatatgcccatactgtgcgtccagactgacttcagatggactagttagacatgtgactcaatgtcccaaaaggaaggaaaaggtcgaggagactgagctgtacttgaacctggagaggataccctggttggtaagaagactactgcaagtgtcagagtcaacagggatggctctaaagagaagttgctggatgaccacactcctcattctgctagtagtttcattgtctccagttcaatctgctccagtaggt

SEQ ID NO: 3937 - RNA, 972 nt, synthetic construct
  misc_feature 1..972: note = derived and/or modified CDS sequence (wt) from CCHFV(SPU128/81/7)__DQ157174.1__Gn
  source 1..972: mol_type = other RNA
tccgaagaacccagtgatgactgcatatcaagaactcaactattgaggacagagactgcagagatccacggcgacaactatggtggcccgggtgacaaaataaccatctgcaacggctcaactattgtagaccaaagactaggcagtgagctagggtgttacactatcaacagagtgaagtcattcaagctatgcgaaaatagtgccacagggaagagctgtgaaatagaaagtgtcccagttaaatgcaggcagggttattgcctgagaatcactcaggaagggaggggccatgtaaaattatctaggggctcagaggttgtcttagatgcatgtgatacaagctgtgaaataatgatacctaagggcactggtgacatcttggttgactgttcaggtgggcagcaacattttctaaaggacaatttgatagatctaggatgccccaaaattccattattgggcaaaatggctatttacatttgcagaatgtcgaatcaccccaaaacaaccatggctttcctcttctggttcagctttggctacgtaataacttgtatactttgcaaggccatcttctacttgttaataattattggaacactagggaaaaggttcaagcagtatagagagttaaaacctcagacctgcaccatatgtgagacaactcctgtaaatgcaatagatgctgagatgcacgacctcaattgcagttacaacatttgtccctactgtgcatctagactaacctcagatgggcttgctaggcatgtgacacaatgccctaagcggaaggagaaagtggaagaaactgaactgtacttgaacttagaaagaattccttgggttgtaagaaagctgttgcaggtatcagagtccactggtgtggcattgaaaagaagcagctggctgattgtgctgcttgtgctgttcacggtttcattgtcaccagttcaatcagcacccattggt

SEQ ID NO: 3938 - RNA, 972 nt, synthetic construct
  misc_feature 1..972: note = derived and/or modified CDS sequence (wt) from CCHFV(ROS/HUVLV-100)__DQ206448.1__Gn
  source 1..972: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagcccctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggt

SEQ ID NO: 3939 - RNA, 972 nt, synthetic construct
  misc_feature 1..972: note = derived and/or modified CDS sequence (wt) from CCHFV(AP92)__DQ211625.1__Gn
  source 1..972: mol_type = other RNA
tcagaagggggtgatggaggctgcatctcaagaactcaactgataaaaacagaaactgcggaggtgcacggagacgattacggtggacctggcgagaaaattaccatctgcaatggttcaaccatcgttgatcagaggttaggtagtgaactggggtgttacacaattaacagaataaaatctttcaaactatgcgagaatagtgcccagggcaagaactgtgagatagacagtgcaccagtacaatgcaggcaaggttattgcttgaaaattagtcaagagggaagaggacatgtgaaactttccaggggttcagaaattgttctagatgtttgtgacacaagctgtgagataatgattcctaagggcacaggtgacatcttagtagactgctcaggagggcagcagcattttctacagagcaacttagttgacctgggttgtccgaacattccgctgctgggcaagatggctatttatatttgcagaatgtcaaatcaccctaaaacaaccatggctttccttttttggttcagctttggctacgtgatcacttgtatattgtgcaagacacttttttacatacttataattattgggacattagggaaaaaattaaagcagtacagagagctgaaaccccaaacatgtaccatatgtgaatcagtaccggttaatgcaatagatgctgaaatgcatgacctcaactgcagctacaacatatgcccttattgtgcctccagactcacctcagaggggctcactagacatgtgaaccagtgccccaaaaggaaagagaaggtagaagagacagagttatacctgaacctggaaaggatcccctggattgttaggaagctcctacaggtatctgagtcaacaggtgtggccttaaaaagaagcagctggatgatcgtgctcctcatattactgatagtctctatgtcaccggttcaatctgcaccaataagt

SEQ ID NO: 3940 - RNA, 972 nt, synthetic construct
  misc_feature 1..972: note = derived and/or modified CDS sequence (wt) from CCHFV(ArD8194)__DQ211626.1__Gn
  source 1..972: mol_type = other RNA
gcagagggggggagcaatgattgtgtttcaagaacccagctagtcaaaacagaggttgcagaaattcatgaagacagttacggtggtcctggcgaaaaaatcacaatttgcaacggctccacaatagtggatcaaaggcttggcagcgaattaggttgctatacaataaacagagtgagaacctataagctctgtgagaacagtgccacagaaaagagctgtgaaatagacagtgttccagttaaatgcaaacaggggttctgcctcaaaataactcaggaaggtaggggccatgtgaaattgtctagagggacagaaatcgttttggatgtctgtgatactagctgtgaactgatgatacccaaaggcactggggatatattggtggactgctcaggagggcagcaacactttttacaggacaatctaattgacttgggatgcccaaatattccattgctaggtcgaacagctatatatgtttgtagaatgtcaaaccatcccaagacaaccatggcttttctgttttggttcagttttggctatgtcatcacatgtgtagtgtgcaaggtgctcttctatttgctaattgtcatcgggacactaggaaaaaggctgaaacagtacagagagctaaagcctcaaacatgtattgtctgtgaatctatccctgtcaatgcaatagatgctgaaatgcacgatcttaactgcaactacaacatatgcccttactgtgcatccagactgacctcagatggtctcgtcaggcacgtaactcaatgtcccaaacggaaagagaaggtcgaagaaactgaactatacttaaacctggagagaataccttggttggtgagaaaactcctacaagtgtcggagtcaacaggagtggctctaaagagaagctgctggatgatcacactccttattctgctgactgtttcaatgtcaccagttcagtccgcaccagtaggc

SEQ ID NO: 3941 - RNA, 972 nt, synthetic construct
  misc_feature 1..972: note = derived and/or modified CDS sequence (wt) from CCHFV(ArD15786)__DQ211627.1__Gn
  source 1..972: mol_type = other RNA
gcagagggggggagcaatgactgtgtttcaagaacccagctagtcaaaacagaggttacagaaattcatgaagacagttacggtggtcctggcgaaaaaatcacaatttgcaacggctccacaatagtggatcaaaggcttggcagcgaattaggttgctatacaataaacagagtgagaacctataagctctgtgagaacagtgccacagaaaagagctgtgaaatagacagtgttccagttaaatgcaaacaggggttctgcctcaaaataactcaggaaggtaggggtcatgtgaaattgtctagagggacagaaatcgttctggatgtctgtgatactagctgtgaactgatgatacccaaaggcactggggatatattggtggactgctcaggagggcagcaacactttttacaggacaatctaattgacttgggatgcccaaatattccattgctaggtcaaacggctatatatgtctgtagaatgtcaaaccatcccaagacaaccatggcttttctgttttggttcagttttggctatgtcatcacatgtgtagtgtgcaaggtgctcttctatttgctaattgtcatcgggacactaggaaaaaggctgaaacagtacagagagctaaagcctcaaacatgtattgtctgtgaatctatccctgtcaatgcaatagatgctgaaatgcatgatcttaactgcaactacaacatatgcccttactgtgcatccagactgacctcagatggcctcgtcaggcacgtaactcaatgtcccaaacggaaagagaaggtcgaagaaactgaactatacttaaacttggagagaataccttggttggtaagaaagctcctacaagtgtcggagtcaacaggagtggctctgaagagaagctgctggataatcacactccttattctgctgactgtttcaatgtcaccagttcagtccgcaccggtaggc

SEQ ID NO: 3942 - RNA, 972 nt, synthetic construct
  misc_feature 1..972: note = derived and/or modified CDS sequence (wt) from CCHFV(ArD39554)__DQ211628.1__Gn
  source 1..972: mol_type = other RNA
tcagaaagcaacaacaatgattgcgtatcaaggactcagctgatcaagacagaaaatgctgaaatacatggtgatgactatggcgggcccggagagaaaataaccatctgcaacggctctactattgtagaacaaagattaggcagcgaattaggatgctacactatcaacagaataaagtccttcaaactatgcgaaaatagtgcttcaggaaagggttgtgaaattgacagtactccagtaaaatgtaagcaaggcttctgtttgaaaataacccaagaaggaaggggtcatgttaaactttccagaggctcagagataattctagacgtttgcgactcaagctgtgaaatgatgataccaaaagggtctggtgatatcctggtagattgctctggaggacagcagcacttcctacaggacaacttggtcgacttaggatgcccaaacgttcccctactgggcaaaatggccatatacatctgcagaatgtcaaaccaccccaagacaaccatggccttcctcttttggttcagctttggctatgtcataacctgcatcttttgcaaggttatcttttatgtgctaataataattggaacattaggaaaaaggatcaaacagtacagagagcttaagcctcagacctgcactatatgtgaagcaactcctgttaatgcaatagatgctgaaatgcatgatcttaactgtagctacaacatatgcccttattgcgcatctagattaacttcagaaggtctggttaggcatgtgactcagtgtcctaagaggaaggaaaagatagaggaaacagagctgtacttaaatttggaaaggataccctggtttgtcagaaagctcttgcaggtatcagaatcaacaggggtagcgctcaagagaagcagctggctggtgacacttcttgtgttgctaacagtatctttgtcgcctgtgcaatcagcacccattggt

SEQ ID NO: 3943 - RNA, 972 nt, synthetic construct
  misc_feature 1..972: note = derived and/or modified CDS sequence (wt) from CCHFV(Drosdov)__DQ211630.1__Gn
  source 1..972: mol_type = other RNA
tctgaagagccaggtgacgactgcatatcaagaactcagctattgaagacagaaacagcagagatccatgacgacaactatggtggtccaggtgacaaaataactatctgcaatggttcaaccattgtggatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaagtaatgatacctaaaggcactggagatatcctagtagactgttcaggtggacagcagcatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttactcattgataattattgggacactagggaaaaaaatcaagcaatatagggagctgaaacctcaaacttgcaccatatgtgagacagctcctgtcaatgcaatagatgctgaaatgcatgacctcaaatgtagttacaatatatgcccttattgtgcatcaagattgacctctgatgggctagctaggcatgtgacacaatgccctaagcgaaaggagaaagttgaggagactgaactgtacttgaacctggaaagaattccttggatagtcagaaagctattgcaagtgtcagagtccactggtgtagcattgaaacgaagcagttggctgattgtgctgcttgtgttactcacagtctcattgtcaccggttcaatcagcacctgttggt

SEQ ID NO: 3944 - RNA, 972 nt, synthetic construct
  misc_feature 1..972: note = derived and/or modified CDS sequence (wt) from CCHFV(Oman)__DQ211632.1__Gn
  source 1..972: mol_type = other RNA
tccgaagagtctggtgaagactgtatatcaaggactcagctattgaggacagaaactgcagaaatccatggtgataactatggtggtccaggtgacaaaataaccatctgcaatggttcaaccattgtagatcaaaggctgggtagtgaactggggtgttacactatcaatagggtgaagtcatttaagctatgcgaaaacagtgccacaggtaagtcctgtgaaatagataacactccagtaaaatgcaagcaaggtttttgcttgaaaataacccaagaaggaaggggccacgtgaagctttcaagagactcagaagttgtcctggacgcctgcgattcaagctgtgaaataatgataccaaagggcactggagacatcctggttgactgctcaggtgggcagcagcacttcttaaaagacaacctgattgatctgggatgccccaacatcccattattaggcaaaatggcaatctacatttgtagaatgtcaaatcatcctaaaacaactatggcttttcttttttggtttagctttggttatgtgataacctgcatactttgtaaagtcattttttatctattgatagttgttggaactttagggaaaaagtttaaacagtatagagagttaaaacctcagacctgcacaatatgtgaaacaactcctgtcaatgcaatagatgctgagatgcacgatctcaattgtagttacaatatatgtccttattgtgcatctaggttaacttcagatggtcttgccagacatgtaatgcagtgtcctaagcggaaggaaaaaatagaagaaaccgaattatacctgaacttagaaagaatcccttgggttgtcagaaaactactgcaggtgtcagaatccactggtgtagcactaaagaggagcagttggctgattgtgctacttgtgcttctcacagtttcattgtcaccagtacaatcagcacctatcggt

SEQ ID NO: 3945 - RNA, 972 nt, synthetic construct
  misc_feature 1..972: note = derived and/or modified CDS sequence (wt) from CCHFV(SPU97/85)__DQ211633.1__Gn
  source 1..972: mol_type = other RNA
tccgaggagtctgatggtgactgtatatcaagaactcaactattgaggacagagactgcagaaatccacagtgacaactatggtggcccaggtgacaaaataactatctgcaatggttcaactattgtagatcaaagactaggcagtgaactggggtgttatactatcaatagggtaaagtcatttaagctttgcgaaaacagtgccacaggaaaatcttgtgaaatagatagcaccccagttaagtgcagacaaggtttttgcttgaaaatcactcaagaagggaggggccacgtgaagctgtcgagaggctcagaaattgtcttggacgcctgcgattcaagctgtgaaataatgataccaaagggcaccggagacatcttagttgactgttcaggtggacaacaacatttcttaaaagataatttgattgatcttggatgtcccaatatcccattattaggcagaatggccatctacatttgcagaatgtccaatcatcctaaaacaaccatggcctttctcttttggtttagctttggttatgtgataacctgtatcctttgtaaggtgatcttttacctattgatagttgcagggacagtagggaaaaagttcaaacagtatagagagttgagacctcagacctgcaccatatgtgaaacaactcctgtcaatgcaatagatgctgaaatgcatgacctcaactgcagttacaatatatgtccttattgcgcatctagattaacctcagatggtcttgccagacatgtaatgcaatgccccaagcggaaggaaaaaatagaggaaactgaattatacttaaacctagaaaggattccctgggttgttaggaaattattgcaagtttcagagtctaccggtgtggcattgaagaggagcagttggctgacagtgctgcttgtgttgcttatagtttcattgtcaccggtgcagtcagcacctattggt

SEQ ID NO: 3946 - RNA, 972 nt, synthetic construct
  misc_feature 1..972: note = derived and/or modified CDS sequence (wt) from CCHFV(SPU103/87)__DQ211634.1__Gn
  source 1..972: mol_type = other RNA
tccgaggagtctagcgacgactgtatatcaagaactcaactattgaggacagagactgcagagatccacggcgataactatggtggcccaggtgacaagataaccatctgcaatggctcaactattgtagaccagagactgggtagtgagctggggtgttacactatcaatagagtaaagacattcaaactatgcgaaaacagtgctacagggaagagttgtgaaatagatagtgtcccagttaaatgcaggcagggttattgcctaaaaatcactcaggaaggaaggggtcatgtaaaattatctagaggctcagaggttgtcttagatgcatgtgacacaagctgtgaagtaatgatacccaaaggcactggtgacatcctagttgactgttcaggtgggcagcaacattttctgaaagacaatctgatagatctaggatgccccaaaattccattgctgggtaaaatggctatttatatttgcagaatgtcgaatcaccccaaaacaactatggctttcctcttctggttcagctttggctatgtgataacttgtgtactttgcaaggccattttttacttgttaataattgttggaacactaggaaaaaggctcaagcagtacagagagttaaaacctcagacctgcaccatatgtgagacaactcctgtgaatgcaatagatgctgagatgcatgacctcaattgcagttacaacatatgtccctattgtgcatctagactaacctcagacgggcttgctaggcatgtgacacagtgccctaagcggaaggaaaaagtggaggaaactgaattgtacttgaacttggaaagaattccttgggttgtgagaaggctgttgcaggtatcagagtccactggtgtggcattgaaaagaagcagctggctgattgtgctactggtgctgttcacggtttcattgtcaccggttcagtcagcgcccattagt

SEQ ID NO: 3947 - RNA, 972 nt, synthetic construct
  misc_feature 1..972: note = derived and/or modified CDS sequence (wt) from CCHFV(SPU415/85)__DQ211635.1__Gn
  source 1..972: mol_type = other RNA
tccgaggagtctgatggtgactgtatatcaagaactcaactattgaggacagagactacagaaatccacagtgacaactatggtggcccaggtgacaaaataactatctgcaatggttcaactattgtagatcaaagactaggcagtgaactggggtgttatactatcaatagggtgaagtcatttaagctttgcgaaaacagtgccacaggaaaatcttgtgaaatagatagcaccccagttaagtgcagacaaggtttttgcttgaaaatcactcaagaagggaggggccacgtgaagctgtcgagaggctcggaaattgtcttggacgcttgcgattcaaactgtgaaataatgataccaaagggcaccggagacatcttagttgactgttcaggtggacaacaacatttcttaaaagataatttgattgatcttggatgtcccaatatcccattattaggcaaaatggccatctacatttgcagaatgtccaatcatcctaaaacaaccatggcctttctcttttggtttagctttggttatgtgataacctgtatactttgtaaggtgatcttttacctattgatagttgcagggacagtaggaaaaaagttcaaacagtatagagagttgagacctcagacctgcaccatatgtgaaacaattcctgtcaatgcaatagatgctgaaatgcatgacctcaactgcagttacaatatatgtccgtattgcgcatctagattaacctcagatggtcttgccagacatgtaatgcaatgccctaagcggaaggaaaaagtagaggaaactgaattatacttaaacctagaaaggattccctgggttgttaggaaattattgcaagtttcagagtctaccggtgtggcattgaagaggagcagttggctgacagtgctgcttgtgttgcttatagtctcattgtcaccggtgcagtcagcacctattggt

SEQ ID NO: 3948 - RNA, 972 nt, synthetic construct
  misc_feature 1..972: note = derived and/or modified CDS sequence (wt) from CCHFV(Turkey200310849)__DQ211636.1__Gn
  source 1..972: mol_type = other RNA
tccgaagagccaggtgatgactgcatatcaagaactcagctattgaggacagaaacagcagagatccatgatgacaactatggtggtccaggtgataaaataactatctgcaacggttcaaccattgtagatcagagactgggcagtgaactagggtgttataccatcaacagggtgaagtcattcaagctatgcgaaaacagcgccacagggaaaacctgtgaggtagacagcactccggttaagtgcaggcaaggtttttgtttaaaaatcacccaagagggaaggggccacgtaaaattatctagaggctcagaggttgtcctggatgcttgcgactcaagctgtgaagtaatgatacctaaaggcactggggatatcctagtggactgttcaggtgggcagcaacatttcttaaaagacaacttaattgacctagggtgcccccatatcccgctattgggtaagatggctatttacatttgcagaatgtcaaatcatcctagaacaaccatggcttttctcttctggttcagctttggctatgttatcacctgtatatcttgcaaggctcttttttattcattgataattattggaacactaggaaaaaagatcaagcaatatagggaactgaaacctcaaacctgcaccatatgtgagacagctcctgtcaatgcaatagatgctgaaatgcatgacctcaactgtagttacaatatatgcccttattgtgcatcaagattgacctccgatgggctagccaggcatgtaacgcaatgccccaagcggaaagagaaggttgaagagactgaactgtacctgaacctggaaagaattccttggattgtcagaaagctattgcaggtgtcagagtccactggtgtggcattaaaacgaagcagctggctgattgtactgcttgtgttactaacagtttcattgtcaccggttcaatcagcacctgttggt

SEQ ID NO: 3949 - RNA, 972 nt, synthetic construct
  misc_feature 1..972: note = derived and/or modified CDS sequence (wt) from CCHFV(Kosova Hoti)__EU037902.1__Gn
  source 1..972: mol_type = other RNA
tccgaagagccaggtgatgattgcatatcaaggactcagctattgaggacagaaacagcagagatccatgacgataactatggtggtccaggtgacaaaataactatctgcaatggttcaaccattgtagatcagagactgggcagtgaactagggtgttacaccatcaacagggtgaagtcattcaagctatgcgaaaacagcgccacagggaaaacctgtgagatagacagcactccagttaagtgcaggcaaggtttttgtttaaaaatcacccaaaagggaaggggccacgtaaaattatctagaggctcagaggttgtcttggacgcttgcgactcaaactgtgaagtaatgatacctaaaggcactggagatatcctagtggactgttcaggtggacagcagcatttcttaaaagacaacttgattgacctggggtgccctcatatcccactattgggtaagatggccatttacatttgcagaatgtcaaatcatcctaaaacaaccatggcttttctcttctggttcagctttggttatgtgatcacctgtatattttgcaaggctcttttttattcattgataattattgggacactaggaaaaaagatcaagcaatatagggaactgaaacctcaaacttgcaccatatgtgaaacagctcctgtcaatgcaatagatgctgaaatgcatgacctcaactgtagttacaatatatgcccttattgtgcatcaagattgacctccgatgggctagctaggcatgtaaagcaatgccctaagcgaaaggagaaagtcgaggagactgagctgtacctgaacctggaaagaattccttgggtcgtcagaaagctattgcaagtgtcagagtccactggtgtggcattgaaacgaagcagttggctgattgtgctgcttgtgttactcacagtttcattgtcaccggttcaatcagcacctgttggt

SEQ ID NO: 3950 - RNA, 972 nt, synthetic construct
  misc_feature 1..972: note = derived and/or modified CDS sequence (wt) from CCHFV(YL04057)__FJ562094.1__Gn
  source 1..972: mol_type = other RNA
gcagaaggaggaagcagtgactgcatttcaagaactcagctagttaaaacagaggttgcagaaattcatgaggacagttacggtgggcctggtgagaaaataacaatctgcaatggttccacaattgtagatcaaaggcttggtagggaattgggctgttatacaatcaacagagtaagatcctacaagctatgcgagaacagtgcctcagggaaaagctgtgaaatagatagcatcccagtcaaatgcaaacaagggttttgcctcaaaataacccaagaaggaagaggtcatgtaaaactgtccagagggacagaaattgttctagatgtctgtgattccagctgtgagctgatgatacctaagggcactggagacattttagtggattgctcaggagggcagcagcattttttacaaaacaatctgattgacttgggatgccccaatgtcccactactgggtaaaatggccatatatgtctgcaggatgtcaaaccacccaaaaactaccatggcatttctgttctggttcagctttggctatgtcattacatgtatagcatgcagggtactcttctacttgctgattgccatcggaacagtagggaaaaagctaaaacagtatagagagctgaaaccacaaacatgcattgtttgtgaatctgtccctgttaatgcaatagatgctgaaatgcatgagcttaattgcagttacaatatatgcccatactgtgcatctagactgtctacagacgggctcatcaggcacgtaactcagtgtcccaaacggagggagaaggtggaagagactgagctattcttgaacttggaaagaataccttggctggtgagaaagctccttcaagtatcagagtcaacaggaatggctctaaagaggagctgttggatgatcacactcctcattctactattggtttcgatatcaccagtccaatctgcaccggtaggc

SEQ ID NO: 3951 - RNA, 972 nt, synthetic construct
  misc_feature 1..972: note = derived and/or modified CDS sequence (wt) from CCHFV(V42/81)__GU477490.1__Gn
  source 1..972: mol_type = other RNA
tccaaagagccaggtgatgactgtatatcaagaactcagctaatgaggacagaaacagcagagatccatgatgacaactatggtggtccaggtgataaaataactatctgcaatggttcaaccattgtggatcagagactgggcagtgaactagggtgttataccatcaacagggtgaagtcattcaagctatgtgaaaacagcgccacagggaaagcctgtgaagtggacagcactccggttaagtgcaggcagggtttttgtttaaaaatcacccaagagggaaggggccatgtaaagttatctagaggctcagaggttgtcttggatgcttgcgactcaagctgtgaagtaatgatacctaaaggcactggagatatcctagtggactgttcaggtggacagcaacatttcttaaaggacaacttaattgacctagagtgccctcatatcccgctattaggtaagttggccatttacatttgcagaatgtcaaatcatcctagaacaactatggcttttctcttctggttcggctttggctatgtgatcacctgtatactctgcaaggctcttttttattcattgataattattgggacactagggaaaaagatcaagcaatatagggaactgaaacctcaaacttgcaccatatgtgagacagctcctgtcaatgcaatagatgctgaaatgcatgaccttaactgtagttacaatatatgcccttattgtgcatcaagattgacctccgatgggctagctaggcatgtaacgcaatgccccaagcgaaaagagaaagttgaggagactgaactgtacttgaatctggagagaattccttggattgtcaggaagctcctgcaagtgtcggagtccactggcgtggtattgaaacgaagcagttggctgattgtgctgcttgtgttactcacagtttcattgtcaccagttcagtcagcacctgttggt

SEQ ID NO: 3952 - RNA, 972 nt, synthetic construct
  misc_feature 1..972: note = derived and/or modified CDS sequence (wt) from CCHFV(Afg09-2990)__HM452306.1__Gn
  source 1..972: mol_type = other RNA
tccgaagaatctggtgatgactgcatatcaagaactcagctattgaggacagagactgcagaggtccatggcgataactatggtggtccaggtgataagataaccatctgtaatggttcaactgttgtagatcaaagactgggtagtgaactggggtgttacactatcaatagagtgaggtcattcaagctatgcgaaaacagtgccacagggaagagctgtgaaatagacagtatcccagtcaagtgtaagcagggttattgccttaaaatcactcaggaaggaaggggccatgtgaagttatctagaggctcagaagttgtcttggatgtatgtgattcaagctgtgaagtgatgatacctaagggcactggtgacattctagtagattgttcaggtgggcagcaacattatttaaaagacaacctggttgacctagggtgtcccaaaattccgttactgggcaaaatggctatttatatctgcaggatgtcgaatcaccccaagacaaccatggccttcctcttttggttcagctttggctatgtgataacttgtatactttgcaaggccatttttttcttattgataatttttggaacactagggaaaaggttcaagcagtacagagagttgaaaccccagacctgcaccatatgtgagacaacacctgtaaatgcaatagatgctgaaatgcatgatctcaactgcagttacaatatatgtccctattgtgcgtctagactgacttcagatgggcttgctaggcatgtaacacaatgtcctagacggaaggagaaagtggaggaaaccgaattatacctgaatttagagagaattccctgggttgtaagaaagctattgcaggtgtcagagtccactggtacagtattaaaaaggagcagctggctaattgtattacttgtgctgttcacagtttcattgtcaccagttcaatcagcacccattggt

SEQ ID NO: 3953 - RNA, 972 nt, synthetic construct
  misc_feature 1..972: note = derived and/or modified CDS sequence (wt) from CCHFV(Sudan Al-Fulah 3-2008)__HQ378184.1__Gn
  source 1..972: mol_type = other RNA
tccgaagaacccagtgatgactgcatatcaagaactcaactattgaggacagagactgcagaaatccacggcgacaactatggtggcccgggtgacaaaataaccatctgcaacggctcaactattgtagaccaaagactgggcagtgagttagggtgttacactatcaatagagtgaagtcattcaagctatgtgaaaatagtgccactgggaagagctgtgtgatagacagtgtcccagttaaatgcaggcagggttattgcctaaggattactcaagaaggaaggggccatgtaaaattatctaggggctcagaggttgtcttagatgcatgcgatacaagctgtgaaataatgatacctaagggcaccggtgacatcctagttgactgttcaggtgggcagcaacattttctaaaggacaatttggtagatctaggatgccccaaaatcccattactgggcaaaatggctatctacatttgcagaatgtcgaatcaccccaaaacaaccatggctttcctcttctggttcagctttggctatgtaataacttgtatactttgcaaggccatcttttacttgttaataattattggaacactagggaaaaggttcaggcagtatagagagttaaagcctcagacctgcaccatatgtgagacaactcctgtaaatgcaatagatgctgagatgcatgacctcaattgcagttacaacatttgtccctactgtgcatctagactaacctcggatgggcttgctaggcatgtgacacagtgccctaagcggaaggagaaagtggaagaaactgaactgtacttgaacttagaaagaattccttgggttgtgagaaagctgttgcaggtatcagagtccaccggtgtggcattgaaaagaagcagctggctgattgtgctgcttgtgctgttcacggtttcattgtcgccagttcaatcagcacccattggt

SEQ ID NO: 3954 - RNA, 972 nt, synthetic construct
  misc_feature 1..972: note = derived and/or modified CDS sequence (wt) from CCHFV(Sudan AB1-2009)__HQ378187.1__Gn
  source 1..972: mol_type = other RNA
tctgaagaacccagtgatgactgtatatcaagaactcaactactgaggacagagactgcagagatccacggcgataactatggtggcccgggtgacaaaataaccatctgcaatggctcaactattgtagaccaaagactgggcagtgaactagggtgttacaccatcaatagagtaaagtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgacacaagctgtgaaataatgatacctaagggcactggtgacatcctagttgactgttcaggcgggcagcaacattttctaaaggacaatttgatagatctaggatgccccaaaattccattattgggcaaaatggctatttacatttgcagaatgtcgaaccaccccaaaacaaccatggctttcctcttctggttcagctttggctatttaataacctgcatactttgcaaggccattttttacttgttgataattattggaacactagggaaaaggctcaagcagtatagagagttgaaacctcagacctgcaccatatgtgagacaactcctgtaaatgcaatagatgctgagatgcatgacctcaattgcagttacaacatttgcccctactgtgcatctagactaacctcagatgggcttgctaggcatgtgatacaatgccctaagcggaaggagaaagtggaagaaactgaactgtacttgaacctagaaagaattccttgggttgtaagaaagctgttgcaggtgtcagagtcaactggtgtagcattgaaaagaagcagttggctgattgtgctgcttgtgctattcactgtttcattgtcaccagttcaatcagcacccattggt

SEQ ID NO: 3955 - RNA, 972 nt, synthetic construct
  misc_feature 1..972: note = derived and/or modified CDS sequence (wt) from CCHFV(NIVA 118595)__JN572083.1__Gn
  source 1..972: mol_type = other RNA
tccgaagaatctggtgatgactgcatatcaagaactcagctattaaggacagagactgcagaggtccatggcgacaactatggtggtccgggtgataagataaccatctgcaatggttcaactgttgtagatcaaagactgggtagtgaactggggtgttacactatcaatagagtgaagtcctttaagctatgcgaaaacagtgccacagggaagagctgtgaaatagacagtatcccagttaagtgtaggcagggttattgcctaaaaatcactcaggaaggaaggggccatgttaaattatctaggggttcagaagttgtcttggatgcatgtgactcaagctgtgaagtgatgatacctaagggcactggtgacattctagtagattgttcaggtgggcagcaacattttttaaaggacaacctgattgatctaggatgtcccaaaattccattattgggcaaaatggctatttatatctgcagaatgtcgaatcaccccaaaacaaccatggcctttctcttttggttcagcttcggctatgtgataacttgtatactttgcaaggtaattttttacttattaataatttttggaacactagggaaaaggttcaagcagtacagagagttgaaaccccagacctgcaccatatgtgagacaacacctgtgaatgcaatagatgctgaaatgcatgatcttaactgcagttacaatatatgtccctattgtgcgtctaggctaacttcagatgggctcgctaggcatgtaacacaatgccctaagcggaaggagaaggtggaagagaccgaattgtacttgaacttagagagaattccttgggttgtaagaaagctattgcaggtgtcagagtccactggcatagcattaaaaaggagcagctggctaattgtgctgcttgtgttattcacagtatcaataacaccggttcaatcagcgcccattggt

SEQ ID NO: 3956 - RNA, 972 nt, synthetic construct
  misc_feature 1..972: note = derived and/or modified CDS sequence (wt) from CCHFV(SCT ex Afghanistan)__KC344856.1__Gn
  source 1..972: mol_type = other RNA
tctgaagagtctggtgacgactgtatatcgaggactcagctattgaggacagagactgcagaggtccataatgataactatggtggtccaggtgacaaaattaccatctgcaacggttcaaccattgtagatcagagacttggcagtgaactggggtgttatactatcaacagagtgaagtcattcaagctatgcgaaaatagcgccacgggaaagtcctgtaaaatagacagcaccccggttaagtgcaggcaaggtttttgcttaaaaatcactcaggaaggaaggggccatgtgaagctatcgagaggctcagaagttgtcttagatgcctgcgattcaagctgtgaaataatgataccgaagggcactggagacatcctagtggactgttcaggtgggcagcaacatttcttaaaagataatttgattgatctaggatgccctaacattccactattaggtaaaatggctatctatatttgtagaatgtcaaatcatcccaaaacaactatggcttttctcttttggttcagttttggttatgtaataacatgtatattttgcaaagtcattttttatttattgatagttgtggggacattgggaaaaaagttcaaacagtatcgagagctgaaacctcagacttgtacaatatgtgaaacaactcctaccaatgcaatagatgctgaaatgcacgatcttaactgcagttacaatatatgtccttattgtgcatctagattaacctcggacgggcttgccaggcatgtgacacaatgccctaagcgaaaggaaaaagtagaagagactgagttgtacttgaacttggaaagaattccttggattgtcagaaaactactgcaggtgtcagagtctacaggtgtggcactgaagaggagcagttggctaattgtgttacttgtgctacttacagtttcattgtcaccggttcaatcggcacccatcggg

SEQ ID NO: 3957 - RNA, 972 nt, synthetic construct
  misc_feature 1..972: note = derived and/or modified CDS sequence (wt) from CCHFV(Zahedan 2007)__KC867273.1__Gn
  source 1..972: mol_type = other RNA
tccgaagaatctggtgatgactgcatatcaagaactcagctattgaggacagagactgcagaggtccatggcgataactatggtggtccaggtgataagataaccatctgtaatggttcaactgttgtagatcaaagactgggtagtgaactggggtgttacactatcaatagagtgaggtcattcaagctatgcgaaaacagtgccacagggaagagctgtgaaatagacagtatcccagtcaagtgtaagcagggtttttgcctaaaaatcactcaggaaggaaggggccatgtgaagttatctagaggctcagaagttgtcttggatgtatgtgattcaagctgtgaagtgatgatacctaagggcactggtgacattctagtggattgttcaggtgggcagcaacattttttaaaagacaacctggttgacctagggtgtcccaaaattccgttactgggcaaaatggctatttatatctgcaggatgtcgaatcatcccaagacaaccatggccttcctcttttggttcagctttggctatgtgataacttgtatactttgcaaggccatttttttcttattaataatttttggaacactagggaaaaggttcaagcagtacagagagttgaaaccccagacctgcaccatatgtgagacaacacctgtaaatgcaatagatgctgaaatgcatgatctcaactgcagttacaatatatgtccctattgtgcgtctagactgacttcagatggacttgctaggcatgtgacacaatgtcctagacggaaggagaaagtggaggaaaccgaattatacctgaatttagaaagaattccctgggttgtaagaaagctattgcaggtgtcagagtccactggtacagtattaaaaaggagcagctggctaattgtattacttgtgctgttcacagtttcattgtcaccagttcaatcagcacccattggt

SEQ ID NO: 3958 - RNA, 972 nt, synthetic construct
  misc_feature 1..972: note = derived and/or modified CDS sequence (wt) from CCHFV(SPU 44/08)__KJ682805.1__Gn
  source 1..972: mol_type = other RNA
tctgaagagtctaatgatgactgtttatcaaggactcagctattgaggacagagaatgcggaaattcacagtgacaactatggtggtccaggtgacaagataactatctgcaacggttcaactattgtagatcagagattgggcagtgaactagggtgttacactatcaatagagtgaaatcatttaagctctgcgaaaacagtgctacaggtaaatcttgtgaaatagatagcaccccagtcagatgtaggcagggtttttgcttgaaaattactcaggagggaaggggccacgtgaagctatcaagaggctcagaagttgtcttggacgcctgtgactcaagctgtgaaataatgataccaaagggcactggggacatcctagttgactgctcaggtgggcagcaacatttcctaaaagataacctggttgatttaggatgccccaacatcccactgttaggcaaaatggccatctacatttgtagaatgtcaaatcatcccaagacaactatggctttccttttttggtttagctttggttatgtgataacctgtatactttgtaaagcaatcttctatctattaatagttgtagggacattaggaaaaaagttcaaacagtacagagagttaaaacctcagacctgtaccatatgtgaaacaaatcctgttaatgcaatagatgctgagatgcacgacctcaactgcagttacaatatatgtccttattgtgcatctaggttaacctcagatggtcttgccagacatgtaatgcaatgccccaaacggaaggaaaaaatagaagaaaccgaattatatttaaacttagaaagaatcccttgggttgttaggaaattactgcaggtgtcagaatccaccggtgtagcactaaagaggagtagttggctggttatactacttgtgctgctcacagtttcattgtcaccagtacaatcagcacccatcagc

SEQ ID NO: 3959 - RNA, 972 nt, synthetic construct
  misc_feature 1..972: note = derived and/or modified CDS sequence (wt) from CCHFV(SPU 383/87)__KJ682806.1__Gn
  source 1..972: mol_type = other RNA
tctgaagagtctaatgatgactgtttatcaaggactcagctattgaggacagagaatgcggaaattcacagtgacaactatggtggtccaggtgacaagataactatctgcaacggttcaactattgtagatcagagattgggcagtgaactagggtgttacactatcaatagagtgaaatcatttaagctctgcgaaaacagtgctacaggtaaatcttgtgaaatagatagcaccccagtcagatgtaggcagggtttctgcttgaaaattactcaggagggaaggggccacgtgaagctatcaagaggctcagaagttgtcttggacgcctgcgactcaagctgtgaaataatgataccaaagggcactggggacatcctagttgactgttcaggtgggcagcaacatttcctaaaagataacctggttgatttaggatgccccaacatcccactgttaggcaaaatggcaatctacatttgtagaatgtcaaatcatcccaagacaactatggctttccttttttggtttagctttggttatgtgataacctgtatactttgtaaagtaatcttctatctattagtagttgtagggacattagggaaaaagttcaaacagtacagagagttaaaacctcagacctgtaccatatgtgaaacgaatcctgttaatgcaatagatgctgagatgcacgacctcaactgcagttacaatatatgtccttattgtgcatctaggttaacctcagatggtcttgccagacatgtaatacaatgccccaaacggaaggaaaaaatagaagaaaccgaattatatttaaacttggaaagaatcccttgggttgttaggaaattactgcaggtgtcagaatccaccggtgtagcactaaagaggagtagttggctggttatactacttgtgctactcacagtttcattgtcaccagtacaatcagcacctatcagc

SEQ ID NO: 3960 - RNA, 972 nt, synthetic construct
  misc_feature 1..972: note = derived and/or modified CDS sequence (wt) from CCHFV(SPU 130/89)__KJ682807.1__Gn
  source 1..972: mol_type = other RNA
tctgaagagcctaattatgactgtttatcaaggactcagctattgaggacagagaatgcggaaattcacagtgacaactatggtggtccaggtgacaagataactatctgcaacggttcaactattgtagatcagagattgggcagtgaactagggtgttacactatcaatagggtgaaatcatttaagctctgcgaaaacagtgctacaggtaaatcttgtgaaatagatagcaccccagtcagatgtaggcagggtttttgcttgaaaattactcaggagggaaggggccacgtgaagctatcaagaggctcagaagttgtcttggacgcctgtgactcaagctgtgaaataatgataccaaagggcactggggacatcctagttgactgttcaggtgggcagcaacatttcctaaaagataacctggttgatttaggatgccccaacatcccactgttaggcaaaatggccatctacatttgtagaatgtcaaatcatcccaagacaaccatggctttccttttttggtttagctttggttatgtgataacctgcatactttgtaaagtaatcttctatctattaatagttgtagggacattaggaaaaaagttcaaacagtacagagagttaaaacctcagacctgtaccatatgtgaaacgaatcctgttaatgcaatagatgctgagatgcatgacctcaactgcagttacaatatatgtccttattgtgcatctaggttaacctcagatggtcttgccagacatgtaatgcaatgccccaaacggaaggaaaaaatagaagaaaccgaattatatttgaacttagaaagaatcccttgggttgttaggaaattactgcaggtgtcagaatccaccggtgtagcactaaagaggagtagttggctggttgtactacttgtgctactcacagtttcattgtcaccagtacaatcagcacctatcagc

SEQ ID NO: 3961 - RNA, 972 nt, synthetic construct
  misc_feature 1..972: note = derived and/or modified CDS sequence (wt) from CCHFV(SPU 497/88)__KJ682808.1__Gn
  source 1..972: mol_type = other RNA
tctgaagagtctaacgatgactgtttatcaaggactcagctattgaggacagagaatgcggaaattcacagtgacaactatggtggtccaggtgacaagataactatctgcaacggttcaactattgtagatcagagactgggcagtgaactagggtgttacaccatcaatagagtgaaatcatttaagctctgcgaaaacagtgctacaggtaaatcttgtgaaatagatagcaccccagtcagatgtaggcagggtttttgcttgaaaattactcaggagggaaagggccacgtgaagctatcaagaggctcagaggttgtcctggacgcctgtgattcaagctgtgaaataatgataccaaagggcacaggggacatcctagttgactgttcaggtgggcagcaacatttcctaaaagataacctggttgatctaggatgccccaacatcccactgttaggcaaaatggccatctacatttgtagaatgtcaaatcatcccaagacaactatggttttccttttttggtttagctttggctatgtgataacctgtatactttgtaaagtaatcttctatctattaatagttgtagggacgttaggaaaaaagttcaaacagtacagagagttaaaacctcagacctgtaccatatgtgaaacaaaccctgttaatgcaatagatgctgagatgcacgacctcaactgcagttacaatatatgtccttattgtgcatctaggttaacctcagatggtcttgccagacatgtaatgcaatgccccaaacggaaggaaaaaatagaagaaaccgaattatatttaaacttagaaagaatcccttgggttgttaggaaattactgcaggtgtcagaatccaccggtgtagcactaaagaggagtagttggctggttatactacttgtgctactcacagtttcattgtcaccagtacaatcagcacctatcagc

SEQ ID NO: 3962 - RNA, 972 nt, synthetic construct
  misc_feature 1..972: note = derived and/or modified CDS sequence (wt) from CCHFV(SPU 18/88)__KJ682810.1__Gn
  source 1..972: mol_type = other RNA
tctgaagagtctaatgatgactgtttatcaaggactcagctattgaggacagaaaatgcggaaattcacagtgacaactatggtggtccaggtgacaagataactatctgcaacggttcaactattgtagatcagagactgggcagtgaactaggatgttacactatcaatagagtgaaatcatttaagctctgtgaaaacagtgctacaggtaaatcttgtgaaatagatagcaccccagtcagatgtaggcagggtttttgcttgaaaattactcaggagggaaggggccacgtgaagctatcaagaggctcagaagttgtcttggacgcctgtgattcaagctgtgaaataatgataccaaagggcactggggacatcctagttgactgttcaggtgggcagcaacatttcctaaaagataacctggttgatctaggatgccccaacatcccactgttaggcaaaatggccatctacatttgtagaatgtcaaatcatcccaagacaactatgggtttccttttttggtttagctttggttatgtgataacctgtatactttgtaaagtaatcttctatctattaatagttgtagggacattagggaaaaagttcaaacagtacagagagttaaaacctcagacctgtaccatatgtgaaacgaatcctgttaatgcaatagatgctgagatgcacgacctcaactgtagttacaatatatgtccttattgtgcatctaggctgacctcagatggtcttgccagacatgtaatgcaatgccccaaacggaaggaaaaaatagaagaaaccgaattatatttaaacttagaaagaatcccctgggttgttaggaaattactgcaggtgtcagaatccaccggtgtagcactaaagaggagtagttggctggttatactacttgtgctactcacagtttcattgtcaccagtacaatcagcacctatcagc

SEQ ID NO: 3963 - RNA, 972 nt, synthetic construct
  misc_feature 1..972: note = derived and/or modified CDS sequence (wt) from CCHFV(SPU 48/90)__KJ682813.1__Gn
  source 1..972: mol_type = other RNA
tccgaagaacccagtgatgactgcatatcaagaactcagctattgaggacagagactgcagagatccacggcgacaactatggtggcccgggtgacaaaataactatctgcaatggctcaactattgtagaccaaagactgggcagtgagctagggtgttacactatcaacagagtgaagtcattcaagctatgcgaaaatagtgccacagggaagagctgtgtaatagacagtgtcccagttaaatgcaggcaaggttattgtctaagaatcactcaggaaggaaggggccatgtaaaattatctaggggctcagaggttgtcttagatgcatgcgatacaagctgtgaaataatgatacctaagggcaccggtgacatcctagttgactgttcaggtgggcagcaacattttctaaaggacaatttgatagatctaggatgccccaaaattccattattgggcaaaatggctatctacatttgcagaatgtcgaatcaccccacaacaaccatggctttcctcttctggttcagctttggctatgtaataacttgtatactttgcaaggccatcttttacttgttaataattattggaacactagggaaaaggttcaggcagtatagagagttaaaacctcagacctgcaccatatgtgagacaactcctgtaaatgcaatagatgctgagatgcatgacctcaattgcagttacaacatttgtccctactgtgcatctagactaacctcagatgggcttgctaggcatgtgacacagtgccctaagcggaaggagaaagtggaagaaactgaactgtacttgaacttagaaagaattccttgggttgtaagaaagctattgcaggtatcagagtccaccggtgtggcattgaaaagaagcagctggctgattgtgctgcttgtgctgttcacggtttcattgtcgccagttcaatcagcacccattggt

SEQ ID NO: 3964 - RNA, 972 nt, synthetic construct
  misc_feature 1..972: note = derived and/or modified CDS sequence (wt) from CCHFV(SPU 187/90)__KJ682814.1__Gn
  source 1..972: mol_type = other RNA
tccgaagaacctagtgatgactgcatatcgagaactcaactattgaggacagagactgcagagatccacggcgacaactatggtggcccgggtgacaaaataaccatctgcaacggctcaactattgtagaccaaagactgggcagtgagctagggtgttacactatcaatagagtgaagtcattcaagctatgcgaaaatagtgccacagggaagagctgtgaaatagacagtgtcccagttaaatgcaggcagggttattgcctaagaatcactcaggaagggaggggccatgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcgaatcaccccaaaacaaccatggctttccttttctggttcagctttggctacgtaataacttgtatactttgcaaggccatcttttacttgttaataattattggaacgctagggaagaggttcaagcagtatagagagttaaaacctcagacctgcaccatatgtgagacaactcctgtaaatgcaatagatgctgagatgcatgacctcaactgcagttacaacatttgtccctactgtgcatctagactaacctcagatgggcttgctaggcatgtgacacaatgccctaagcggaaggagaaagtggaagaaactgaactatacttgaacttagaaagaattccttgggttgtaagaaagctgttgcaggtatcagagtccactggtgtggcattgaaaagaagcagctggctgattgtgctgcttgtgctgttcacggtttcattgtcaccagttcaatcagcacccattggt

SEQ ID NO: 3965 - RNA, 972 nt, synthetic construct
  misc_feature 1..972: note = derived and/or modified CDS sequence (wt) from CCHFV(Haskovo-V46/13)__KR092379.1__Gn
  source 1..972: mol_type = other RNA
tccgaagagctaggtgatgactgtatatcaagaactcagctattgaggacagaaacagcagagatacatgatgacaactatggtggtccaggtgataaaataactatctgcaatggttcaaccattgtagatcagagactgggcagtgaactaggatgttataccatcaacagggggaagtcattcaagctatgcgaaaacagcgctacagggaaaacctgtgagatagacagcactccggttaagtgcaggcaaggtttttgtttaaaaatcacccaagagggaaggggccacgtaaaattatctagaggctcagaggttgtcctggatgcttgcgactcaagctgtgaagtaatgatacctaaaggcactggagatatcctagtggactgttcaggtgggcagcaacatttcttaaaagacaacttaattgacctagggtgcccccatatcccgctattgggtaagatggctatttacatttgcagaatgtctaatcatcctagaacaaccatggcttttctcttctggtttagctttggctatgtgatcacttgtatattttgcaaggctcttttttattcattgataattattgggacactagggaaaaaaatcaagcaatatagggaactgaaacctcaaacctgcaccatatgtgagacaactcctgtcaatgcaatagatgctgaaatgcatgacctcaactgtagttacaatatatgcccttattgtgcatcaagattgacctccgatgggctagccaggcatgtaacacaatgccccaagcggaaagagaaagttgaggagactgaactgtacctgaacctggaaagaattccttggattgtcagaaagctattgcaggtgtcagagtccaccggtgtggcattgaaacgaagcagctggctgattgtactgcttgtgttactcccagtttcattgtcgccggttcaatcagcacctgttggt

SEQ ID NO: 3966 - RNA, 972 nt, synthetic construct
  misc_feature 1..972: note = derived and/or modified CDS sequence (wt) from CCHFV(24-R-2012)__KR814856.1__Gn
  source 1..972: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgacacaagctgcgaagtaatgatacctaaaggcactggagatatcctggtggactgttcaggtggacagcaacatttcttaaaagacaatttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggt

SEQ ID NO: 3967 - RNA, 972 nt, synthetic construct
  misc_feature 1..972: note = derived and/or modified CDS sequence (wt) from CCHFV(36-ST-2014)__KR814857.1__Gn
  source 1..972: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtaaagtcattcaagctatgcgaaaacagtgccacagggaaaacctgtgagatagacagcactccggtcaagtgcaggcaaggtttttgtttgaaaatcacccaagaggggaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaagctcttttttattcattgataattattgggacactaggaaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgaagcagctggctgattgtgctgcttgtgttactcacagtctcattgtcaccggttcaatcagcacctgttggt

SEQ ID NO: 3968 - RNA, 972 nt, synthetic construct
  misc_feature 1..972: note = derived and/or modified CDS sequence (wt) from CCHFV(44-ST-2010)__KR814859.1__Gn
  source 1..972: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtaaagtcattcaagctatgcgaaaacagtgccacagggaaaacctgtgagatagacagcactccggtcaagtgcaggcaaggtttttgtttgaaaatcacccaagaggggaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaagatggccatttacatttgcagaatgtcaaatcatcccaggacaaccatggctttcctcctctggttcagttttggctatgtaatcacctgtatattttgcaaagctcttttttattcattgataattattgggacactaggaaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgaagcagctggctgattgtgctgcttgtgttactcacagtctcattgtcaccggttcaatcagcacctgttggt

SEQ ID NO: 3969 - RNA, 972 nt, synthetic construct
  misc_feature 1..972: note = derived and/or modified CDS sequence (wt) from CCHFV(47-ST-2013)__KR814861.1__Gn
  source 1..972: mol_type = other RNA
tccgaagagccaggtgacgactgcatatcaagaactcagctgttgaagacagaaacagcagagatccatgacgacaactatggtggtccaggtgacaaaataactatctgcaatggttcaaccattgtagatcagagactgggtagtgaactagggtgttataccatcaacagggtgaagtcattcaagctatgcaaaaacagtgccacagggaaaacctgtgagatagacagcactccggtcaagtgcaggcaaggtttttgtttgaaaatcacccaagagggaaggggccacgttaaattatccaggggctcagaggttgttttggatgcttgcgactcgagctgtgaaataatgatacctaaaggcactggagatatcctagtagactgctcaggtggacagcaacatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagattgacctctgatgggctagctagacatgtgacacaatgccctaagcgaaaggagaaagttgaggagactgaactgtatttgaacctggaaagaattccttggatagtcagaaagttattgcaagtgtcagagtccactggtgtggcattgaaacgaagcagttggctgattgtgctgcttgtgttactcacagtctcattgtcaccggttcaatcagcacctgttggt

SEQ ID NO: 3970 - RNA, 972 nt, synthetic construct
  misc_feature 1..972: note = derived and/or modified CDS sequence (wt) from CCHFV(52-R-2014)__KR814862.1__Gn
  source 1..972: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttatactatcaacagggtgaagtcattcaagctatgcgaaaacagcgccacagggaaaacctgtgagatagacagcactccggttaagtgcaggcaaggtttttgtttaaaaatcacccaagagggaagaggccacgtaaaattatctagaggctcagaggttgttttggatgcttgcgacacaagctgcgaagtaatgatacctaaaggcactggagatatcctggtggactgttcaggtggacagcaacatttcttaaaagacaatttaattgacctagggtgcccccatgtcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggt

SEQ ID NO: 3971 - RNA, 972 nt, synthetic construct
  misc_feature 1..972: note = derived and/or modified CDS sequence (wt) from CCHFV(75-R-2012)__KR814863.1__Gn
  source 1..972: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcgctccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaacttaattgacctagggtgcccacatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagcccctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctagaaagaattccttggattgtcagaaagctattgcaagtgtcagagtccactggtgtggcattgaagcgaagcagctggctgattgtactgcttgtgttactcacagtttcattgtcaccggttcaatcagcacctgttggt

SEQ ID NO: 3972 - RNA, 972 nt, synthetic construct
  misc_feature 1..972: note = derived and/or modified CDS sequence (wt) from CCHFV(75-ST-2010)__KR814864.1__Gn
  source 1..972: mol_type = other RNA
tccgaagagtcaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagaaggaaggggccacgtaaaattatctagaggctcagaggttgttttggatgcttgcgactcaagctgcgaagtaatgatacctaaaggcactggagatatcttggtggactgttcaggtggacagcaacatttcttaaaagacaacttaattgacctagggtgcccccatatcccgctattgggtaaaatggccatttacatctgcagaatgtcaaatcaccctagaacaactatggcttttctcttctggttcagctttggctatgtgatcacctgtttattttgcaaggctcttttttattcattgataatcattgggacactagggaaaaagatcaagcaatatagggaattgagacctcaaacctgtaccatatgtgagacagctcctgtcaatgcaatagatgctgaaatgcatgaccttaactgcagttacaatatatgtccttattgtgcatcaagattgacctccgatgggctagctaggcatgtgccacaatgccccaagcggaaggaaaaagttgaggagactgagctgtacttgaacctggaaagaataccttggattgtcagaaagctattgcaagtgtcagagtccactggtgtggcattgaaacgaagcagctggctgattgtactgcttgtgttactcacagtttcattgtcaccggttcaatcagcacctgttggt

SEQ ID NO: 3973 - RNA, 972 nt, synthetic construct
  misc_feature 1..972: note = derived and/or modified CDS sequence (wt) from CCHFV(3820-ST-2007)__KR814868.1__Gn
  source 1..972: mol_type = other RNA
tccgaagagccaggtgacgactgcatatcaagaactcagctattgaagacagaaacagcagagatccatgacgacaactatggtagtccaggtgacaaaatcactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcactgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctggctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcgcagtctcattgtcaccggtccaatcagcacctgttggt

SEQ ID NO: 3974 - RNA, 972 nt, synthetic construct
  misc_feature 1..972: note = derived and/or modified CDS sequence (wt) from CCHFV(4701-ST-2009)__KR814872.1__Gn
  source 1..972: mol_type = other RNA
tccgaagagccaggtgacgactgcatatcaagaactcagctattgaagacagaaacagcagagatccatgacgacaactatggtggtccaggtgacaaaataactatctgcaatggttcaaccgttgtagatcagagactgggcagtgaactagggtgttataccatcaacagggtgaagtcattcaagctatgcgaaaacagtgccacagggaaaacctgtgagatagacagcactccggttaagtgcaggcaagggttttgtttgaaaatcacccaagagggaaggggccacgtaaaattatccaggggctcagaggttgttttggatgcttgcgactcaagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctggctaggcatgtgacacaatgccctaagcgaaaagagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggt

SEQ ID NO: 3975 - RNA, 972 nt, synthetic construct
  misc_feature 1..972: note = derived and/or modified CDS sequence (wt) from CCHFV(5170-R-2011)__KR814873.1__Gn
  source 1..972: mol_type = other RNA
tccgaagagccaggtgacgactgcatatcaagaactcagctattgaagacagaaacagcagaaatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgtttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgaagggctagctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggt

SEQ ID NO: 3976 - RNA, 972 nt, synthetic construct
  misc_feature 1..972: note = derived and/or modified CDS sequence (wt) from CCHFV(200406546-Turkey)__KR864902.1__Gn
  source 1..972: mol_type = other RNA
tccgaagagccaggtgatgactgcatatcaagaactcagctattgaggacagaaacagcagagattcatgatgataactatggtggcccaggtgataaaataactatctgcaacggttcaactattgtagatcagagactgggcagtgaactagggtgttatactatcaacagggtgaagtcattcaagctatgcgaaaacagcgccacagggaaaacctgtgagatagacagcactccagttaagtgcaggcaaggtttttgtttaaaaatcacccaagagggaaggggccacgtaaaattatctagaggctcagaggttgtcttggacgtttgcgactcaagctgtgaagtaatgatacctaaaggcactggagatatcctggtggactgttcaggtggacagcaacatttcttaaaagacaacctaattgacctagggtgcccccatgtcccgctattgggtaggatggccatttacatttgcagaatgtcaaatcatcctagaacaactatggcttttctcttctggttcagctttggctatgtgatcacctgtatattttgcaaggctcttttttattcattgataattattgggacactagggaaaaagttcaagcagtatagggaactgaaacctcaaacttgtaccatatgtgagacggctcctgtcaatgcaatagatgctgaaatgcatgaccttaactgcagttacaatatatgcccttattgtgcatcaagattgacctccgacgggctagctaggcatgtgccacaatgccccaagcggaaagaaaaagttgaggagactgaactgtacttgaacctggagagaattccttggattgtcagaaagctattgcaggtgtcagagtccactggtgtggcattgaaacgaagcagctggctgattgtactgcttgtgttactcacagtttcgttgtcaccggttcaatcggcacctgttggt

SEQ ID NO: 3977 - RNA, 972 nt, synthetic construct
  misc_feature 1..972: note = derived and/or modified CDS sequence (wt) from CCHFV(1-CR/HU-2015)__KU161584.1__Gn
  source 1..972: mol_type = other RNA
tccgaagagccaggtgatgactgcatatcaagaactcagctattgaggacagaaacagcagagatccatgacgacaactacggcggtccaggtgacaaaataactatctgcaatggttcaaccatcgtagatcagagactgggcagtgaactagggtgttataccatcaacagggtgaagtcattcaagctatgcgaaaacagcgctacagggaaaacctgtgagatagacagcactccggtcaagtgcaggcaaggtttctgtttaaaaatcacccaagagggaaggggccacgtaaaattatctagaggctcagaggttgtcttggatgcttgcgactcaagctgtgaagtgatgatacctaaaggcaccggagatatcctagtagactgttcaggtggacagcagcattttttaaaagacaacttgattgacctagggtgcccccacatcccgctattgggtaagatggccatttacatttgcagaatgtcaaatcatcctaggacaaccatggcttttctcttctggttcagctttggctatgtgatcacctgtatattttgcaaggctcttttttattcattaataattattgggacactagggaaaaagatcaagcagtatagagaactaaaacctcaaacttgtactatatgtgagacagctcctgtcaatgcaatagatgctgaaatgcatgacctcaactgtagttacaatatatgcccttattgtgcatcaagactgacctctgatgggctagctaggcatgtaacgcaatgccctaagcgaaaggagaaagttgaggagactgaactgtacttgaacctagaaagaattccttggatcgtcagaaagctattgcaagtgtcagagtccactggtgtggccttgaaacgaagcagttggttgattgtgctgcttgtgttactcacagtttcattgtcaccggttcaatcagcacctgttggt

SEQ ID NO: 3978 - RNA, 972 nt, synthetic construct
  misc_feature 1..972: note = derived and/or modified CDS sequence (wt) from CCHFV(Gaib)__KX013445.1__Gn
  source 1..972: mol_type = other RNA
tccgaagaatccagtgatgactgcatatcaagaactcagctattaaggacagagactgcagaaatccataatgataattatggagggccaggtgacaaaataactatttgtaatggttcaactattgtagatcaaaggctaggcagtgaactgggatgttacactatcaatagagtaaagtcatttaagctatgcgaaaacagtgctacagggaaatcctgtgaaatagatagcatccctgtaaagtgcaggcaagggttttgtttaaaaattactcaggagggaagaggccatgtgaagttgtcaagaggttcagaagttgtcttagatgcctgtgattcaagctgtgaaataatgataccaaaaggcaccggagacatcctagtggactgttcaggtgggcaacaacattttttaaaggataacttgattgacttagggtgtcccaatatcccactgttaggcaaaatggctatctacatttgtagaatgtctaatcatcccaaaacaaccatggcctttctcttttggtttagttttggttatgtgataacctgtatattttgcaaagccatcttttatttgttgataatcgtggggacacttggaaaaaagttcaaacagtatagagagttaaaacctcagacctgtaccatatgtgaaacaactcctgtcaacgcaatagacgctgaaatgcatgatcttaactgcagttacaatatatgcccttattgtgcatctagattaacctcagatggacttgccagacacgttgtgcactgccctaagcggaaggagaaaatagaagagactgaactgtacttaaacttagaaagagttccttgggttgttagaaaactacttcaggtgtctgaatcaactggtgtggcactgaagaggagcagttggctaattgtgctacttgtgctacttacagtctcattgtcaccagttcaatcagcacccatcggt

SEQ ID NO: 3979 - RNA, 972 nt, synthetic construct
  misc_feature 1..972: note = derived and/or modified CDS sequence (wt) from CCHFV(Hodzha)__KX013448.1__Gn
  source 1..972: mol_type = other RNA
tctgaagaatctggtgacgactgcatatcaagaactcagctactgaggacagagactgcagagatccatggtgatgattatggtggtccgggcgacaagattaccatttgcaatggttcaactattgtagatcaaagactaggtagtgaactggggtgttacactatcaatagagtgaagtcattcaagctgtgcgaaaacagtgcaacagggaagagctgtgaaatagacagcaccccagttaaatgcaggcagggttattgcctaaaaatcactcaggaaggaaggggccatgtgaaattatccaggggctcggaggttgtcttggatgcatgcgattcaagctgtgaagtaatgatacctaagggcacaggtgacatcctagtagactgttcaggtgggcagcaacattttttgaaagacaacttaattgatctaggatgtcccagaattccattattaggtaaaatggctatttatatttgcagaatgtcgaatcaccctgagacaaccatggctttcctcttttggttcagtttcggctatgtgataacctgtatactctgcaaggccattttctacttattaataattgttggaacactagggaagaggttcaagcagtatagagagttaaaaccccagacctgtaccatatgtgagacaactcctgcaaatgcaatagatgctgaaatgcatgaccttaactgcagttacaacatatgtccctattgtgcatctagactaacctcagatgggcttgctaggcatgtgacacaatgccctaagcggaaggagaaggtagaagaaactgaattgtacttgaacttagagagaattccctggattgtaagaaagctgttgcaggtgtcggagtccactggtgttgcattaaaaagaagcagctggctgattgtgctgcttgtgctgttcgcagtttcattatcacctgttcaatcagcacccattggt

SEQ ID NO: 3980 - RNA, 972 nt, synthetic construct
  misc_feature 1..972: note = derived and/or modified CDS sequence (wt) from CCHFV(IbAn7620)__KX013451.1__Gn
  source 1..972: mol_type = other RNA
tccgaagaacccagtgatgactgtatatcaagaactcaactattgaggacagagactgcagagatccacggcgacaactatggtggcccgggtgataaaataaccatctgcaatggctcaactattgtagaccaaagactgggcagtgaactagggtgttacaccatcaatagagtgaagtcattcaagctatgcgaaaacagtgccacagggaagaattgtgaaatagacagtgtcccagttaaatgcaggcagggttattgcctaagaatcactcaagaagggaggggccacgtaaaattatctaggggctcagagattgtcttagatgcatgcgatacaagctgtgaaataatgatacctaagggcactggtgacatcctagttgactgttcaggtgggcagcaacattttctaaaggacaatttgatagatctaggatgccctaaaattccattattgggcaaaatggctatttacatttgcagaatgtcgaaccaccccaaaacaaccatggctttcctcttctggttcagctttggttatgtaataacctgtatactttgcaaggccattttttacttgttaataattattggaacactagggaaaaggctcaagcagtatagagagttgaaacctcagacctgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggt

SEQ ID NO: 3981 - RNA, 972 nt, synthetic construct
  misc_feature 1..972: note = derived and/or modified CDS sequence (wt) from CCHFV(K128_76)__KX013454.1__Gn
  source 1..972: mol_type = other RNA
tctgatgaatctggtgatgactgcatatcaaggactcagctgttgagaacagagactgcagagatccatggtgacaattatggtggtccgggtgacaagattaccatttgcaatggttcaactattgtagaccaaagactgggtagtgaactggggtgttacactatcaatagagtgaagtcattcaagctgtgcgaaaacagtgccacagggaagagctgtgaaatagacagtatcccagttaagtgcaggcagggttattgcctaaaaatcactcaagaaggaaggggccatgtgaaattatccaggggctcagaggttgtcttggatgcatgcgactcaagctgtgaagtaatgatacctaagggcacaggtgacattctagtagactgttcaggtgggcagcaacattttttgaaggacaacttgattgacctaggatgtcccaaaattccattgttgggcaaaatggctatttatatttgtagaatgtcgaatcaccccaaaacgaccatggctttcctcttttggttcagttttggctatgtgataacttgtatagtctgcaaagccattttttacttattaataattgttggaacactagggaagaggtttaagcagtatagagagttaaaaccccagacctgtaccatctgtgagacaactcctacaaatgcaatagatgctgaaatgcatgaccttaactgcagttacaacatatgtccctattgtgcatctagactaacctcagatgggcttgctaggcatgtaactcattgccctaagcggaaggagaaagtagaagaaactgaattgtacttgaacttagaaagaattccatgggttgtaagaaagctattgcaggtatcagagtccaccggtgtagcattaaaaagaagcagctggctgattgtgctgcttgtgctgtttgcagtttcattatcaccagttcaatcagcacccattagt

SEQ ID NO: 3982 - RNA, 972 nt, synthetic construct
  misc_feature 1..972: note = derived and/or modified CDS sequence (wt) from CCHFV(K168_40)__KX013457.1__Gn
  source 1..972: mol_type = other RNA
tctgatgagtctggtgatgactgcatatcaaggactcagctactgagaacagagactgcagagatccatggtgacaattatggtggtccgggtgacaagattaccatttgcaatggttcaactattgtagaccaaagactgggcagtgaactggggtgttacactatcaatagagtgaagtcattcaagctgtgcgaaaacagtgccacagggaagagctgtgaagtagacagtatcccagtaaaatgcaggcagggttattgcctaaaaatcactcaggaaggaaggggccacgtgaaattatccagaggttcagaggttgtcttggatgcatgcgattcaagctgtgaagtaatgatacctaagggcacaggtgacatcctagtggactgttcaggtgggcagcaacatttcttgaaggacaacttaattgacctaggatgtcccaaaattccattgttgggcaaaatggctatttatatttgcagaatgtcgaatcaccccaagacaaccatggctttcctcttttggttcagttttggctatgtgataacttgtatagtctgcaaggccattttttacttattaataattgttggaacactagggaagaggtttaagcagtatagagagttaaaaccccagacctgcaccatctgtgagacaactcctacaaatgcaatagatgctgaaatgcatgaccttaactgcagttacaacatatgtccctattgtgcatctagactaacctcagatgggcttgctaggcatgtaactcattgccctaagcggaaagagaaagtagaagaaactgaattgtacttgaacttagagagaattccctgggttgtaagaaagctgttgcaggtatcagagtccaccggtgtagcattaaaaagaagcagctggctgattgtgctgcttgtgctgtttgcagtttcattatcaccagttcaatcagcacctattggt

SEQ ID NO: 3983 - RNA, 972 nt, synthetic construct
  misc_feature 1..972: note = derived and/or modified CDS sequence (wt) from CCHFV(K168_125)__KX013460.1__Gn
  source 1..972: mol_type = other RNA
tctgatgagtctggtgatgactgcatatcaaggactcagctactgagaacagagactgcagagatccatggtgacaattatggtggtccgggtgacaagattaccatttgcaatggttcaactattgtagaccaaagactgggcagtgaactggggtgttacactatcaatagagtgaagtcattcaagctgtgcgaaaacagtgccacagggaagagctgtgaagtagacagtatcccagtaaaatgcaggcagggttattgcctaaaaatcactcaggaaggaaggggccacgtgaaattatccagaggttcagaggttgtcttggatgcatgcgattcaagctgtgaagtaatgatacctaagggcacaggtgacatcctagtggactgttcaggtgggcagcaacatttcttgaaggacaacttaattgacctaggatgtcccaaagttccattgttgggcaaaatggctatttatatttgcagaatgtcgaatcaccccaagacaaccatggctttcctcttttggttcagttttggctatgtgataacttgtatagtctgcaaggccattttttacttattaataattgttggaacactagggaagaggtttaagcagtatagagagttaaaaccccagacctgcaccatctgtgagacaactcctacaaatgcaatagatgctgaaatgcatgaccttaactgcagttacaacatatgtccctattgtgcatctagactaacctcagatgggcttgctaggcatgtaactcattgccctaagcggaaagagaaagtagaagaaactgaattgtacttgaacttagagagaattccctgggttgtaagaaagctgttgcaggtatcagagtccaccggtgtagcattaaaaagaagcagctggctgattgtgctgcttgtgctgtttgcagtttcattatcaccagttcaatcagcacctattggt

SEQ ID NO: 3984 - RNA, 972 nt, synthetic construct
  misc_feature 1..972: note = derived and/or modified CDS sequence (wt) from CCHFV(K229_194)__KX013463.1__Gn
  source 1..972: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaaggcaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtatcagagtccactggtgtggcattgaaacgaagcagctggctgattgtgctgcttgtgttactcacagtctcattgtcaccggttcaatcagcacctgttggt

SEQ ID NO: 3985 - RNA, 972 nt, synthetic construct
  misc_feature 1..972: note = derived and/or modified CDS sequence (wt) from CCHFV(K315_14)__KX013469.1__Gn
  source 1..972: mol_type = other RNA
tccgaagagccaggtgacgactgcatatcaagaactcagctattgaagacagaaacagcagaaatccatgacgacaactatggtggtccaggtgacaaaataactatctgcaatggttcaaccgttgtggatcagagactgggcagtgaactagggtgttataccatcaacagggtgaagtcattcaagctatgcaaaaacagtgccacagggaaaacctgtgagatagacagcactccggtcaagtgcaggcaaggtttttgtttgaaaatcacccaagagggaaggggccacgtaaaattatccaggggctcagaggttgttttggatgtttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgaagggctagctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggt

SEQ ID NO: 3986 - RNA, 972 nt, synthetic construct
  misc_feature 1..972: note = derived and/or modified CDS sequence (wt) from CCHFV(K323_27)__KX013472.1__Gn
  source 1..972: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaagctcttttttatttattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgactgtgctgcttgtgttactcacagtctcattgtcaccggtccaatcagcacctgttggc

SEQ ID NO: 3987 - RNA, 972 nt, synthetic construct
  misc_feature 1..972: note = derived and/or modified CDS sequence (wt) from CCHFV(K340_6)__KX013475.1__Gn
  source 1..972: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtctttcaagctatgcgaaaacagtaccacagggaaaacctgtgagatagacagcactccggtcaagtgcaggcaaggcttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgccattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctggctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggt

SEQ ID NO: 3988 - RNA, 972 nt, synthetic construct
  misc_feature 1..972: note = derived and/or modified CDS sequence (wt) from CCHFV(Mamon)__KX013478.1__Gn
  source 1..972: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgtttcggatgcttgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactgtggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattaaaacgaagcagctggctgattgtactgcttgtgttactcacagtttcattgtcaccggttcaatcagcacctgttggt

SEQ ID NO: 3989 - RNA, 972 nt, synthetic construct
  misc_feature 1..972: note = derived and/or modified CDS sequence (wt) from CCHFV(Nakiwogo)__KX013484.1__Gn
  source 1..972: mol_type = other RNA
gcagaaggagtgagcaatgactgcgtttcaaggacccagctaatcaaaacagaagttgcagagattcacgaagatagctacggtgggcctggagaaaaaataacaatctgcaacggctccacaatcgtggaccaaaggcttggtagcgaactaggttgctacacaattaaccgcgtgaagacttataagctttgtgagaacagtgccacagaaaagggttgtgagatcgatagtgttccagtcaaatgcaaacaagggttctgcctcaaagtaacccaagagggcaggggccatgtgaaactatctagaggaacggaaattgtcctggatgtgtgtgacaccagttgtgagttgatgatacctaaaggcactggagacatattggtggattgctcaggaggacagcagcacttcttgcaggacaacttgattgacttaggttgcccaaatgtaccattactaggcaagatggcaatatatatctgcaggatgtcgaaccatcctaagaccaccatggcttttttgttctggttcagttttggctatgtcatcacatgcgtagtatgcaaagtgctcttctatctgctaattgtcattgggacactaggaaagaaacttaaacagtatagggaactaaaacctcagacatgcattgtctgtgaatcaatccctgtcaatgtaatagatgctgaaatgcacgagctcaattgcaattacaatatatgcccatactgtgcgtccagactgacttcagatggactagttagacatgtgactcaatgtcccaaaaggaaggaaaaggtcgaggagactgagctgtacttgaacctggagaggataccttggttggtaagaagactactgcaagtgtcagagtcaacagggatggctctaaagagaagttgctggatgaccacactcctcattctgctagtagtttcattgtctccagttcaatctgctccagttggt

SEQ ID NO: 3990 - RNA, 972 nt, synthetic construct
  misc_feature 1..972: note = derived and/or modified CDS sequence (wt) from CCHFV(Saf)__KX013487.1__Gn
  source 1..972: mol_type = other RNA
tccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacattacttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacggctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggt

SEQ ID NO: 3991 - RNA, 972 nt, synthetic construct
  misc_feature 1..972: note = derived and/or modified CDS sequence (wt) from CCHFV(Ast199)__KX056051.1__Gn
  source 1..972: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttacaccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgcgaaataatgatacctaaaggcactggagatatcctagtagactgttcaggtggacagcaacatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgatgcagctggctgattgtgctgcttgtgttactcacagtctcattgtcaccggttcaatcagcacctgttggt

SEQ ID NO: 3992 - RNA, 972 nt, synthetic construct
  misc_feature 1..972: note = derived and/or modified CDS sequence (wt) from CCHFV(Ast137)__KX056057.1__Gn
  source 1..972: mol_type = other RNA
tccgaagagccaggtgacgactgcatatcaagaactcagctattgaagacagaaacagcagagatccatgacgacaactatggtggtccaggtgacaaaataactatctgcaatggttcaaccattgtggatcagagactgggcagtgaactagggtgttataccatcaacagggtgaagtcattcaagctatgcgaaaacagtgccacagggaaaacctgtgagatagacagcactccggtcaagtgcaggcaagggttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaagatggccattcacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgaagcagctggctgattgtgctgcttgtgttactcacagtctcattgtcaccggttcaatcagcacctgttggt

SEQ ID NO: 3993 - RNA, 972 nt, synthetic construct
  misc_feature 1..972: note = derived and/or modified CDS sequence (wt) from CCHFV(Ast133)__KX056060.1__Gn
  source 1..972: mol_type = other RNA
tccgaagagccagatgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacttgtgagatagacagcactccggtcaagtgcagacaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttatttattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggt

SEQ ID NO: 3994 - RNA, 972 nt, synthetic construct
  misc_feature 1..972: note = derived and/or modified CDS sequence (wt) from CCHFV(SK/2015/human)__KX458183.1__Gn
  source 1..972: mol_type = other RNA
tctgaagaatctggtgatgactgcatatcaagaactcgcctattgagaacagagactgcagagatccatggtgatagctatggtggtccaggtgacaagattactatttgcaatggttcaactattgtagatcaaagactgggtagtgagatggggtgttacactatcaatagagtgaagtcattcaagctgtgcgaaaacagtgcaacagggaagagctgtgaaatagacagtatcccagttaggtgcaggcagggttattgcctaaaaatcactcaggagggaaggggccatgtgaaattatccaggggctcagaggttgtcttggatgcatgcgactcaagctgtgaagtaatgatacctaagggcacaggtgacatccttgtagactgttcaggtgggcagcaacattttttgaaggacaacttaattgatctaggatgtcccaatattccattattaggtaaaatggctatttatatttgcagaatgtcgaatcaccctaagacaaccatggcttttctcttttggttcagttttggctatgtgataacctgtatactctgcaaggctattttctacttattaataattgttggaacactagggaagaggtttaagcagtacagagagttaaaaccccagacctgcaccatatgtgagacaactcctgcaaatgcaatagatgctgaaatgcatgaccttaactgcagttacaccatatgcccctattgtgcatctagactaacctcagatgggcttgctaggcatgtgacacaatgccctaagcggaaggagaaagtagaagaaactgaattgtacctgaacttagagagaattccctgggttgtaagaaagctgttgcaggtatcggagtccactggtgttgcattaaaaagaagtagctggctgattgtgctgcttgtgttgttcacagtttcattatcaccagttcaatcagcacccatcggt

SEQ ID NO: 3995 - RNA, 972 nt, synthetic construct
  misc_feature 1..972: note = derived and/or modified CDS sequence (wt) from CCHFV(YL16070)__KY354081.1__Gn
  source 1..972: mol_type = other RNA
gcagaaggaggaagcagtgactgcatttcaagaactcagctagttaaaacagaggttgcagaaattcatgaggacagttacggtgggcctggtgagaaaataacaatctgcaatggttccacaattgtagatcaaaggcttggtagtgaattgggctgctatacaatcaacagagtaaaatcctacaagctatgcgagaacagtgcctcagggaaaagctgtgaaatagatagcatcccagtcaaatgcaaacaagggttttgcctcaaaataacccaagaaggaagaggtcatgtaaaactgtccagagggacagaaattgttctagatgtctgtgattccagctgtgagctgatgatacctaagggcactggagacattttagtggattgctcaggagggcaacagcattttttacaaaacaatctgattgacttgggatgccccaatgtcccattactgggtaaaatggccatatatgtctgcaggatgtcaaaccacccaaaaactaccatggcatttctgttctggttcagctttggctatgtcattacatgtatagtatgcagggtactcttctacttgctgattgccatcggaacagtagggaaaaagctaaaacagtatagagagctgaaaccacaaacatgcattgtttgtgaatctgtccctgttaatgcaatagatgctgaaatgcatgagcttaattgcagttacaacatatgcccatactgtgcttctagactgtctacagacgggctcatcaggcacgtaactcagtgtcccaaacggagggagaaggtggaagagactgagctattcttgaacttggaaagaataccttggctggtgagaaagctccttcaagtatcagagtcaacaggaatggctctaaagagaagctgttggatgatcacactcctcattctactattggtttcgatgtcaccagtccaatctgcaccggtaggc

SEQ ID NO: 3996 - RNA, 972 nt, synthetic construct
  misc_feature 1..972: note = derived and/or modified CDS sequence (wt) from CCHFV(UCCR4448)__KY484042.1__Gn
  source 1..972: mol_type = other RNA
tccgaagaaaccagtgatgactgcatatcaagaactcaactattgaggacagagactgcagagatccacggcgacaactatggtggcccgggtgacaaaataaccatctgcaacggctcaactattgtagaccaaagactaggcagtgagctagggtgttacactatcaacagagtgaagtcattcaagctatgcgaaaatagtgccacagggaagagctgtgaaatagacagtgtcccagttaaatgcaggcagggttattgcctaagaatcactcaggaagggaggggccatgtaaaattatctaggggctcagaggttgtcttagatgcatgtgatacaagctgtgaaataatgatacctaagggcactggtgacatcttggttgactgttcaggtgggcagcaacattttctaaaggacaatttgatagatctaggatgccccaaaattccattattgggcaaaatggctatttacatttgcagaatgtcgaatcaccccaaaacaaccatggctttcctcttctggttcagctttggctacgtgataacttgtatactttgcaaggccatcttctacttgttaataattattggaacactagggaaaaggttcaagcagtatagagagttaaaaccccagacctgcaccatatgtgagacaactcctgtaaatgcaatagatgctgagatgcacgacctcaattgcagttacaacatttgtccctactgtgcatctagactaacctcagatgggcttgctaggcatgtaacacaatgccctaagcggaaggagaaagtggaagaaactgaactgtacttgaacttagaaagaattccttgggttgtaagaaagctgttgcaggtatcagagtccactggtgtggcattgaaaagaagcagctggctgattgtgctgcttgtgctgttcacgatttcattgtcaccagttcaatcagcacccattagt

SEQ ID NO: 3997 - RNA, 972 nt, synthetic construct
  misc_feature 1..972: note = derived and/or modified CDS sequence (wt) from CCHFV(SPU 45/88)__KJ682809.1__Gn
  source 1..972: mol_type = other RNA
tctgaagagtctagtgatgactgtttatcaaggactcagctattgaggacagagaatacggaaattcacagtgacaactatggtggtccaggtgacaagataactatctgcaacggttcaactattgtagatcagagactgggcagtgaactagggtgttacactatcaatagagtgaaatcatttaagctttgcgagaacagtgctacaggtaaatcttgtgaaatagatagcaccccagttagatgtaggcagggtttttgcttgaaaatcactcaggagggaaggggccacgtgaagctatcaagaggctcagaagttgtcttggacgcctgtgattcaagctgtgaaataatgataccaaagggcactggggacatcctagttgactgttcaggtgggcagcaacatttcttaaaagataacttggttgatctaggatgccccaacattccactattaggcaaaatggccatctacatttgtagaatgtcaaatcatcccaagacaactatgggttttcttttttggtttagctttggttatgtgataacctgtatactttgtaaggtaatcttctatctattaatagttgtagggacattagggaaaaagtttaaacagtacagagagttgaaacctcagacctgtaccatatgtgaaacgactcctgttaatgcaatagatgctgagatgcacgacctcaactgcagttacaatatatgtccttattgtgcatctaggttaacctcagatggtcttgccagacatgtaatgcaatgccccaaacggaaggaaaaaatagaagaaaccgaattatatttaaacttagaaagaatcccctggattgttaggaaattactgcaggtgtcagaatccaccggtgtagcactaaagaggagtagttggttggttgtactacttgtgctactcacagtttcattgtcaccagtacaatcagcacctatcggc

SEQ ID NO: 3998 - RNA, 1932 nt, synthetic construct
  misc_feature 1..1932: note = derived and/or modified CDS sequence (wt) from CCHFV(10200)__U39455.2__Gc
  source 1..1932: mol_type = other RNA
ttcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctagcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggc

SEQ ID NO: 3999 - RNA, 1932 nt, synthetic construct
  misc_feature 1..1932: note = derived and/or modified CDS sequence (wt) from CCHFV(IbAr10200)__AF467768.2__Gc
  source 1..1932: mol_type = other RNA
ttcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtgggagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctggcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatagaagaattgccgaactgttctctacaaaaacacacattggc

SEQ ID NO: 4000 - RNA, 1932 nt, synthetic construct
  misc_feature 1..1932: note = derived and/or modified CDS sequence (wt) from CCHFV(Turkey-Kelkit06)__GQ337054.1__Gc
  source 1..1932: mol_type = other RNA
ttcttggacagtatagttaaaggtatgaaaaatttgctaaactcaacaagcttggaaacaagcttatcaattgaggcaccatggggagcaataaatgtccaatcaacctttaaaccaactgtatcgactgcaaacatagcactcagttggagctcagtggtgcacagaggcaacaagatcttggtcacaggcaggtctgaatcaattatgaaactggaggaaaggacaggagtcagctgggatctaggcgtagaagatgcctctgaatccaaattacttaccgtttctatcatggatttgtcacaaatgtattctcctgtttttgagtacttgtcaggagacagacaggttgaagaatggcccaaagcaacttgtacaggtgattgcccggaaaggtgtggttgcacatcatcaacctgcttacataaagaatggtctcactcaagaaactggagatgtaatcccacttggtgctggggagtaggaaccggctgcacctgctgcggggtggatgtaaaagatctttttaccgatcacatgtttgtcaaatggaaagttgaatacataaaaactgaagctatagtatgtgttgcgctcaccagccaagaaagacagtgcagtctgattgaggcaggtactagattcaacttgggccctgtgactattaccctgtctgagccaagaaacattcagcagaagcttcctcctgagattatcacgttgcatcccaaaattgaagaaggcttctttgacttgatgcatgtacaaaaagtgttgtctgcaagtacagtgtgtaaactgcagagttgcacacatggtataccaggagatctacaagtttaccacattggcaacttgttgaaaggggatagagtaaacgggcatctaattcacaaaattgaatcacatttcaacacctcttggatgtcctgggatggttgtgacttagactactactgcaacatgggggattggccatcttgcacatacacaggagtgacccagcataaccatgctgcatttgtaaacttgcttaacattgaaactgattacacgaaaaccttccacttccactctaaaagagtcacagcacatggtgacacaccacaattggacttaaaagcaaggccgacctacggtgcaggtgggatcactgtgctggttgaggttgctgacatggagttgcataccaagaaagttgaaatatcaggcttgaaatttgcaagtctggcttgcacgggttgctatgcttgtagctctggcatctcctgtaaagttaggattcatgtagatgaaccagatgagctcacagtacatgtaaagagcagtgatccagatgtggttgcagctagcacaagtctcatggcgaggaagcttgaatttgggacagacagcacattcaaggccttttcagctatgcccaaaacctctctatgtttttacattgtggagagagaatactgcaagagctgcagtgaagatgatacacaaaaatgtgttgacacaagacttgagcagccacagagcatactaattgagcacaaaggaacgataattggaaagcagaatgatacttgcacagccaaggcaagctgttggctagagtcagtcaagagttttttttatggattgaagaatatgcttggcagtgtttttggtaatcttttcataggcattttgttattccttgccccttttgtcctgttggtgcttttctttatgtttgggtggaaaatcttgttttgctttaaatgttgcaggaggaccagaggcttatttaagtatagacacctcaaagacgatgaggaaacaggctacagaaggattattgaaagactgaacagcaaaaaagggaaaaacaggctgcttgatggtgatagactggctgataggaaaattgctgagctgttctccacaaaaacacacattggc

SEQ ID NO: 4001 - RNA, 1935 nt, synthetic construct
  misc_feature 1..1935: note = derived and/or modified CDS sequence (wt) from CCHFV(SR3)__AJ538199.1__Gc
  source 1..1935: mol_type = other RNA
ctatttctagatagtatagtcaaaggtatgaaaaatctgctaaactcaacaagtctagaaacaagcttatcaattgaggcaccgtggggagcaatcaatgttcagtcaacctacaaaccaactgtctcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagttatggacttgtctcagatgtactctcctgtcttcgagtacttatcaggtgacagacaagtggaagagtggcctaaagcaacctgcacaggtgactgcccagaaagatgtggctgcacatcatcaacctgcttacacaaagagtggccccactcaaggaattggagatgtaatcctacttggtgctggggtgtagggactggctgcacctgttgtggtttagatgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagaaccaaggaacattcaacaaaagctccctcctgaaataatcacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacctgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacaactagatctgaaggcaaggccaacctatggtgcaggtgagatcaccgtgctggtggaagttgctgacatggagttacacacaaagaagattgaaatatcaggcttaaaatttgcaggcctaacttgcacaggttgttatgcttgtagttctggcatctcttgtaaagttagaattcatgtagatgaaccagatgaacttacagtacatgttaaaagtgatgacccagatgtagttgcagctagctcaagtctcatggcgaggaagcttgaatttggaacagacagtacatttaaagctttctcagccatgcctaaaacctccctatgtttctacattgtggaaagggaatactgtaaaagctgcaataaagaagatacacaaaaatgtgttaacacgaaactcgaacaaccacagagcattttgatcgaacataagggaactataattggaaagcaaaacaatacttgcacggctaaagcgagttgctggttagagtcagttaagagtttcttttatggtctgaagaatatgctcggtggcatatttggcaatgtttttataggcattttcacatttcttaccccctttatcttgttaatacttttctttatgtttgggtggaggatcctgttttgcttcaagtgttgcagaaggaccagaggcctattcaagtacagacacctcaaagacgatgaagaaactggttacagaaagatcattgaaagactgaacaacaaaaaaggaaaaaacaggctgcttgatggtgaaagacttgctgacagaaagattgctgaactgttctccacaaaaacacacattggc

SEQ ID NO: 4002 - RNA, 1935 nt, synthetic construct
  misc_feature 1..1935: note = derived and/or modified CDS sequence (wt) from CCHFV(UCCR4413)__KY484038.1__Gc
  source 1..1935: mol_type = other RNA
ttcctgagtagtatagtcaagggtaagaagaatctgctaaactcagcaagtttagaaacaagcctgtcaattgaggcaccatggggagccataaatgctcagtccacctttaaacccaccatatcaactgcaaatatagcactcagctggagctcagtggagcatagaggcaataaagttttggtttcaggtagatcagagtctatcatgaaactcgaggagcgaacaggaatcagttggaacctaggggtagaggacgcatcagagtcaagaatgctaacggtctctgtcatggacttgtcacagatgtacttaccagtatttgaatatctgtctggtgacaggcaagtggaagagtggccaaaagcaacctgtacaggtgactgtccagaaagatgcggctgcacatcatcaacctgcttgcataaagaatggccgcactcaagaaactggagatgcaatcccacttggtgttggggggttggaacaggatgcacatgctgcggattagacgtgaaagacctgttcactgattatatgtttgttaagtggaaggttgagtatattaagactgaagccatagtttgtgttgagttaaccagccaagagagacagtgcagcttaattgaggccggcacaagattcaacttaggtcccgtgacaataacattatcagaaccaaggaacatccaacaaaagctcccttcagagatagtcacactgcatcccaaaatagaagaaggcttctttgacctcatgcatgtgcaaaaggtactatctgctagcacggtgtgcaagctgcagagctgcacgcacggagtggcgggagacctgcaggtctatcatgttggcaatttattaaaaggggacaaaataaatggacattcgattcacaagattgaaccacatctcaacacatcatggatgtcttgggatggctgtgatctagactattactgcaatatgggagattggccctcttgcacatacacaggggtgacacaacacaatcatgcagcatttgtcaacctactaaacattgaaactgattacaccaaaagcttccactttcactcaaaaagagtaacagcacatggagacactccccaactggacctgaaggcgcggcccatgtatggtgcaggcgaaataactgtcttggtggaggttgctgacatggaattgcactcaaagaacattgagatctcaggtctaaaatttgcaagcttgacctgctcaggctgttatgcctgcagctcaggtatttcatgcaaagtcagaatccatgtagacgagcccgatgagctagcagtacatgtaaagagtgatgatctggatgttgtggcagctagttcaagtcttatggcaagaaaaatagaattcggaacagatagcacatttaaagctttctcatctatgccaaaagaatctttatgcttctacattgttgaaagagacttctgtaaaagttgtgcagcagaagacacacaaaaatgtgtgaaagcaaaacttgaacagccacaaagcatacttattgaacacaaagggacaataattgggaaacaaaatgacacttgctcaaccaaaacaagctgttggttggagtcattcaaaagcttcttttatgggctaaaaaacatgctaagcggcgtttttggcagtgctattatgggcattctcttgttccttgccccctttatcttgttaatacttttcttcttttttggatggagaatcttattctgcctaagatgttgtagaaggaccagagggctgtttaagtacaagcatatcaaggatgatgaggaagcaggctacaaaaaaatcattgagaagcttaacaacaaaaaagggggaacaagtaaattgttagatggtgagagacttgcggacagaaagattgccgaacttttctcaacaaaagcacacatcggc

SEQ ID NO: 4003 - RNA, 1932 nt, synthetic construct
  misc_feature 1..1932: note = derived and/or modified CDS sequence (wt) from CCHFV(66019)__AB069669.1__Gc
  source 1..1932: mol_type = other RNA
ttctcagacagtatagtcaagggcatgaaaaacctgctaaattcaactagcttggaaacaagcttatcaattgaagcaccatggggagcaataaacgtccagtcaacctttaaacccaccgtttcaactgcaaacatagcacttagctggagttcagtagaacacagaggtaacaaaattttggtctcaggcagatcagaatcaattatgaagctagaagaaaggacaggaatcagctgggatctgggcgtagaagatgcctctgagtctaagttgcttactgtttctgtcatggatttgtcacagatgtattctcctgtctttgagtacttatcaggtgacagacaggtagaggagtggcccaaagcaacctgcacaggtaattgcccagataggtgtggctgcacatcatcaacctgcttacacaaggaatggccccattcaaggaattggagatgcaaccccacttggtgttggggagtcggcactggatgcacctgctgtggactagatgtgaaagatctttttacagattatatgtttgtcaagtggaaagttgaatacataaagaccgaggccatagtgtgcgttgagctcaatagccaagaaaggcagtgcagcttgattgaggcaggcacaagattcaacttgggtcctgtgaccatcacgttgtcagaaccaagaaacattcagcagaagcttccttctgaaataatcacattgcatcctagaattgaggaaggcttcttcgatctgatgcatgttcaaaaggtgctgtctgcaagtacagtatgcaagctacaaagctgcacacatggtgtgccaggagacttacagatctaccacattggcaacttgttaaaaggggatagggtaaatgggcatctgattcacaaaattgagccacacttcaacacttcttggatgtcctgggatggctgtgacctagattactactgtaacatgggggattggccctcttgcacatatactggagtgacccaacataaccatgctgcttttgtaaacttacttaacatcgaaactgattacacaaagaacttccattttcattctaagagagttactgcacatggagacacaccacagctggatttgaaagctagaccaacttacggtgcgggtgaaatcactgtactagtggaggttgctgacatggagttacacacaaaaaagattgcgatatcaggtctgaaatttgcaagtttgacttgcacaggttgctatgcttgtagctctggcatctcctgtaaagtcaggattcatgtggatgaaccagatgagcttacagtacatgtgaaaagtgaagatccggacattgttgcagccagctcaagcctcatggcaaggaagcttgaatttgggacagacagcacattcaaggccttctcagccatgcccaaaacctccttgtgcttctacattgtagagagagaatactgtgagagctgcagcaaagaagacacacagaaatgtgttaacacaaagcttgagcaaccacaaagcattttaattgagcacaaaggaacaataatcggaaagcaaaatgacacttgcacagccaaagcaagctgctggttagagtcagtaaagagttttttttatggattgaagaacatgcttagcggcatcttcggcaacgtttttataggcattttcttattccttgctccttttattctgttaatactcttctttatgtttgggtggagaatcctgttttgctttaagtgttgcagaaggaccagaggcttattcaagtacagatatctcaaggacgacgaagagtctggttacagaagaatcattgaaagattaaacaacaaaaaaggaaaaaacaagttacttgacggtgaaagactagctgacaggaggatcgctgagttgttctctaccaaaacacacattggt

SEQ ID NO: 4004 - RNA, 1932 nt, synthetic construct
  misc_feature 1..1932: note = derived and/or modified CDS sequence (wt) from CCHFV(7001)__AB069670.1__Gc
  source 1..1932: mol_type = other RNA
ttcctggataacatagccaagggaatgaaaagcctgttgaactccacgagcttagaaactagtctgtcaattgaagctccgtggggagcaatcaatgtccagtcaactttcaaaccaacagtttcagctgctaacatagcacttagctggagttcagttgaacacaggggcaacaaaattttagtttcaggtagatcagagtcaatcatgaaattagaagaaagaacaggagtcagctggaatctgggtgtagaagatgcttctgagtcaaagacgcttactgtttccgtcatggacctgtcacaaatgtactctcctgtttttgagtacttgtcaggtgacagacaagtggaggaatggccaaaggcaacttgcacaggtgactgtccagagagatgcggctgcacttcgtcaacctgcttacataaagagtggccacattcaagaaactggcgatgtaatcctacctggtgttggggggtggggactggctgcacttgctgtgggctggatgtaaaggatttttttactgactacatgctggtaaaatggaaagtggaatatataaagacagaagctatagtgtgtgtcgagctgactagtcaagagaggcagtgtagtttaattgaagcaggcacaagatttaacctaggccctgtaacaataaccctatcagagccaagaaatgtccagcagaggcttcctcccgaaattgtaacactgcatcctaaaatagaggaaggtttttttgatttgatgcatgtacaaaaaatactgtctgcaagcacagtttgcaagctacagagctgcacacacggtgtgccgggcgattttcaggtctaccatgtcggtaacctgctgaggggagacaaggttaatggacactcaattcacaagatagaaccacattttaatacttcatggatgtcatgggatggttgcgatctggactatttctgcaatatgggggactggccttcatgcacatacactggagtgacacagcataaccgtgctgcatttatcaacatgctcaacattgagactgactatacaaaaactttccactttcattcgaagagggtcacggcacatggagatactccccagctagacctaaaagcgagaccggcatatggtgctggcgaggtcactgttctagtggaggttgcagacttggagttgcacacaaagaaacttgaagtgtcaggtttgaaaattgcaagtttgacctgctctgggtgttatgcctgcagctctggcatctcctgcaaagttagaatccatgtaaatgaaccagatgaatttacagtacatgtaagaagtagcgacccagatgttgtagcagcaggatcaagtcttatggcaaggaaaatagagtttggggctgacagtacattcaaggccttttcatcaatgcccaaggactccttatgcttttacatagtagaaaaggattactgcagcagctgcaccgacgatgacacacaaaagtgtgtcaacacgaagcttgaccatccacagagcatactcattgagcacaaaggaacaataattggcaagcaaaatgacacttgttcgaccaagacaagctgctggctagaatcagttaagggttttttctatgggctaaaaaacatgctaagtggcatctttggaaatgtttttttaggcatcttcttattccttgctccttttgtgctactgatattttttttcttttttgggtggaggcttctgttttgtctcaaatgttgcagaagaactagaggactgttgaaatacaagcaccttaaggatgaagaggaggctggatacaaaaaaatcattgaaaggctaaatggcaaaaaaggtaaaagtcaattgtttgatggtgaaaggcttgcagacaggaagattgctgagcttttttctactaaaattcacataggt

SEQ ID NO: 4005 - RNA, 1932 nt, synthetic construct
  misc_feature 1..1932: note = derived and/or modified CDS sequence (wt) from CCHFV(75024)__AB069671.1__Gc
  source 1..1932: mol_type = other RNA
ttcctggacagtatagttagaggcatgaaaaatcagctaaactcaacaagtttagaaacaagcttatcgattgaggcaccatggggagcaataaatgttcagtcaacctacaaaccaactgtgtcaactgcaaacatagcacttagttggagctcagttgaacacagaggtaataagattttggtttcaggcagatcagaatcaattatgaagctggaagaaaggacaggaatcagctgggaccttggcgtagaagatgcctctgaatctaagctacttacagtctctgtcatggacttgtctcagatgtactctcctgtcttcgagtacttatcaggtgacagacaagtagaagagtggcccaaggcaacctgtacaggagactgcccagaaagatgtggctgcacaacatcaacctgcttgcataaagaatggccccattcaagaaactggagatgtaatcccacttggtgctggggggtggggactggctgcacttgttgtggattagatgtgaaagacctttttacagattatatgattgtcaagtggaaagttgaatacattaaaacagaggccatagtgtgtgtggaactcaccagtcaggaaaggcagtgtagcttgattgaggcaggcacaaggttcaatttaggttctgtgaccatcacattgtcagaaccgaggaacattcaacaaaagctccctcctgaaataatcacattgcatcctaggattgaagaaggtttttttgacctgatgcatgtacaaaaagtgttgtcagctagcacagtgtgtaagttgcagagttgcacacacggtgtgccaggtgatctacaggtctaccatgtcggaaatttattaaaaggagataaggtgaatggacacctaattcataaaattgagccacacttaaacacttcctggatgtcctgggatggctgtgatctagactactattgcaacatgggagactggccttcttgtacatataccggagttacccaacacaatcatgcttcatttgtaaacctgctcaacattgaaactgactatacaaaaagcttccactttcactctaaaagggttactgcacacggagacacaccacaattagatctgaaggcaagaccaacctacggcgcaggagaaatcactgtactggtagaagttgctgacatggagttcacaccgaagaagattgaaatatcaggcctaaaatttgcaagcctgacttgcacaggctgttatgcttgtagttctggcatttcctgcaaagttaggattcatgtggatgaaccagatgaacttacagtacatgttaagagtgatgatccagatgtagtagcagctagctcaagtctcatggcaaggaagcttgagtttggaacagacagtacatttaaagctttctcagctatgcccaaaacttccttatgtttctacattgtcgaaagggagtactgtaagagctgcagtaaagaagacacacaaaaatgtgttaacacaaaacttgagcaaccacagagcattttgatcgaacataagggaactataattggaaagcaaaacaatacctgcacagccaaagcaagttgctggttagagtcggttaaaagtttcttttatggtctaaagaacatgcttagtggcatttttggcaatctttttatgggcatcttcttatttcttgcccccttcatcttgttaatacttttctttatgtttggatggaggatcctgttttgctttaagtgttgcagaagaaccaggggcctgttcaagtatagacatctcaaagacgatgaagaaactggttacaggaggatcattgaaagactgaacaacaagaaggggaagaacaagctgcttgatggtgaaagacttgccgatagaagaattgccgaactattctccacaaaaacacacattggc

SEQ ID NO: 4006 - RNA, 1932 nt, synthetic construct
  misc_feature 1..1932: note = derived and/or modified CDS sequence (wt) from CCHFV(7803)__AB069672.1__Gc
  source 1..1932: mol_type = other RNA
ttcctggacagtatagttagaggcatgaaaaatccgctaaactcaacaagtttagaaacaagcttatcgattgaggcaccatggggagcaataaatgttcagtcaacctacaaaccaactgtgtcaactgcaaacatagcacttagttggagctcagttgaacacagaggtaataagattttggtttcaggcagatcagaatcaattatgaagctggaagaaaggacaggaatcagctgggaccttggcgtagaagatgcctctgaatctaagctacttacagtctctgtcatggacttgtctcagatgtactctcctgtcttcgagtacttatcaggtgacagacaagtagaagagtggcccaaggcaacctgtacaggagactgcccagaaagatgtggctgcacaacatcaacctgcttgcataaagaatggccccattcaagaaactggagatgtaatcccacttggtgctggggggtggggactggctgcacttgttgtggattagatgtgaaagacctttttacagattatatgattgtcaagtggaaagttgaatacattaaaaccagaggcatagtgtgtgtggaactcaccagtcaggaaaggcagtgtagcttgattgaggcgggcacaaggttcaatttaggttctgtgaccatcacattgtcagaaccgaggaacattcaacaaaagctccctcctgaaataatcacattgcatcctaggattgaagaaggtttttttgacctgatgcatgtacaaaaagtgttgtcagctagcacagtgtgtaagttgcagagttgcacacacggtgtgccaggtgatctacaggtctaccatgtcggaaatttattaaaaggagataaggtgaatggacacctaattcataaaattgagccacacttaaacacttcctggatgtcctgggatggctgtgacctagactactactgcaacatgggagactggccttcttgtacatataccggagttacccaacacaatcatgcttcgtttgtaaacctgctcaacattgaaactgactatacaaaaagcttccactttcactctaaaagggttactgcacacggagacacaccacaattagatctgaaggcaagaccaacctacggcgcaggagaaatcactgtactggtagaagttgctgacatggagttcacaccgaagaagattgaaatatcgggcctaaaatttgcaagcctgacttgcacaggctgttatgcttgtagttctggcatttcctgcaaagttaggattcatgtggatgaaccagatgaacttacagtacatgttaagagtgatgatccagatgtagtagcagctagctcaagtctcatggcaaggaagcttgagtttggaacagacagtacatttaaagctttctcagctatgcccaaaacttccttatgtttctacattgtcgaaagggagtactgtaagagctgcagtaaagaagacacacaaaaatgtgttaacacaaaacttgagcaaccacagagcattttgatcgaacataagggaactataattggaaagcaaaacaatacctgcacagccaaagcaagttgctggttagagtcggttaaaagtttcttttatggtctaaagaacatgcttagtggcatttttggcaatttttttatgggcatcttcttatttcttgcccccttcatcttgttaatacttttctttatgtttggatggaggatcctgttttgctttaagtgttgcagaagaaccaggggcctgttcaagtatagacatctcaaagacgatgaagaaactggttacaggaggatcattgaaagactgaacaataagaaggggaagaacaagctgcttgatggtgaaagacttgccgatagaagaattgccgaactattctccacaaaaacacacattggc

SEQ ID NO: 4007 - RNA, 1932 nt, synthetic construct
  misc_feature 1..1932: note = derived and/or modified CDS sequence (wt) from CCHFV(79121)__AB069673.1__Gc
  source 1..1932: mol_type = other RNA
ttcctggatagcacagccaagggaatgaaaagcctgttgaactccacgagcttagaaactagtctgtcaattgaagctccgtggggagcaatcaatgtccagtcaactttcaaaccaacagtttcagctgctaacatagcacttagctggagttcagttgaacacaggggcaacaaaattttagtttcaggtagatcagagtcaatcatgaaattagaagaaagaacaggagtcagctggaatctgggtgtagaagatgcttctgagtcaaagacgcttactgtttccgtcatggacctgtcacaaatgtactctcctgtttttgagtacttgtcaggtgacagacaagtggaggaatggccaaaggcaacttgcacaggtgactgtccagagagatgcggctgcacttcgtcaacctgcttacataaagagtggccacattcaagaaactggcgatgtaatcctacctggtgttggggggtggggactggctgcacttgctgtgggctggatgtaaaggatttttttactgactacatgctggtaaaatggaaagtggaatatataaagacagaagctatagtgtgtgtcgagctgactagtcaagagaggcagtgtagtttaattgaagcaggcacaagatttaacctaggccctgtaacaataaccctatcagagccaagaaatgtccagcagaggcttcctcccgaaattgtaacactgcatcctaaaatagaggaaggtttttttgatttgatgcatgtacaaaaaatactgtctgcaagcacagtttgcaagctacagagctgcacacacggtgtgccgggcgattttcagatctaccatgtcggtaacctgctgaggggagacaaggttaatggacactcaattcacaagatagaaccacattttaatacttcatggatgtcatgggatggttgcgatctggactatttctgcaatatgggggactggccttcatgcacatacactggagtgacacagcataaccgtgctgcatttatcaacatgctcaacattgagactgactatacaaaaactttccactttcattcgaagagggtcacggcacatggagatactccccagctagacctaaaagcgagaccggcatatggtgctggcgaggtcactgttctagtggaggttgcagacttggagttgcacacaaagaaccttgaagtgtcaggtttgaaaattgcaagtttgacctgctctgggtgttatgcctgcagctctggcatctcctgcaaagttagaatccatgtaaatgaaccagatgaatttacagtacatgtaagaagtagcgacccagatgttgtagcagcaggatcaagtcttatggcaaggaaaatagagtttggggctgacagtacattcaaggccttttcatcaatgcccaaggactccttatgcttttacatagtagaaaaggattactgcagcagctgcaccgacgatgacacacaaaagtgtgtcaacacgaagcttgaccatccacagagcatactcattgagcacaaaggaacaataattggcaagcaaaatgacacttgttcgaccaagacaagctgctggctagaatcagttaagggttttttctatgggctaaaaaacatgctaagtggcatctttggaaatgtttttttaggcatcttcttattccttgctccttttgtgctactgatattttttttcttttttgggtggaggcttctgttttgtctcaaatgttgcagaagaactagaggactgttgaaatacaagcaccttaaggatgaagaggaggctggatacaaaaaaatcattgaaaggctaaatggcaaaaaaggtaaaagtcaattgtttgatggtgaaaggcttgcagacaggaagattgctgagcttttttctactaaaattcacataggt

SEQ ID NO: 4008 - RNA, 1932 nt, synthetic construct
  misc_feature 1..1932: note = derived and/or modified CDS sequence (wt) from CCHFV(8402)__AB069674.1__Gc
  source 1..1932: mol_type = other RNA
ttttcagacagcattgtcaaaggcatgaagaacttgctaaattcaacaagcttagaaacaagcttatcaattgaggcaccatggggagcaataaatgtccaatcaaccttcaaacctactgtgtcagctgcgaatatagctcttagttggagctcagtggaacacaggggtaataagattttggtttcaggtagatcagagtcaatcatgaagctagaggaaaggacaggaatcagctgggatctaggggtagaagatgcttctgagtctaaattgcttactgtctctgttatggacttgtcacagatgtactctcctgtctttgagtacctatcaggtgacagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttatcaagtggaaagttgagtacattaaaacagaagctatagtgtgtgttgagcttactagccaagagagacaatgtaccttgattgaggcaggcacaagattcaacttaggtcctgtgaccatcacattgtcagagccaagaaacattcagcaaaagctccctccagagatagttacattgcaccccagaattgaagaaggtttctttgatttaatgcatgtacaaaaggtgctatcagcaagtacagtgtgtaagctacagagttgcacacatggtgtgccaggggacctacaggtctatcacataggaaacttgttaaaaggagacaaggtgaatgggcacctgattcacaaaattgaaccacacttcaacacttcctggatgtcttgggacggctgtgacctagactactactgtaatatgggggattggccatcttgcacatatactggagtaacccagcacaatcatgctgcatttgtaaacatgctcaacatcgaaactgattatacaaaaaacttccactttcactctaagagagttactgcacatggagacacaccacaattagatttgaaagctagaccaacttatggtgcaggtgaaatcactgtgctggtggaagttgctgacatggagttacacacaaagaaaattgagatatcaggtttgaagtttgcaagcttaacttgcacaggctgttatgcttgtagctctggtatctcctgtaaggttagaatccatgtagatgagccagatgagcttacagtacatgtgaagagtgaagacccagacatagttgctgctagctcaagtctcatggctagaaaacttgaatttgggacagatagtacattcaaagccttttcagccatgcccaaaacctccttatgcttttacattgtggagagagaatattgtaaaagctgcagcaaagaagatacacaaaaatgtgtcaacacaaagcttgagcaaccacagagcattttaatcgagcacaaaggaacgataattggtaagcagagcaacacctgcacagctaaagcaagctgttggctagagtcagtcaagagcttcttttatgggctaaagaacatgcttagtggcatttttggcaatgttttcataggggttttcttattctttgctccttttatccttttgatacttttctttatgtttggatggagaatcctgttctgctttaaatgttgcagaagaactagaggcctttttaagtacagacacctcaaggacgatgaagaaaccggttacaggaaaatcattgagagactgaacaacaaaaaagggaaaaacaaactgcttgatggtgaaagattagctgataggaagattgctgagctgttctccacaaagacacacattggc

SEQ ID NO: 4009 - RNA, 1932 nt, synthetic construct
  misc_feature 1..1932: note = derived and/or modified CDS sequence (wt) from CCHFV(88166)__AB069675.1__Gc
  source 1..1932: mol_type = other RNA
ttttcagacagcattgtcaaaggcatgaagaacttgctaaattcaacaagcttagaaacaagcttatcaattgaggcaccatggggagcaataaatgtccaatcaaccttcaaacctaccatgtcagctgcgaatatagctcttagttggagctcagtggaacacaggggtaataagattttggtttcaggtagatcagagtcaatcatgaagctagaggaaaggacaggaatcagctggaatctaggggtagaagatgcttctgagtctaaattgcttactgtctctgttatggacttgtcacagatgtactctcctgtctttgagtacctatcaggtgacagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttatcaagtggaaagttgagtacattaaaacagaagctatagtgtgtgttgagcttactagccaagagagacaatgtaccttgattgaggcaggcacaagattcaacttaggtcctgtgaccatcacattgtcagagccaagaaacattcagcaaaagctccctccagagatagttacattgcaccccagaattgaagaaggtttctttgatttaatgcatgtacaaaaggtgctatcagcaagtacagtgtgtaagctacagagttgcacacatggtgtgccaggggacctacaggtctatcacataggaaacttgttaaaaggagacaaggtgaatgggcacctgattcacaaaattgaaccacacttcaacacttcctggatgtcttgggacggctgtgacctagactactactgtaatatgggggattggccatcttgcacatatactggagtaacccagcacaatcatgctgcatttgtaaacatgctcaacatcgaaactgattatacaaaaaacttccactttcactctaagagagttactgcacatggagacacaccacaattagatttgaaagctagaccaacttatggtgcaggtgaaatcactgtgctggtggaagttgctgacatggagttacacacaaagaaaattgagatatcaggtttgaagtttgcaagcttaacttgcacaggctgttatgcttgtagctctggtatctcctgtaaggttagaatccatgtagatgagccagatgagcttacagtacatgtgaagagtgaagacccagacttagttgctgctagctcaagtctcatggctagaaaacttgaatttgggacagatagtacattcaaagccttttcagccatgcccaaaacctccttatgcttttacattgtggagagagaatattgtaaaagctgcagcaaagaagatacacaaaaatgtgtcaacacaaagcttgagcaaccacagagcattttaatcgagcacaaaggaacgataattggtaagcagaacaacacatgcacagctaaagcaagctgttggctagagtcagtcaagagcttcttttatgggctaaagaacatgcttagtggcatttttggcaatgttttcataggggttttcttattctttgctccttttatccttttgatacttttctttatgtttggatggagaatcctgttctgctttaaatgttgcagaagaactagaggcctttttaagtacagacacctcaaggacgatgaagaaaccggttacaggaaaatcattgagagactgaacaacaaaaaagggaaaaacaaactgcttgatggtgaaagattagctgataggaagattgctgagctgttctccacaaagacacacattggc

SEQ ID NO: 4010 - RNA, 1932 nt, synthetic construct
  misc_feature 1..1932: note = derived and/or modified CDS sequence (wt) from CCHFV(BA88166)__AF338470.1__Gc
  source 1..1932: mol_type = other RNA
tatttagacagcattgtcaaaggcatgaagaacttgctaaattcaacaagcttagaaacaagcttatcaattgaggcaccatggggagcaataaatgtccaatcaaccttcaaacctaccatgtcagctgcgaatatagctcttagttggagctcagtggaacacaggggtaataagattttggtttcaggtagatcagagtcaatcatgaagctagaggaaaggacaggaatcagctggaatctaggggtagaagatgcttctgagtctaaattgcttactgtctctgttatggacttgtcacagatgtactctcctgtctttgagtacctatcaggtgacagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttatcaagtggaaagttgagtacattaaaacagaagctatagtgtgtgttgagcttactagccaagagagacaatgtaccttgattgaggcaggcacaagattcaacttaggtcctgtgatcatcacattgtcagagccaagaaacattcagcaaaagctccctccagagatagttacattgcaccccagaattgaagaaggtttctttgatttaatgcatgtacaaaaggtgctatcagcaagtacagtgtgtaagctacagagttgcacacatggtgtgccaggggacctacaggtctatcacataggaaacttgttaaaaggagacaaggtgaatgggcacctgattcacaaaattgaaccacacttcaacacttcctggatgtcttgggacggctgtgacctagactactactgtaatatgggggattggccatcttgcacatatactggagtaacccagcacaatcatgctgcatttgtaaacatgctcaacatcgaaactgattatacaaaaaacttccactttcactctaagagagttactgcacatggagacacaccacaattagatttgaaagctagaccaacttatggtgcaggtgaaatcactgtgctggtggaagttgctgacatggagttacacacaaagaaaattgagatatcaggtttgaagtttgcaagcttaacttgcacaggctgttatgcttgtagctctggtatctcctgtaaggttagaatccatgtagatgagccagatgagcttacagtacatgtgaagagtgaagacccagacatagttgctgctagctcaagtctcatggctagaaaacttgaatttgggacagatagtacattcaaagccttttcagccatgcccaaaacctccttatgcttttacattgtggagagagaatattgtaaaagctgcagcaaagaagatacacaaaaatgtgtcaacacaaagcttgagcaaccacagagcattttaatcgagcacaaaggaacgataattggtaagcagaacaacacatgcacagctaaagcaagctgttggctagagtcagtcaagagcttcttttatgggctaaagaacatgcttagtggcatttttggcaatgttttcataggggttttcttattctttgctccttttatccttttgatacttttctttatgtttggatggagaatcctgttctgctttaaatgttgcagaagaactagaggcctttttaagtacagacacctcaaggacgatgaagaaaccggttacaggaaaatcattgagagactgaacaacaaaaaagggaaaaacaaactgcttgatggtgaaagattagctgataggaagattgctgagctgttctccacaaagacacacattggc

SEQ ID NO: 4011 - RNA, 1932 nt, synthetic construct
  misc_feature 1..1932: note = derived and/or modified CDS sequence (wt) from CCHFV(BA66019)__AF350448.1__Gc
  source 1..1932: mol_type = other RNA
ttctcagacagtatagtcaagggcatgaaaaacctgctaaattcaactagcttggaaacaagcttatcaattgaagcaccatggggagcaataaacgtccagtcaacctttaaacccaccgtttcaactgcaaacatagcacttagctggagttcagtagaacacagaggtaacaaaattttggtctcaggcagatcagaatcaattatgaagctagaagaaaggacaggaatcagctgggatctgggcgtagaagatgcctctgaatctaagttgcttactgtttctgtcatggatttgtcacagatgtattctcctgtctttgagtacttatcaggtgacagacaggtagaggagtggcccaaagcaacctgcacaggtgattgcccagataggtgtggctgcacatcatcaacctgtttacacaaagaatggccccattcaagaaattggagatgcaaccccacttggtgttggggagtcggcactggatgcacctgctgtggactagatgtgaaagatctttttacagattatatgtttgtcaagtggaaagttgaatacataaagaccgaggccatagtgtgcgttgagctcaatagccaagaaaggcagtgcagcttgattgaggcaggcacaagattcaacttgggtcctgtgaccatcacgttgtcagaaccaagaaacattcagcagaagcttcctcctgaaataatcacattgcatcctagaattgaggaaggtttcttcgatctgatgcatgttcaaaaggtgctgtctgcaagtacagtatgcaagctacaaagctgcacacatggtgtgccaggagacttacagatctaccacattggcaacttgttaaaaggggatagggtaaatgggcatctgattcacaaaattgagccacacttcaacacttcttggatgtcctgggatggctgtgacctagattactactgtaacatgggggattggccctcttgcacatatactggagtgacccaacataaccatgctgcttttgtaaacttacttaacatcgaaactgattacacaaagaacttccattttcattctaaaagggttactgcccatggagacaccccacaactggatcttaaagctagaccaacttacggtgcgggtgaaatcactgttctggtggaggttgctgacatggagttacacacaaaaaagattgcgatatcaggtctgaaatttgcaagtttgacttgcacaggttgctatgcttgtagctctggcatctcctgtaaagtcaggattcatgtggatgaaccagatgagcttacagtacatgtgaaaagtgaagatccggacattgttgcagccagctcaagcctcatggcaaggaagcttgaatttgggacagacagcacattcaaggccttctcagccatgcccaaaacctccttgtgcttctacattgtagagagagaatactgtgagagctgcagcaaagaagacacacagaaatgtgttaacacaaagcttgagcaaccacaaagcattttaattgagcacaaaggaacgataatcggaaagcaaaatgacacttgcacagccaaagcaagctgctggttagagtcagtaaagagttttttttatggattgaagaacatgcttagcggcatcttcggcaacgtttttataggcattttcttattccttgctccttttattctgttaatactcttctttatgtttgggtggagaatcctgttttgctttaagtgttgcagaaggaccagaggcttattcaagtacagatatctcaaggacgacgaagagtctggttacagaagaatcattgaaagattaaacaacaaaaaaggaaaaaacaagttacttgacggtgaaagactagctgacaggaggatcgctgagttgttctctaccaaaacacacattggt

SEQ ID NO: 4012 - RNA, 1932 nt, synthetic construct
  misc_feature 1..1932: note = derived and/or modified CDS sequence (wt) from CCHFV(BA8402)__AF350449.1__Gc
  source 1..1932: mol_type = other RNA
ttttcagacagcattgtcaaaggcatgaagaacttgctaaattcaacaagcttagaaacaagcttatcaattgaggcaccatggggagcaataaatgtccaatcaaccttcaaacctactgtgtcagctgcgaatatagctcttagttggagctcagtggaacacaggggtaataagattttggtttcaggtagatcagaatcaatcatgaagctagaagaaaggacaggaatcagctgggatctaggggtagaagatgcttctgaatctaaattgcttactgtctctgttatggacttgtcacagatgtactctcctgtctttgagtacctatcaggtgacagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttatcaagtggaaagttgagtacattaaaacagaagctatagtgtgtgttgagcttactagccaagagagacaatgtaccttgattgaggcaggcacaagattcaacttaggtcctgtgaccatcacattgtcagagccaagaaacattcagcaaaagctccctccagagatagttacattgcaccccagaattgaagaaggtttctttgatttaatgcatgtacaaaaggtgctatcagcaagtacagtgtgtaagctacagagttgcacacatggtgtgccaggggacctacaggtctatcacataggaaacttgttaaaaggagacaaggtgaatgggcacctgattcacaaaattgaaccacacttcaacacttcctggatgtcttgggacggctgtgacctacactactactgtaatatgggggattggccatcttgcacatatactggagtcacccagcacaatcatgctgcatttgtaaacatgctcaacatcgaaactgattatacaaaaaacttccactttcactctaagagagttactgcacatggagacacaccacaattagatttgaaagctagaccaacttatggtgcaggtgaaatcactgtgctggtggaagttgctgacatggagttacacacaaagaaaattgagatatcaggtttgaagtttgcaagcttaacttgcacaggctgttatgcttgtagctctggtatctcctgtaaggttagaatccatgtagatgagccagatgagcttacagtacatgtgaagagtgaagaccccgacatagttgctgctagctcaagtctcatggctaggaagcttgaatttgggacagatagtacattcaaagccttttcagccatgcccaaaacctccttatgcttctacattgtggagagagaatattgtgaaagctgcagcaaagaagatacacaaaaatgtgttaacacaaagcttgagcaaccacagagcattttaatcgagcacaaaggcacgataattggtaagcagagcaacacctgcacagctaaagcaagctgttggctagagtcagtcaagagcttcttttatgggctaaagaacatgcttagtggcatttttggcaatgttttcataggggttttcttattctttgctccttttatccttttgatacttttctttatgtttggatggagaatcctgttctgctttaaatgttgcagaagaactagaggcctttttaagtacagacacctcaaggacgatgaagaaaccggttacaggaaaatcattgagagactgaacaacaaaaaagggaaaaacaaactgcttgatggtgaaagattagctgataggaagattgctgagctgttctccacaaagacacacattggc

SEQ ID NO: 4013 - RNA, 1932 nt, synthetic construct
  misc_feature 1..1932: note = derived and/or modified CDS sequence (wt) from CCHFV(Matin)__AF467769.2__Gc
  source 1..1932: mol_type = other RNA
tttttagacagtattattaagggtatgaagaacttgctaaattcaacaagcttagaaacaagcttatcaattgaggcaccatggggagcaataaatgtccaatcaactttcaaacctactatgtcagctgcgaacatagcgctaagttggagctcagtggaacacagaggtaataagattttggtttcaggcagatcagagtcgatcatgaagctagaggaaaggacaggaatcagctgggatctaggagtagaagatgcctctgagtctaaattgcttactgtatctgttatggacttatcacagatgtattctcctgtctttgagtacttatcaggtgatagacaagtggaggaatggcccaaggcaacctgcacaggcgattgtccagaaagatgtggctgcacatcatcaacctgcctacacaaagaatggccccattcaagaaactggagatgcaatcctacttggtgttggggagtcggcactggatgtacctgctgtgggctagacgtaaaagacctttttactgattacatgtttgtcaagtggaaagttgaatacattaaaacggaagttatagtgtgtgttgagcttactagccaagaaagacaatgtagcttgattgaggcaggcacaagattcaacttaggtcctgtgaccattacattgtcagagccaagaaacattcagcaaaagctccctccagagatagtcacattgcatcccagaattgaagaaggtttctttgatttaatgcatgtacaaaaagtgctatcagcaagtacagtgtgcaagctacagagttgcacacatggtgtgccaggggacctacaggtctaccacataggaaacttgttaaaaggagataaggtgaacgggcacttgattcacaaaattgaaccacacttcaacacttcctggatgtcttgggacggctgtgacctagactactactgtaatatgggggattggccatcttgctcatatactggagtaacccaacacaatcatgctgcatttgtaaacatgctcagcatcgaaactgattatacaaaaaacttccactttcactctaagagagttactgcacatggagacacaccacaattagatctgaaagctaggccaacttacggtgcaggtgaaatcactgtgctggtagaggttgctgacatggaattacatacaaagaaaattgagatatcaggtttgaagtttgcaagcttaacttgcacaggatgttatgcttgtagctctggtatctcctgtaaggttagaatccatgtagatgaaccagatgagcttacagtacatgtgaagagtgaagacccagacatagttgctgctagctcaagtctcatggctagaaagcttgaatttgggacagatagtacattcaaagccttttcagccatgcccaaaacctccttatgcttttacattgtggagagagaatattgtaaaagttgcagtaaagaagacacacaaaaatgtgtcaacacaaagcttgagcaaccacagagcatcttaatcgagcataaagggacgataattggaaagcaaaacgacacctgtacagccaaagcaagctgctggctggagtcagtcaaaagttttttttatggactaaagaacatgcttagtggcatttttggcaatgttttcatagggattttcttattccttgctccttttgcccttttaatacttttctttatgtttggatggagaatcctgttctgctttaaatgttgcagaagaactagaggcctatttaaatacagacacctcaaggacgacgaagaaaccggttacaggaaaatcattgagaggctgaacaacaaaaaaggtaaaaacaaactgctcgacggtgaaagactagctgacaggaagatcgctgagctgttctccacaaaaacacacgttggc

SEQ ID NO: 4014 - RNA, 1932 nt, synthetic construct
  misc_feature 1..1932: note = derived and/or modified CDS sequence (wt) from CCHFV(Baghdad 12)__AJ538197.2__Gc
  source 1..1932: mol_type = other RNA
ttcctggatagtatagtcaaaggcacgaaaaatctgctaaactcaacaagtttagaaacaagcttatcgattgaggcaccatggggagcaataaatgttcagtcaacctataaaccaactgtgtcaactgcaaacatagcacttagttggagttcagttgaacacagaggtaacaagattttggtttcaggcagatcagaatcaattatgaagctagaagagagaacaggaatcagttgggatcttggcgtagaagatgcctctgaatctaagctacttacagtctctgtcatggacttgtctcagatgtactctcctgtctttgagtacttatcaggtgacagacaagtagaagaatggcccaaggcaacctgtacaggtgactgcccagaaagatgtggctgcacaacatcaacctgcttgcataaagaatggccccattcaagaaactggagatgtaatcccacttggtgctggggagtgggaactggctgcacttgttgcggattagatgtgaaggacctttttacagattatatgttcgtcaaatggaaagttgaatacattaaaacagatgccatagtgtgtgtggaactcactagtcaagaaaggcaatgcagcttgattgaggcaggtacaaggtttaacttaggttctgtgaccatcacattgtcagaaccgaggaacattcagcaaaagctccctcctgaaataatcacattacatcctaggattgaagaaggtttttttgacctgatgcatgtacaaaaagtgttgtcagctagcacagtgtgtaagttgcagagttgcacacacggtgtgccaggtgatctacaggtctaccacatcggaaatttattaaaaggggataaagtgaatggacacctaattcataaaattgagccacattttaacacttcttggatgtcctgggatggctgtgacttagactactattgcaatatgggagactggccttcttgcacatataccggagttacccaacacaatcatgcttcatttgtaaacctgctcaacattgaaactgattacacaaaaagcttccactttcactctaaaagggttactgcacatggagatacaccacagttagatctgaaggtaagaccaacctacggcgcaggagaaatcactgtactggtagaagttgctgacatggagttgcacacgaagaagattgaaatatcaggcctaaaatttgcaagcctgacttgcacaggctgttatgcttgtagctctggcatttcctgcaaagttaggatacatgtggatgaaccggatgaactcacagtacacgtcaaaagtgatgatccagatgtagtagcagctagctcaagtctcatggcaaggaagcttgagtttggaacagacagcacatttaaagctttctccgccatgccaaaaacttccttatgtttctacattgtcgaaagggagtactgtaaaagctgcagtaaagaagatacacaaaaatgtgttaacacaaaacttgagcaaccacagagcattttgattgaacataagggaactataatcggaaagcaaaacaatacctgcacagccaaaacaagttgctggttagagtcagttaaaagtttcttttatggtctaaagaatatgcttagtggcatttttggcaattttttcatgggcatcttcttatttcttgccccctttatcttgttaatacttttctttatgtttggatggaggatcctgttttgctttaagtgttgcagaagaaccaggggcctgtttaagtacagacatctcaaagatgatgaagaaactggttatagaaggatcattgaaagactgaacaacaagaaagggaagaacaagctgcttgatggtgaaagacttgccgatagaaggattgccgaactattctccacaaaaacacatattggc

SEQ ID NO: 4015 - RNA, 1932 nt, synthetic construct
  misc_feature 1..1932: note = derived and/or modified CDS sequence (wt) from CCHFV(VLG/TI29414)__AY179961.1__Gc
  source 1..1932: mol_type = other RNA
ttcttagacagtatagttaaaggcatgaagaatttactaaactcaacaaacttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctgggaagtaggaactggctgcacctgctgcgggtggaatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgctgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggaatgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtgattgcagctagcacaagtctcatggcgaggaagcttgaatttgggacagacagtacattcaaggccttttcagctatgcccaaaacctctttatgtttttacattgcggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacgaaaacacacattggt

SEQ ID NO: 4016 - RNA, 1932 nt, synthetic construct
  misc_feature 1..1932: note = derived and/or modified CDS sequence (wt) from CCHFV(TADJ/HU8966)__AY179962.1__Gc
  source 1..1932: mol_type = other RNA
ttcctggatagtatagtcaaaggcatgaaaaatccgctaaactccacaagtttagaaacaagcttgtcgattgaggcaccatggggggcaataaatgttcagtcaacttacaagccaactgtttcaactgcaaacatagcacttagttggagttcaattgaacacagaggtaataatattttggtttcaggcagatcagaatcaattatgaagctggaagaaagaacaggaattagtggggatcttggcgttgaagatgcctctgaatccaagctacttacagtctctgttatggacttgtctcagatgtactcccctgtcttcgagtacttatcaggtgacagacaagtagaagagtggcccaaggcaacctgtacaggtgactgcccagaaagatgtggctgcacatcatcaacctgcttacataaagaatggccccattcacgaaactggagatgcaatcccacttggtgctggggggtggggactggctgcacctgttgtggattagatgtgaaagacctatttatagattatatgttcgtcaagtggaaagttgattacattaaaacagaagccatagtgtgtgtagaactcaccagtcaggaaaggcagtgtagcttggttgaggcgggcacaaggttcaatttaggtcctgtgaccatcacattgtcagaaccgaggaacatacaacaaaagctccctcctgaaataatcacattgcatcctaggattgaagaaggtttttttgatctaatgcatgtgcaaaaagtgctgtcagcaagcacagtgtgtaaattgcagagttgcacacatggtgtgccaggagatctacaggtctaccacatcggaaacttattaaaaggagataaagagaacggacacctaattcataaaattgagccgcacttcaatacttcctggatgtcctgggatggctgtgacctagactactactgcaacatgggagactggccttcttgcacatataccggagttacccagcacaatcatgcttcatttgtaaacctgctcaacattgaaactgactatacaaaaagcttccactttcactctaaaagggttactgcacacggagacacaccacaattggatctgaaggcaagaccaacttacggcgcaggagaaatcactgtactggtagaagttgctgatatggagttacacacgaagaagattgaaataacaggcctcaaatttgcaagcctgacttgcacaggttgttatgcttgtagttcaggcatttcctgcaaagttaggattcatgtggacgagccagatgaacttacagtacatgttaaaagtgatgatccagatgtagttgcagctagctcaagtctcatggcaaggaagcttgagttcgggacagacagtacattcaaagctttctcagccatgcctaaaacttccttatgcttctacattgtcgaaagggagtaccgtaagagctgtagtaaagaggacacacagaaatgtgttaacacaaaacttgagcaaccacagagcattttgatcgaacacaagggaactataatcggaaagcaaaataatacttgcacagccaaagcaagttgctggttagagtcagtcaaaagtttcttttatggtctaaagaacatgcttagtggcatttttggcaatgtttttgtgggcattttcttgtttcttgccccttttatcttgttaatacttttctttatgtttggatggaggatcctgtcttgctttaagtgttgcagaagaaccaggggcctgcttaagcatagacatctcaaagacgatgaagaaactggttacagaaggatcattgaaagactgaacaacaagaaggggaaaaacaagctgcttgatggtgaaagacttgccgatagacggattgccgaactattctccacaaaaacacacattggc

SEQ ID NO: 4017 - RNA, 1932 nt, synthetic construct
  misc_feature 1..1932: note = derived and/or modified CDS sequence (wt) from CCHFV(Hodzha)__AY223476.1__Gc
  source 1..1932: mol_type = other RNA
ttcctggatagtatagttaaaggcacgaaaaatctgttaaactccacaagtttagaaacaagcttgtcgattgaggcaccatggggggcaataaatgttcagtcaacctacaaaccaactgtatcaactgcaaacatagcacttagttggagttcagttgaacacagaggtaataagattttggtttcaggcagatcagaatcaattatgaagctggaagaaagaacaggaatcagctgggatcttggcgttgaagatgcctctgaatctaagctacttactgtctctgtcatggacttgtctcagatgtactcccctgtcttcgagtacttatcgggtgacagacaagtagaagagtggcccaaagcaacctgcacaggtgactgcccagaaagatgtggctgcacatcatcaacctgcttacataaagaatggccccattcacgaaactggagatgcaatcccacttggtgctggggggtggggactggctgcacctgttgtggattagatgtgaaagacctatttacagattatatgttcgtcaagtggaaagttgattacattaaaacagaggccatagtgtgtgtagaactcaccagtcaggaaaggcagtgtagcttggttgaggcgggcacaaggttcaatttaggtcctgtaaccatcacattgtcagaaccgaggaacatacaacaaaagctccctcctgaaataatcacattgcatcctaggattgaagaaggtttttttgacctgatgcatgtacaaaaagtgctgtcagcaagcacagtgtgtaaattgcagagttgcacacatggtgtgccaggagatctacaggtctaccacatcggaaatttattaaaaggggataaagtgaacggacacctaattcataaaattgagccgcacttcaatacttcctggatgtcctgggatggctgtgacctagactactactgcaacatgggagactggccttcttgcacatataccggagttacccaacacaatcatgcttcatttgtaaacctgctcaacattgaaactgactatacaaaaagcttccactttcactctaaaagggttactgcacatggagacacaccacaattggatctgaaggcaagaccaacctacggcgcaggagaaatcactgtactggtagaagttgctgatatggagttacacacaaagaagatcgaaataacaggccttaaatttgcaagcctgacttgcacaggttgttatgcttgtagttcaggcatctcctgcaaagttaggattcacgtggatgaaccagatgagctaacagtacatgttaaaagtgatgacccagatgtagttgcagccagctcaagtctcatggcaaggaaacttgagtttggaacagacagtacattcaaagctttctcagccatgcctaaaacttccttatgcttctacattgtcgaaagggagtactgtaagagctgcagtaaagaagacacacagaaatgtgttaacacaaaacttgagcaaccacagagcattttgatcgaacgcaagggaactataatcggaaagcaaaacaatacttgcacagccaaggcaagttgctggttagagtcagttaaaagtttcttttatggtctaaagaacatgcttagtggcatttttggcaatgtttttgtaggcattttcttatttcttgccccctttatcttgttaatacttttcttcatgtttggatggaggatcctgttttgcttcaagtgttgcagaagaaccaggggcctgtttaagtataaacatctcaaagacgatgaagaaactggttacagaaggatcattgaaagactgaacaacaagaaggggaaaaacaagctgcttgacggtgaaagacttgccgatagaaggattgccgaactattctccacaaaaacacacattggc

SEQ ID NO: 4018 - RNA, 1932 nt, synthetic construct
  misc_feature 1..1932: note = derived and/or modified CDS sequence (wt) from CCHFV(Kosovo/9553/2001)__AY675511.1__Gc
  source 1..1932: mol_type = other RNA
ttcttagacagtatagtcaaaggtatgaaaaatttgctaaactcaacaagcttggaaacaagcttatcaattgaggcaccatggggagcaataaatgtccagtcaacctttaaaccaacagtatcgactgcgaacatagcactcagttggagctcagtggagcacagaggcaacaagatcttagtcacaggcaggtctgaatcaattatgaaactagaggaaaggacaggagtcagctgggatctaggggtagaagatgcctctgaatccaaattacttaccgtctctatcatggatttgtcacagatgtattccccagtttttgagtacttgtctggagacagacaggttgaagaatggcccaaagcaacttgtacaggtgactgcccagaaaggtgtggctgcacatcatcaacctgcttgcataaagaatggcctcattcaagaaactggagatgtaatcccacttggtgctggggagtgggaaccggctgcacctgctgcggggtggatgtaaaagacctttttacagatcacatgtttgtcaaatggaaggttgaatatataaaaactgaagccatagtgtgtgttgagctcaccagccaagaaagacagtgcagtctgattgaggcaggtactagattcaacttgggccctgtgactattaccctgtctgagccaagaaacattcagcagaagcttccccctgagatcattacgttgcatcccaaaattgaggaaggcttctttgacttgatgcatgtacaaaaagtgttgtccgcaagtacagtgtgtaaactgcagagttgcacacatggtataccaggagatctacaagtttaccacattggcaacttgttgaaaggggatagagtaaacgggcatctaattcacaaaattgaaccacatttcaacacctcttggatgtcctgggatggttgtgacttagactactactgcaacatgggggactggccttcttgtacatacacaggagtgacccagcataatcatgctgcatttgtaaacttgcttaacattgaaactgattacacgaaaaccttccacttccactctaaaagagtcacagcacatggtgacacaccacaattggacttaaaagcaaggccgacctacggtgcaggagagatcactgtgctggttgaggttgctgacatggagttgcataccaagaaagttgagatatcgggcttgaaatttgcaagtctggcttgcacaggttgctatgcctgtagctctggcatctcctgtaaagtcaggattcatgtagatgaaccagatgagctcacagtgcatgtaaagagcagtgacccagatgttgttgcagctagcacaagcctcatggcaaggaagcttgaatttgggacagacagcacattcaaggccttttcagctatgcccaaaacctctttatgtttttacattgtggagaaagaatactgcaagagctgcagtgaagatgatacaaaaaaatgtgttgacacaaaacttgagcagccacagagcatactaattgagcacagagggacgataattggaaagccgaatgatacttgcccagccaagacaagctgttggctagagtccgtcaagagctttttttatggattgaagaatatgcttggcagtgtctttggtaattttttcataggcattttgttattccttgccccttttttcctgtggatgctttcctttatgtttggatggaaaatcttgttctgctttaaatgttgcaggaggaccagaggcctgtttaagtatagacacctcaaagacgatgaggaaacaggctacagaaggattattgaaaggctgaacaacaaaaaagggaaaaatagactgcttgatggtgaaaggttggctgataggaaaattgccgagctgttttctacaaaaacacacattggc

SEQ ID NO: 4019 - RNA, 1932 nt, synthetic construct
  misc_feature 1..1932: note = derived and/or modified CDS sequence (wt) from CCHFV(SPU41/84)__AY900142.1__Gc
  source 1..1932: mol_type = other RNA
ttcttagatagtatagttaagggcatgaaaaatttgctaaactcaacaagtttagagacaagtttatcaattgaggcaccatggggagcaataaatgttcagtcaacctacaaaccaactgtatcaactgcaaacatagcgcttagttggagctcagtggaacacagaggcaataagatactggtttcaggcagatcagaatcaattatgaagctggaagaaaggacaggaataagctgggatctcggtgtggaagacgcctctgagtctaaactgcttacagtctctgtcatggacttgtctcagatgtactcacctgtcttcgagtacttatcaggagacagacaggtggaggagtggcccaaagcaacttgtacgggtgactgcccagaaagatgtggctgcacatcatcaacctgcttgcacaaagaatggccccactcaagaaattggagatgtaatcccacttggtgctggggtgtaggaactggctgcacctgttgtggattagacgtgaaagacctctttacagattatatgtttgtcaagtggaaagttgaatacattaagacagaagcaatagtgtgtgtagaacttactagtcaggaaagacagtgtagcttgattgaagcgggcacaaggttcaacttgggtcctgtgaccatcacattgtcagaaccaagaaacatccagcaaaagctcccacctgaaataatcacactgcatcccaggattgaggagggtttttttgacctgatgcatgtacaaaaagtgttgtcggcaagcacagtgtgtaagttgcagagttgcacacatggtgtgccaggagatctacaggtctaccacatcggaaatttactaaaaggggataaggtaaatgggcacctagttcataaaattgagccacacttcaatacttcttggatgtcctgggatggttgtgatctagactattattgcaacatgggagattggccttcttgcacatacacaggagttacccagcacaatcatgcctcatttgtaaacatgctcaacattgaaactgattacacaaaaaacttccactttcactctaaaagggtcactgcacacggagacacaccacaactagatcttaaagcaagaccaacctatggtgcaggtgagatcactgtattggtggaggttgctgacatggagttacacacaaagaagattgaaatatcaggcttaaaatttactagcttgacttgtacaggttgttatgcttgtagttctggcatctcatgcaaagttagaattcatgtggatgaaccagatgagcttacagtgcatgttaaaagtgaagatccagatgttgttgcagctagctcaagtctcatggcaagaaagcttgaatttggaacagacagtacatttaaagctttttcagccatgcctaaaacttctctatgtttctacattgtggaaagagaatactgtaagagctgcagtgaagaagacacacaaaaatgtgttaacacaaaacttgagcagccacagagcattttgatcgaacgtaagggaactataatcgggaagcaaaacaacacttgcaaggctaaggcgggttgctggttagagtcagttaagagttttttttacggcctaaagaacatgctcagtggcatttttggcaatgtatttataggcattttcttattccttgcccccttcatcctgttaatactattctttatgtttgggtggaggatcttgttttgttttaagtgttgtagaagaaccagaggcctgttcaagtacagacacctgaaagacgatgaagaaactggttatagaaagatcattgaaagactaaacaacaaaaaagggaaaaataaactgcttgatggtgaaagacttgctgatagaagaattgccgaactgttctctacaaaaacacacattggc

SEQ ID NO: 4020 - RNA, 1932 nt, synthetic construct
  misc_feature 1..1932: note = derived and/or modified CDS sequence (wt) from CCHFV(UG3010)__AY900143.1__Gc
  source 1..1932: mol_type = other RNA
tacctagacagcatagccaaggggatgaaaagtctgctaaattctacgaatttagagacaagcctgtcgattgaggccccgtggggagcaatcaatgttcagtcaacttttaaaccaacagtttcagctgccaatatagcacttagctggagttcagttgaacacaggggcaacaaaatcctagtttcgggcaggtcagagtcaattatgaagctggaagaaaggaccggtatcagctggagcctaggtgtagaggatgcttctgagtcaaagacgctgactgtttctgtcatggacctatcccaaatgtattctcccgtctttgagtatctgtcaggtgatagacaggtagaagagtggccaaaagccacctgcacaggcgactgccaagagagatgtggctgcacttcttcaacctgcttgcataaagaatggccacactcgagaaactggcgatgcaaccccacttggtgttggggagtggggactggctgcacctgctgtggattggatgtgagagaccttttcacggactacatgatggttaagtggaaagtggaatatgtaaaaacagaagctataatgtgtgttgagctaaccagtcaggagaggcaatgtagtttgattgaagcaggtacaagatttaacctaggccctgtgacaataaccctgtcagagccaagaaacatccagcaaaggctcccttccgaaatcgttacactgcaccctaagatagaagaagggttctttgacttgatgcatgtgcaaaaggtactatctgcaagtacagtctgcaaactacagagctgcacacacggtgtccctggcgatctacaggtctaccatgttggcaacctactgaaaggagataaggtcaatgggcactcaatccacaagatagagtcccatttcaacacttcatggatgtcatgggatggatgtgatctagactacttctgcaacatgggtgactggccctcatgtacatacactggagtgacacagcacaaccgtgcggcattcatcaatatgctcaatattgagactgattatacaaagactttccacttccattccaagagagtaacggcacatggtgacacccctcaactggatctgaaggcaaggcctacatatggtgcaggcgaagtcactgttctagtagaggttgcagatctggagctacacaccaagaaaattgaagtgtcaggactgaagtttgcaagtctgacctgctccggttgttacgcctgcagctccggtatctcctgcaaagttagaattcatgtgaatgaaccagatgaatttactgtacatgtgaaaagcagtgatccagatgttgtggcagcaggatcaagtttgatggcaaggaaaatagagtttggggctgacagcaccttcaaagctttctcatcaatgcctaaaaactctttgtgcttctatatagtggaaagagactactgcagcagctgcaccaatgatgacactcagaagtgtgttgacacaaagctcgaacatccacaaagcatattaattgagcataagggaacaataattggcaaacaaaacgacacctgttcgaccaaaacaagctgttggctagaatcagtcaagagttttttttatggactaaaaaacatgctgggtggcatcttcggtaatgtcttcttaggcatcttcctgttccttgctccttttgcactgctaatattcttcttcttcttcgggtggaggcttctgttctgtctgaagtgttgcagaagaaccagggggctgctaaagtataaacaacttaaggacgaagaagaagccgggtacaagaaaatcatcgagaggctaaatgacaaaaaaggcaaaagtcgactgtttgacggagagaggcttgcagataggaagattgcagaactcttttcaaccaaaactcatataggg

SEQ ID NO: 4021 - RNA, 1932 nt, synthetic construct
  misc_feature 1..1932: note = derived and/or modified CDS sequence (wt) from CCHFV(Hy13)__AY900145.1__Gc
  source 1..1932: mol_type = other RNA
ttttcagacagtattgtcaaaggcatgaagaacttgctaaattcaacaagcttagaaacaagcttatcaattgaggcaccatggggagctataaatgtccaatcaaccttcaaacctactgtgtccgctgcgaacatagctcttagttggagctcagtggaacacaggggtaataagattttggtttcaggtagatcagagtcaattatgaagctagaggaaaggacaggaatcagctgggatctaggggtagaagatgcctctgagtctaaattgcttactgtctctattatggacttgtcacagatgtattctcctgtctttgagtacctatcaggtgatagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagatcacatgtttgtcaagtggaaagttgagtacattaaaacagaagctatagtgtgtgttgagcttactagccaagagagacaatgtagcttgattgaggcaggcacaagattcaacttaggtcctgtgaccatcacattgtcagagccaagaaacattcagcaaaagctccctccagagatagttacattgcatcccagaattgaagaaggtttctttgatttaatgcatgtaaaaaaagtgctatcagcaagtacagtatgtaagctacagagttgcacacatggtgtgccaggggacctacaggtctaccacataggaaacttgttaaaaggagacaaggtgaatgggcacctgattcacaaaattgaaccacacttcaacacttcctggatgtcttgggacggctgtgacctagactactactgtaatatgggagactggccatcttgctcatatactggagtaacccagcacaatcatgctgcatttgtaaacatgctcaacatcgaaactgattatacaaaaatcttccactttcactctaagagagttactgcacatggagacacaccacaattagatttgaaagctagaccaacttatggtgcaggtgaaatcactgtgctagtggaagttgctgacatggagttacacacaaagaaaattgagatatcaggtttaaagtttgcaagcttaacttgcacaggctgttatgcttgtagctctggtatctcctgtaaggttagaatccatgtagatgagcctgatgagcttacagtacatgtgaagagtgaagacccagacatagttgctgctagctcaagtctcatggctagaaaacttgaatttgggacagatagcacattcaaagccttttcagccatgcccaaaacctccttgtgcttttacattgtggagagagaatattgtaaaagctgcagtaaagaagatacacaaaaatgtgtcaacacaaagcttgagcaaccacagagcattttaattgagcacaaaggaacgataattggtaagcaaaacgacacctgcacatctaaagcaggctgttggctagagtcagtcaagagcttcttttatgggctaaaaaacatgcttagtggcatttttggcaatgttttcatagggattttcttattccttgctccttttatccttttaatacttttctttatgtttggatggagaatcctgttctgctttaaatgttgcagaagaactagaggcttatttaagtacagacacctcaaggacgatgaagaaaccggttacaggaaaatcattgagaggctgaacaacaaaaaagggaaaaacaaactgcttgatggtgaaagattagctgataggaagattgctgagctgttctccacaaagacacacattggc

SEQ ID NO: 4022 - RNA, 1932 nt, synthetic construct
  misc_feature 1..1932: note = derived and/or modified CDS sequence (wt) from CCHFV(Semunya)__DQ094832.1__Gc
  source 1..1932: mol_type = other RNA
ttcctggatagcatagccaaggggaagaaaagtctgttaaattctacgaacttagagacaagcctgtcgattgaggccccatggggagcaatcaatgttcagtcaacttttaaaccaacagtttcagctgccaacatagcacttagctggagttcagttgaacacaggggcaacaaaatcctagtttcgggcaggtcagagtcaattatgaaactggaagaacggaccggcatcagctggagcctaggtgtagaggatgcttctgagtcaaagacgcttactgtttctgtcatggacctgtctcaaatgtattctcctgtctttgagtatctgtcaggtgatagacaagtagaagagtggccaaaggccacttgcacaggcgactgcccggagagatgtggctgcacctcctcaacctgcttgcataaagaatggccgcactcgagaaactggcgatgcaaccccacttggtgttggggagtagggactggctgcacctgctgtggactggatgttagagaccttttcacggactacatgatggtcaagtggaaagtggaatatgtaaaaacagaagctataatgtgtgttgagctaactagtcaggaaaggcagtgtagtttaattgaggcaggtacaaggtttaacctaggccctgtgacaataaccctgtcagagccaagaaatgtccagcaaaggcttccctccgaaatcgttacactgcaccctaagatagaggaaggattctttgatttgatgcatgtgcaaaaagtactattctgcaagtacagtttgcaagctacaagctgcacacacggcgtcccaggcgatttgcaggtctaccatgttggcaacctactgaaaggagacaaggttaatgggcactcaattcacaagatagagtctcatttcaacacctcatggatgtcatgggatggatgtgacctagactacttttgcaacatgggtgactggccttcatgtacatatactggagtgacacagcacaatcgtgcggcattcgtcaacatgctcaatattgagactgattatacaaagacttttcacttccattccaagagggttacggcacacggtgacacccctcaactggatctgaaggcaagaccaacatatggtgcaggcgaggtcactgttctagtggaggttgcagatctggagctacacactaagaaaatagaagtgtcagggttgaagtttgcaagtctgacctgctccggttgttatgcctgcagttccggcatctcctgcaaagttagaattcatgtgaatgaaccagatgagttcacagtacacgtgaaaagcaatgatccagacgttgtggcagcaggatcaagtctgatggcaaggaaaatagagtttggggctgacagcacctttaaagccttttcatcaatgcctaaaaactctttgtgcttttatatagtggaaagagactactgcagcagctgcaccgatgatgacactcagaagtgtgttaacataaagctcgaacatccacaaagcatattaattgagcataagggaacaataattggtaagcaaaatgacacctgtccgaccaaaacaagctgctggctagaatcagtcaagagttttttttatggactgaaaaacatgctgggtggcatcttcggcaatgtcttcttaggcatcttcctattccttgctccttttgcactgctgatactcttcttcttctttggatggaggcttctgttctgtctgaagtgttgcagaaggaccaggggtctgctaaagtataaacaacttaaggatgaagaagaagccgggtacaagaaaatcatcgagaggctgaatgacaaaaagggcaaaagtcgactttttgatggagagaggctcgctgacaggaagattgctaaactcttctcaaccaagactcatataggg

SEQ ID NO: 4023 - RNA, 1932 nt, synthetic construct
  misc_feature 1..1932: note = derived and/or modified CDS sequence (wt) from CCHFV(SPU128/81/7)__DQ157174.1__Gc
  source 1..1932: mol_type = other RNA
ttcctagatagtatagttaaaggcatgaaaaatctgctaaactcaacaagtttagaaacaagtttatcaattgaggcaccatggggggcaataaatgttcagtcaacctacaaaccaactgtgtcaactgcaaacatagcactcagttggagctctgtggaacacagaggcaataagatcttggtttcaggcagatcagaatcaattatgaagctggaagaaaggacaggaatcagctgggatctcggcgtagaagacgcctctgagtctaaactgcttacagtctctgtcatggacttgtctcagatgtactctcctgtcttcgagtacttatcaggagacagacaggtggaagagtggcccaaagcaacttgtacaggtgactgcccagaaagatgcggctgcacatcatcaacgtgtttgcacaaagaatggccccattcaagaaattggagatgcaatcccacttggtgctggggtgtagggactggctgcacctgttgtggattagatgtgaaagacctttttacagattatatgtttgtcaagtggaaagttgaatatattaagacagaggccatagtgtgtgtagaacttaccagtcaggaaaggcagtgtagcttgattgaagcgggcacaaggttcaatttaggtcctgtgaccatcacactgtcagaaccaagaaacatccaacagaagctccctcctgaaataatcacactgcatcccaggatcgaagaaggtttttttgacttgatgcatgtacagaaagtgttatcggcaagcacagtatgtaagttgcagagttgcacacatggtgtaccaggagacctacaggtctaccacatcggaaatttattgaaaggggataaggtaaatggacatctaattcataaaattgagccacacttcaacacttcctggatgtcctgggatggttgtgacctggactactactgcaacatgggagattggccttcttgcacatacacaggagtcacccaacacaatcatgcttcatttgtaaacctgctcaacattgagactgattacacaaaaaacttccactttcactctaaaagggtcactgcacacggagacacaccacaactagatcttaaggcaagaccaacctatggtgcaggtgagatcactgtactggtagaagttgctgacatggagttacacacaaagaagattgaaatatcaggcttaaaatttgcaagcttgacttgcacaggttgttatgcttgtagctctggcatctcatgcaaagttagaattcatgtggatgaaccagatgaacttacagtacatgttaaaagtgatgatccagatgtagttgcagctagctcaagtctcatggcaagaaagcttgaatttggaacagacagtacatttaaagctttctcagccatgcctaaaacttctctatgtttctacattgttgaaagagaacactgtaagagctgcagcgaagaagacacaaaaaaatgtgtcaacacaaaacttgagcaaccacaaagcattttgatcgaacacaagggaactataatcggaaagcaaaacagcacttgcacagccaaggcgagttgctggttagagtcagtcaaaagttttttttatggtctaaagaacatgcttagtggtatttttggcaatgtttttataggtattttcttgttccttggccccttcatcttgttaatactattctttatgtttgggtggaggatcctattttgctttaaatgttgtagaagaactagaggcctgctcaagtatagacacctcaaggaagatgaagaaactggttatagaaggattattgaaagactaaacaataaaaaaggaaaaaacaaactgcttgatggtgaaagacttgctgatagaagaattgccgaactgttctctacaaaaacacacattggc

SEQ ID NO: 4024 - RNA, 1932 nt, synthetic construct
  misc_feature 1..1932: note = derived and/or modified CDS sequence (wt) from CCHFV(ROS/HUVLV-100)__DQ206448.1__Gc
  source 1..1932: mol_type = other RNA
ttcttagacagtatagttaaaggcatgaagaatttgctaaactcaacaagcttagaaacaagcctatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacattgcatcccaaagttgaagagggcttctttgacttgatgcatgtgcaaaaagtgctgtctgcaagtacagtgtgtaaactgcagagttgcacacatggtataccaggagatctacaagtttaccatattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaattttttcataggcattttgttattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaagggaaaaaacagactgcttgatggtgaaaggttggctgataggaaaattgctgagctgttctccacaaaaacacacattggt

SEQ ID NO: 4025 - RNA, 1932 nt, synthetic construct
  misc_feature 1..1932: note = derived and/or modified CDS sequence (wt) from CCHFV(AP92)__DQ211625.1__Gc
  source 1..1932: mol_type = other RNA
tttttggatagcatagctaaaggtgttaagaacctcttgaactcaacaagcctggaaactagcttgtcaattgaagcaccatggggggccatcaatgcccaatcaacttacaaaccaactgcatcaagtgctaatattgctctaacatggagctcagtggaacacaggggcaacaagatcttggtctcaggcaggtctgaatcaattatgaaacttgaagagaggaccggaataagctggaacttgggcgttgaagatgcttctgagtcaagaacactcaccatctccgtcatggatctatcacagatgtattcccctgtctttgagtacctgtcaggagatcgtcaggtggaggaatggccaaaggcaacctgcactggcaactgcccggagagatgcggctgcacatcgtcaacctgcctttacaaggagtggccacattcgagaaactggagatgcaaccccacctggtgttggggggttgggactggctgcacatgctgtggactagatgtcaaagaactgttcacggatcacatgctagtaaaatggaaagttgagtacatcaagacagaggccatagtgtgtgttgagcttaccagtcaagaaaggcagtgcagtttgattgaagcaggtacgagatttagcttaggaccagtaacaatcaccttgtctgagccaaggaacattcagcagaagcttcctcctgaattaattacattacacccaaagatagaagacggctactttgacttaatgcatgttcaaaaggttatgtccgccagtacagtgtgcaagctgcaaagttgcacacacggtgtgcccggggacttgcaaatttatcatgttggcaatctgttgaagggggacagagtgaatgggcacctgatccacaaggttgagccacacctgaacacatcctggatgtcgtgggatggttgtgacttagactatttctgcaatatgggggactggccctcctgcacatacaccggggtgacacaacacaatcatgccgcatttgcaaatctgcttaacattgaaaccgactatacaaagactttccatttccactccaaaagagtgacggcccatggagacacaccacagctggacttgaaggcaaggcctaggtatggtgcaggtgaaatcactgttctggttgaagtagctgatatggagttacatacaaagaaggtcgaggtaacaggcttaaaatttgcaagcctaacttgttcaggatgctatgcctgtagttcaggtatctcctgcaaggttagaatacatgtggacgagccagatgagctcacagtgcatgtgaaaagcagcgacccagacattgtggcagccagctcaagtctcatggcaaggaagattgagtttggggttgacagtactttcaaagcgttctcctctatgcctaaagattctctgtgcttttatattgtcgaaagagactattgcaacagctgcaaaaatgaggaaacacagaggtgtgtgaacgcaaagcttgaacagccacagagcatcctcatcgaacatacaggtacaatcattggcaagcagaacgacacctgtggatctaggacaagctgctggctagactcatttaaaagtttcttttatggactaaagagcatgttgagcggcatttttggtaatgtctttctaggcatcttcttgtttcttgccccctttgctctgctgctgtttttctttttctttggatggagaatcctgttttgctttaagtgctgtagaagaaccagaggcctgtttaaatacagacacatcaaggacgatgaagaggttggctacaaaaaaatcatcgaaagactgaacaataaaaaaggcaaacacagacttcttgacggcgagagacttgcagataggaagatcgctgaacttttctcaactaagacacacattgga

SEQ ID NO: 4026 - RNA, 1932 nt, synthetic construct
  misc_feature 1..1932: note = derived and/or modified CDS sequence (wt) from CCHFV(ArD8194)__DQ211626.1__Gc
  source 1..1932: mol_type = other RNA
ttcttagatagaatagccaagggaatgaaaagcttgttgaactccacaagtttagaaacgagcttgtcaattgaagctccatggggggcaatcaatgttcaatcaactttcaaaccaacagtttcagccgccaatatagcacttagctggagttcagttgaacacaagggcaacaagatcttagtttcaggcagatcagagtcaattatgaaattagaagaaagaactggaatcagctggtgtctaggtgtggaagatgcctctgagtcaaaaacactcaccgtttctgttatggatctgtctcaaatgtattctcctgttttcgagtacctgtcaggtgaccgacaggtggaggagtggccaaaagcaacctgcacaggtgactgtccagaaagatgtggctgcacttcatcaacctgcctgcataaggagtggccgcactcgaggaactggcgctgtaaccccacttggtgttggggggtgggaactggctgcacctgctgtgggctagatgtaaaggatctcttcacagactacatgttggttaaatggaaagtggaatatataaaaacagaagccataatatgtgttgagcttactagtcaagagaggcagtgtagtttaattgaagcaggcacaaggtttaacctaggccctgtgacaataactctatcagaaccaaggaacgtacagcagaggcttcctcccgagatcatcacactgcaccctaaaatagaagaagggttttttgatttgatgcatgtacagaaggtaatgtctgcaagcacggtttgtaagctgcaaagctgtactcatggtgtgcctggagacttacaagtctaccatgttggcaacttgttaaagggggacaaagtcaatgggcactcaatccacaagatagaatcacacctcaacacctcatggatgtcatgggatgggtgtgatttagactatttttgcaacatgggggactggccctcatgcacatacacaggggtgacacaacacaaccatgctgcattcatcaacatgcttaacattgagactgattacacaaaaacctttcactttcattcaaaaagggtcacagcacacggagacacccctcagttggacctaaaagcgagaccagcatatggtgcaggcgaaatcactgttctagtagaagttgcagatttagaactgcacacgaagaaaattgaagtgtcgggtctgaaattcgcaagtttgtcatgctccggatgttatgcttgcagctctggcatctcctgcaaagttaggattcatgtaaatgaaccggatgaattcacagtacatgtaaaaagtaatgacccagatgttgtagcagcaggatcaagtctcatggctagaaagatagagtctggggccgacagcacgtttaaggctttttcatcaatgccaaaaaactctctatgtttttacatagtagaaagagattattgtagcagctgtacagatgatgacactcagaaatgtgttgacattaaacttgaacatccacagagcatactcattgaacacaaaggaacgattattggcaagcagaatgacacctgtccaactaaaacaagctgctggttggaatctattaagagttttttttatgggcttaaaaacatgctgagtgggatcttcggtaatgttttcttaggcatgctcctgtttcttgctccttttatattgctaatattgtttttcttcttcgggtggagacttctcttttgccttaagtgctgtagaaggaccagaaagctgctaaagtataagcaccttagggacgaagaagagagtggttacaaaaaaatcattgaaaggctaaatgacaaaaaaggcaaaagtcgattgtttgatggagaaaggcttgcagacagaaagattgccgaactcttttcaactaaaactcatataggt

SEQ ID NO: 4027 - RNA, 1932 nt, synthetic construct
  misc_feature 1..1932: note = derived and/or modified CDS sequence (wt) from CCHFV(ArD15786)__DQ211627.1__Gc
  source 1..1932: mol_type = other RNA
tccttagatagtatagccaagggaatgaaaagcttgttgaactccacaagtttagaaacgagcttgtcaattgaagctccatggggggcaatcaatgttcaatcaaccttcaaaccaacaatttcagccgccaacatagcacttagctggagttcagttgaacacaagggcaacaagatcttagtttcaggcagatcagagtcaattatgaaattagaagaaagaactggaatcagctggtgtctaggtgtggaagatgcttctgaatcaaaaacactcactgtttctgttatggatctgtctcaaatgtattctcctgttttcgagtacctgtcaggtgaccgacaggtggaggagtggccaaaagcaacctgcacaggtgactgtccagaaagatgtggctgcacttcatcaacctgcctacataaggagtggccgcactcgaggaactggcgctgtaaccccacttggtgttggggggtgggaaccggctgcacctgctgtgggctagatgtaaaggatctcttcacagactacatgttggttaaatggaaagtggaatatataaaaacagaagccataatatgtgttgagcttactagtcaagagaggcagtgtagtttaattgaagcaggcacaaggtttaacctaggccctgtgacaataactctatcagaaccaaggaacgtacagcagaggcttccccccgagatcattacactgcaccctaaaatagaagaagggttttttgatttgatgcatgtgcagaaggtaatgtctgcaagcacggtttgtaagctgcaaagctgtactcacggtgtgcctggagacttacaagtctaccatgttggcaacttgttaaagggggacaaagtcaatgggcactcaatccacaagatagaatcgcacctcaacacctcatggatgtcatgggatgggtgtgatttagattatttttgcaacatgggggactggccctcatgcacatacacaggggtgacacaacacaaccgtgctgcattcatcaacatgcttaacattgagactgattacacaaaaacttttcactttcattcaaaaagggtcacagcacacggagacacccctcagttggacctaaaagcgaggccaacatatggtgcaggcgaaatcactgttctagtggaagttgcagatttagaactacacacgaagaaaattgaagtgtcgggtctgaaattcgcaagtttgacatgctctggatgttatgcttgcagctctggcatctcctgcaaagttaggattcatgtaaatgaaccggatgaattcacagtacatgtaaaaagcaatgacccagatgttgtagcagcaggatcaagtctcatggctagaaagatagagtctggggccgacagcacgtttaaggctttttcatcaatgccaaaaaactctctatgtttttacatagtagaaagagattattgtagcagctgtacagatgatgacactcaaaaatgcgttgacataaaacttgaacatccacaaagcatacttattgaacacaaaggaacgattattggcaagcaaaatgacacctgtccaactaaaacaagctgctggttggaatctatcaagagtttcttttatgggcttaaaaatatgctgagtgggatcttcggtaatattttcttaggcatgctcctgtttcttgctccttttgtattgctaatattgtttttcttcttcgggtggagacttctcttttgccttaagtgctgtagaaggactagaaagctgctaaagtataagcaccttagggacgaagaagagagtggttacaaaaaaatcattgaaaggctaaatgacaagaagggcaaaagtcgattgtttgatggagaaaggcttgcagacagaaagattgccgaactcttttcaactaaaactcatgtaggt

SEQ ID NO: 4028 - RNA, 1932 nt, synthetic construct
  misc_feature 1..1932: note = derived and/or modified CDS sequence (wt) from CCHFV(ArD39554)__DQ211628.1__Gc
  source 1..1932: mol_type = other RNA
tttttggacagtactgccaagagcatgaaaagcctgttaaattcaacaagtttggaaacaagcctgtcaattgaagcaccctggggggcaattaatgtacagtcaactttcaaacccaccgcttcgactgcaaatatagcgctcagttggagctcagtagaacacagaggcaataagattcttgttacaggtagatcagagtcgattatgaaactggaagaaagaacaggaatcagttggaatctcggtgtggaagatgcttctgaatcaaagacactcactgtatcagtcatggacttatctcagatgtattccactgtcttcgagtacttatcaggcgaccggcaagtagaggagtggcctaaagcaacctgcacaggtgattgtccagaaagatgtggctgtacatcatctacttgcctccacaaggcgtggccccattcaaggaactggaggtgcaaccccacgtggtgttggggagttggaactggttgcacttgctgtggattggatgtgaaaaacctctttactgactatatgcttatcaaatggaaagttgaatttataaaaactgaagccatagtgtgtgttgaactcacaagccaggaaaggcaatgcagtcttatagaagcaggcacaagatttaacttgggccctgttaccatcactttatcagaaccaagaaacattcagcagaagctccctcctgaactggttacgctgcatccaagagtagaagaaggcttcttcgaccttatgcatgtgcagaaagtgctttctgcaagcactgtgtgtaaattgcagagctgcacgcatggtgtaccaggtgacttgcaagtgtatcatgtaggcaacttgctgaaaggggataaaataaatggcaactcatttcacaaaattgagccgaacctaaatacatcatggatgtcttgggacggctgtgatcttgattactactgcaacatgggagactggccctcctgtacttacacaggtgtgacgcagcacaaccatgctgcttttgtgaacctgctcaacattgaaactgactatacaaagaacttccactttcactcaaagagagtcacagcacatggagagacgccccagctagaccttaaagccagaccaaagtatggagcaggtgaggtcacagtcctggtggaagttgctgacatggagctgcacactaaaaagattgagatatcaggtttgaaatttgctagcctgacctgcacgggctgctatgcttgtagctcaggtatctcctgcaaggttaggcttcatgtagatgagccagatgagctcacggtacacgtgaagagtgatgatccggatgtagttgcagccagctcaagcctgatggccagaaaaattgaatttggaactgatagcacatttaaagctttctcgtccatgcctaaggataaactctgcttttacattgtggaaagagactactgcagcagttgcagcaaagaggacacacaaaagtgtgtaaatgcaaaacttgagcagcctcagagtatacttattgaacataaaggcaccataattgggaagcaaaatgacacttgtacagtcaaggcgagctgttggttggaatcggtaaaaagttttttttatggactaaaaaacatgttgggtggtatcttcggcaacgttatcttgggcatcatcatgttccttgctccttttgccttgttactgctcttcttccttttcggatggagaattctgttctgccttagatgctgcagaaggactagggggctatttaagtacaaacacatcaaagatgatgaagaatcaggctacaaaaggattattgaaaggttaaataacaagaaaggtaagaacaagttatttgacggcgagagattggcagacaagaaaattgctgaactattctcaacgaagacacacattggc

SEQ ID NO: 4029 - RNA, 1932 nt, synthetic construct
  misc_feature 1..1932: note = derived and/or modified CDS sequence (wt) from CCHFV(C-68031)__DQ211629.1__Gc
  source 1..1932: mol_type = other RNA
ttttcagacagtattgtcaaaggcatgaagaacttgctaaattcaacaagcttagaaacaagcttatcaattgaggcaccatggggagctataaatgtccaatcaaccttcaaacctactgtgtccgctgcgaacatagctcttagttggagctcagtggaacacaggggtaataagattttggtttcaggtagatcagagtcaattatgaagctagaggaaaggacaggaatcagctgggatctaggggtagaagatgcctctgagtctaaattgcttactgtctctattatggacttgtcacagatgtattctcctgtctttgagtacctatcaggtgatagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttgtcaagtggaaagttgagtacattaaaacagaagctatagtgtgtgttgagcttactagccaagagagacaatgtagcttgattgaggcaggcacaagattcaacttaggtcctgtgaccatcacattgtcagagccaagaaacattcagcaaaagctccctccagagatagttacattgcatcccagaattgaagaaggtttctttgatttaatgcatgtaaaaaaagtgctatcagcaagtacagtatgtaagctacagagttgcacacatggtgtgccaggggacctacaggtctaccacataggaaacttgttaaaaggagacaaggtgaatgggcacctgattcacaaaattgaaccacacttcaacacttcctggatgtcttgggacggctgtgacctagactactactgtaatatgggggactggccatcttgctcatatactggagtaacccagcacaatcatgctgcatttgtaaacatgctcaacatcgaaactgattatacaaaaatcttccactttcactctaagagagttactgcacatggagacacaccacaattagatttgaaagctagaccaacttatggtgcaggtgaaatcactgtgctagtggaagttgctgacatggagttacacacaaagaaaattgagatatcaggtttaaagtttgcaagcttaacttgcacaggctgttatgcttgtagctctggtatctcctgtaaggttagaatccatgtagatgagcctgatgagcttacagtacatgtgaagagtgaagacccagacatagttgctgctagctcaagtctcatggctagaaaacttgaatttgggacagatagcacattcaaagccttttcagccatgcccaaaacctccttgtgcttttacattgtggagagagaatattgtaaaagctgcagtaaagaagatacacaaaaatgtgtcaacacaaagcttgagcaaccacagagcattttaattgagcacaaaggaacgataattggtaagcaaaacgacacctgcacatctaaagcaggctgttggctagagtcagtcaagagcttcttttatgggctaaaaaacatgcttagtggcatttttggcaatgttttcatagggattttcttattccttgctccttttatccttttaatacttttctttatgtttggatggagaatcctgttctgctttaaatgttgcagaagaactagaggcctatttaagtacagacacctcaaggacgatgaagaaaccggttacaggaaaatcattgagaggctgaacaacaaaaaagggaaaaacaaactgcttgatggtgaaagattagctgataggaagattgctgagctgttctccacaaagacacacattggc

SEQ ID NO: 4030 - RNA, 1932 nt, synthetic construct
  misc_feature 1..1932: note = derived and/or modified CDS sequence (wt) from CCHFV(Drosdov)__DQ211630.1__Gc
  source 1..1932: mol_type = other RNA
ttcttagacagtacagttaaaggtatgaaaaatttgctaaactcaacaagcttggaaacaagcttatcaattgaggcaccatggggagcaataaatgtccagtcaacctttaaaccaacagtatcgactgcaaacatagcactcagttggagctcagtggagcacagaggcaacaagatcttggtcacaggcaggtctgaatcaattatgaaactagaggaaaggacaggagtcagctgggatctaggcgtagaagatgcctctgaatccaaattacttaccgtctccatcatggatttgtcacaaatgtattcccctgtttttgagtacttatcaggagatagacaggttgaagaatggcccaaggcaacctgtacaggtgattgcccagaaaggtgtggctgcacatcatcaacctgcttgcataaagaatggcctcactcaagaaactggagatgtaaccccacttggtgctggggagtaggaaccggctgcacatgctgcggagtggatgtaaaagacctttttacagatcacatgtttgtcaaatggaaggttgaatatatgaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtacaaaaagtgttatctgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactattgcaacatggggaattggccttcttgcacatacacaggagtgacccaacataatcatgctgcatttgtaaatttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctggtttgcacgggttgctatgcttgtagctctggcatttcctgtaaagtcagaattcatgtagatgaaccagatgagctcacagtgcatgtaaagagcagtgatccagatgtggttgcagctagcacaagccttatggcaaggaagcttgaatttgggacagatagcatattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggtgcttttctttatgtttggatggaaaatcttgttttgctttaagtgttgcaggaggaccagaggcttgtttaagtatagacacctcaaagacgatgaggaaacaggctacagaaggattattgaaagactgaatagtaaaaaaggaaaaaacagactgcttgatggtgagaggttggctgataggaaaattgctgagctgttctccacaaaaacacacattggc

SEQ ID NO: 4031 - RNA, 1932 nt, synthetic construct
  misc_feature 1..1932: note = derived and/or modified CDS sequence (wt) from CCHFV(Kashmanov)__DQ211631.1__Gc
  source 1..1932: mol_type = other RNA
ttcttagacagtatagttaaaggcatgaagaattcgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggataggataaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 4032 - RNA, 1932 nt, synthetic construct
  misc_feature 1..1932: note = derived and/or modified CDS sequence (wt) from CCHFV(Oman)__DQ211632.1__Gc
  source 1..1932: mol_type = other RNA
tttttagacagtattgctaagggcatgaagaacctgctgaattcaacaagcttagaaacaagcttatcaattgaggcaccatggggagcaataaacgttcaatctactttcaaacctactgtgtcaactgcaaacatagcacttagttggagctcagtggaacacagaggtaataagatcttggtttcaggcagatcagagtcaatcatgaagctagaagaaagaacaggaatcagctgggatttgggagtagaagatgcctctgagtccaaattacttactgtttccgtcatggacttatcacagatgtactctcctgtctttgagtacctatcaggtgacagacaagtagaggaatggccaaaggcaacctgtacaggcgattgcccggaaagatgtggctgcacatcatcaacctgcctacacaaggaatggcctcactcaagaaactggagatgcaaccccacttggtgttggggagtcggcaccggatgcacctgttgtggactagatgtaaaggacctttttacagattacatgtttgttaaatggaaggtcgaatatataaaaacagaggctatagtgtgtgttgagcttactagccaagaaagacaatgtagcttgattgaggcaggcacaagattcaacttaggtcctgtgactatcacattatcagagccaagaaacattcagcaaaagctccctccagaaattgtcacattacatcctagaattgaagaaggtttttttgacttaatgcatgtacagaaggtactatcagcaagcacagtgtgcaagctacagagttgcacacatggcgtaccaggagacttacaggtctaccacatcggaaacttactaaaaggagacaaagtgaacgggcatctgatacataaagttgaaccacatttcaacacctcctggatgtcttgggacggctgtgacctagattactactgcaatatgggggattggccctcttgcacgtatactggagttacccaacataatcatgctgcatttgtaaacctacttaacattgaaactgattacacaaagaacttccactttcactctaagagagtcactgcacatggggacactccacaattagatttaaaagccagaccaaattatggtgcaggtgaggtcactgtgctggtggaagttgctgacatggagttacacacaaagaaaattgagatatcaggtttgaagtttgcaagcctaacttgcacaggttgttatgcttgtagctctggcatctcatgtaaggttaggatccatgtagatgaaccagatgagcttacagtacatgtgaagagtgaagacccagacatagttgctgctagctcaagtctcatggcaagaaagcttgaattcgggacggatagtacattcaaagccttctcagccatgcctaaaacctccttgtgcttttacattgttgagagagaatactgtaaaagctgcagtaaagaagacacacaaaagtgtgttaacgcaaagcttgagcgaccacagagcattttaattgagcacaaaggaacgataattggaaagcagaacgacacttgcacagctaaagcaagctgctggctagagtcagtcaagagtttcttttatggactaaagaacatgcttagtggcatttttggcaatgttttcatagggattttcttattccttgctccttttatcctgttaatacttttctttatgtttgggtggagaatcctattctgctttaagtgctgcaggagaactagaggcctatttaagtacagacacctcaaagatgatgaagaaaccggttataggaaaatcattgagagactaaacaacaaaaaaggtaaaaacaagctgcttgacggtgaaagattagctgatagaaagatcgctgagctgttctctacaaaaacacacattggc

SEQ ID NO: 4033 - RNA, 1932 nt, synthetic construct
  misc_feature 1..1932: note = derived and/or modified CDS sequence (wt) from CCHFV(SPU97/85)__DQ211633.1__Gc
  source 1..1932: mol_type = other RNA
tttttagacagtattgttaaaggcaagaagaacttgctaaactcaacaagcttggaaacaagcttatcaattgaagcaccatggggtgcaataaatgtccaatcaaccttcaaacctactgtgtcagctgcaaacatagcacttagctggagctcagtggaacacagaggcaacaagattttggtttcaggcaggtcagaatcaatcatgaagctggaggaaaggacaggaatcagctgggatctgggagtagaagacgcctctgagtccaaattgctcaccgtctctgtcatggacttgtcacagatgtattcccccgtctttgagtacctgtcaggtgatagacaggtagaagagtggcccaaggcgacctgtacaggcgattgcccagaaagatgtggctgcacatcatcaacctgtttgcacaaggaatggccccattcaaggaactggagatgcaaccccacttggtgttggggggtcggcactggatgcacctgttgtggactagatgtaaaagacctctttacagattacatgtttgtcaagtggaaagttgaatacataaaaacagaggccatagtgtgcgtcgaacttactagccaagaaagacaatgtagcttgattgaagcaggcacaagattcaatttaggtcctgtgactatcacattgtcagagccaagaaacattcagcaaaagctccctccagagataatcacattgcatcctagaattgaagaaggcttttttgacttaatgcatgtgcaaaaagtgctgtcagcaagcacagtgtgcaagctacagagttgcacacatggtgttccaggagacctacaggtctaccacatcggaaacttgttaaaaggagacaaggtaaacgggcatctgattcacaagattgaaccacatttcaacacttcctggatgtcttgggatggctgtgacctagactactactgcaatatgggggactggccttcttgcacatacactggagtaacccaacataaccatgctgcatttgtaaatttgctcaatatcgaaaccgattatacaaaaaactttcattttcactccaagagagttactgcacatggagacacaccacagttagacttgaaggccagaccaacttatggtgcaggggaggtcactgtactagtggaggttgctgacatggagttgcacacaaagaaaattgagatatcaggcttgaagtttgcaagcctatcttgcacaggctgctatgcttgtagctctggtatctcctgtaaggtcaggatccatgtagatgaaccagatgagcttacagtacatgtgaagagtgaagacccagacatagttgctgcaggctcaagtctcatggcaaggaagcttgaatttggggcagatagtacattcaaagccttttcagccatgcccaaaacctccttgtgcttttacattgtggagagagaatactgtaagagctgcagtagagaagacacacaaaaatgtgttaacactaaacttgagcgaccacagagcattttgatcgaacataaaggaacgattattggaaagcaaaacgacacttgcacagctaaagcaagctgctggctagagtcagtcaaaagttttttctacggattaaagagtatgcttagtggcatttttggcaacgttttcatagggattttcttattcattgctccttttgtcctgttaatacttttctttatgtttgggtggaggattctgttctgctttaagtgctgcagaagaaccaggggcctatttaagtacagacacctcaaggacgatgaagaaaccggttacaggaaaatcattgagaggctaaataacaaaaagggaaaaaacaaactacttgatggggaaaggctagctgacaggaaaatcgccgagttattctccacaaaatcacatatcggc

SEQ ID NO: 4034 - RNA, 1932 nt, synthetic construct
  misc_feature 1..1932: note = derived and/or modified CDS sequence (wt) from CCHFV(SPU103/87)__DQ211634.1__Gc
  source 1..1932: mol_type = other RNA
ttcttagataatatagttaaaggcatgaaaaatttgctaaactcaacaagtttggagacaagtttatcaattgaggcaccatggggagcaataaatgttcagtcaacctacaaaccaactgtatcaactgcaaacatagcgcttagttggagctcagtagaacacagaggcaataagatactggtttcgggcagatcagaatcaattatgaagctggaagaaaggacaggaataagctgggatctcggtgtagaagacgcctctgagtctaaactgcttacagtctctgtcatggacttgtcacagatgtactcacctgtcttcgagtacttatcaggagacagacaggtggaagagtggcccaaagcaacttgtacgggtgattgcccagaaagatgtggctgcacatcatcaacctgcttacataaagaatggccccattcaaggaattggagatgtaaccccacttggtgctggggtgtagggactggctgcacctgttgtggattagacgtgaaagacctctttacagattatatgtttgtcaagtggaaaattgaatacattaaaacagaagcaatagtgtgtgtagaacttactagtcaggaaagacagtgtagcttgattgaagcgggcacaaggttcaatttgggtcccgtgaccatcacattgtcagaaccaagaaacatccagcaaaagctcccttctgaaataatcacactgcatcccaggattgaggagggtttttttgacctgatgcatgtacaaaaagtgttgtcggcaagcacagtgtgtaagttgcagagttgcacacatggtgtgccaggagatctacaggtctaccacatcggaaatttattaaaaggggataaggtaaatggacacctagttcataaaattgagccacacttcaatacttcttggatgtcctgggatggttgtgatctagactattattgcaacatgggagattggccttcttgcacatacacaggagttacccagcacaatcatgcttcatttgtaaacctgctcaacattgaaactgattacacaaaaaacttccactttcactctaaaagggtcactgcacacggagacacaccacaactggatcttaaggcaagaccaacctatggtgcaggtgagatcactgtattggtggaagttgctgacatggagttacacacaaagaagattgaaatatcaggcttaaaatttacaagcctgacttgtacaggctgttatgcttgtagttctggcatctcatgcaaagttagaattcatgtggatgaaccagatgaacttacagtgcatgttaaaagtgatgatccagatgttgttgcagctagctcaagtctcatggcaagaaagcttgaatttggaacagacagtacatttaaggctttttcagccatgcctaaaacttctctatgtttctacattgtggaaagagaatactgtaagagctgcagtgaagaagacacacaaaaatgtgttaacacaaaacttgagcagccacagagcattttgatcgaacataagggtactataatcgggaagcaaaacaacacttgcaaggctagggcgggttgctggttagagtcagttaagagttttttttacggcctaaagaacatgctcagtggcatttttggcaatgtatttataggcattttcttatttcttgcccccttcatcctattaatactattctttatgtttgggtggaggatcttgttttgttttaagtgttgtagaagaactagaggcctgttcaagtatagacacctgaaagacgatgaagaaactggttatagaaagatcattgaaagactaaacaacaaaaaagggaaaaataaactgcttgatggtgaaagacttgctgatagaagaattgccgaactgttctctacaaaaacacacattggc

SEQ ID NO: 4035 - RNA, 1932 nt, synthetic construct
  misc_feature 1..1932: note = derived and/or modified CDS sequence (wt) from CCHFV(SPU415/85)__DQ211635.1__Gc
  source 1..1932: mol_type = other RNA
tttttagacagtattgttaaaggcatgaagaacttgctaaactcaacaagcttggaaacaagcttatcaattgaggcaccatggggtgcaataaatgtccaatcaaccttcaaacccactgtgtcagctgcaaacatagcacttagctggagctcagtggaacacagaggcaacaagattttggtttcaggcaggtcagaatcaatcatgaagctggaggaaaggacaggaatcagctgggatctgggagtagaagacgcctctgagtccaaattgctcaccgtctctgtcatggacttgtcacaaatgtattcccccgtctttgagtacctgtcaggtgatagacaggtagaagagtggcccaaggcgacctgtacaggcgattgcccagaaagatgtggctgcacatcatcaacctgtttgcacaaggaatggccccattcaaggaactggagatgcaaccccacttggtgttggggggtcggcactggatgcacctgttgtgggctagatgtaaaagacctctttacagattacatgtttgtcaagtggaaagttgaatacataaaaacagaggccatagtgtgtgtcgaacttactagccaagaaaggcaatgtagcttgattgaagcaggcacaagattcaatttaggtcctgtgactatcacattatcggagccaagaaacattcagcaaaagctccctccagaaataattacattgcatcctagaattgaagaaggcttttttgacttaatgcatgtgcaaagagtgctgtcagcaagcacagtgtgcaagctacagagttgcacacatggtgtgccaggagacctacaggtctaccacatcggaaacttgttaaaaggagacaaggtaaacgggcatctgattcacaagattgaaccacatttcaacacttcctggatgtcttgggatggctgtgacctagattactactgcaatatgggggattggccttcttgcacatacactggagtaacccaacataaccatgctgcatttgtaaatttgctcaatatcgaaaccgattatacaaaaaactttcattttcactccaagagagttactgcacatggagacacaccacaattagacttgaaggccagaccaacttatggtgcaggggaggttactgtactagtggaggttgctgacatggagctgcacacaaagaaaattgagatatcaggcttgaagtttgcaagtctaacttgcacaggctgctatgcttgtagctctggtatctcctgtaaggtcaagatccatgtagatgaaccagatgagcttacagtacatgtgaagagtgaagacccagacatagttgctgcaggctcaagtctcatggcaaggaagcttgaatttggggcagatagtacattcaaagccttttcagccatgcccaaaacctccttgtgcttttatattgtggagagagaatactgtaagagctgcagtagagaggacacacgaaaatgtgttaacactaagcttgatcgaccacagagcattttgatcgaacataaaggaacgattattggaaagcaaaacaacacatgcacagctaaagcaagctgctggctagagtcagtcaaaagttttttctacggattgaagaatatgcttagtggcattttcggtaatgttttcatagggattttcttattcattgctccttttgtcctgttaatacttttctttatgtttgggtggaggatcctgttctgctttaagtgctgcagaagaaccagaggcctatttaagtacagacacctcaaggacgatgaagaaaccggttacaggaaaatcattgagaggctaaataacaaaaagggaaaaaacaaactacttgatggggaaaggctagctgataggaaaatcgccgagttattctccacaaaatcacatatcggc

SEQ ID NO: 4036 - RNA, 1932 nt, synthetic construct
  misc_feature 1..1932: note = derived and/or modified CDS sequence (wt) from CCHFV(Turkey200310849)__DQ211636.1__Gc
  source 1..1932: mol_type = other RNA
ttcttggacagtatagttaaaggtatgaaaaatttgctaaactcaacaagcttggaaacaagcttatcaattgaggcaccatggggagcaataaatgtccagtcaacctttaaaccagctgtatcgactgcaaacatagcactcagttggagctcagtggagcacagaggcaacaagatcttagtcacaggcaggtctgaatcaattatgaaactggaggaaaggacaggagtcagctgggatctaggtgtagaagatgcctctgaatccaaattacttaccgtttctatcatggatttgtcacaaatgtattctcctgtttttgagtacttgtcaggagacagacaggttgaagaatggcccaaagcaacttgtacaggtgattgcccggagaggtgtggttgcacatcatcaacctgcttacataaagaatggcctcactcaagaaactggagatgtaatcccacttggtgctggggagtaggaaccggctgcacctgctgcggggtggatgtaaaagatctttttacagatcacatgtttgtcaaatggaaagttgaatacataaaaactgaagctatagtatgtgttgaactcaccagccaagaaagacagtgcagtctgattgaggcaggtactagattcaacttgggccctgtgactattaccctgtctgagccaagaaacattcagcagaagcttcctcctgagattatcacgttgcatcccaaaattgaagaaggcttctttgacttgatgcatgtacaaaaagtgttgtctgcaagtacagtgtgtaaactgcagagttgcacacatggtataccaggagatctacaagtttaccacattggcaacttgttgaaaggggatagagtaaacgggcatctaattcacaaaattgaatcacatttcaacacctcttggatgtcctgggatggttgtgacttagactactactgcaacatgggggattggccatcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgaaatatcaggcttgaaatttgcaagtctggcttgcacgggttgctatgcttgtagctctggcatctcctgtaaagttagaattcatgtagatgaaccagatgagctcacagtacatgtaaagagcagtgatccagatgtggttgcagctagcacaagtctcatggcgaggaagcttgaatttgggacagacagcacattcaaggccttttcagctatgcccaaaacctctttatgtttttacattgtggagagagaatactgcaagagctgcagtgaagatgatacacaaaaatgtgttgacacaagacttgagcagccacagagcatactaattgagcacaaaggaacgataattggaaagcagaatgatacttgcacagccaaggcaagctgttggttagagtcagtcaagagttttttttatggattgaagaatatgcttggcagtgtttttggtaatcttttcataggcattttgttattccttgccccttttgtcctgttggtgcttttctttatgtttgggtggaaaatcttgttttgctttaaatgttgcaggaggaccagaggcttatttaagtatagacacctcaaagacgatgaggaaacaggctacagaaggattattgaaagactgaacagcaaaaaagggaaaaacaggctgcttgatggtgatagactggctgataggaaaattgctgagctgttctccacaaaaacacacattggc

SEQ ID NO: 4037 - RNA, 1932 nt, synthetic construct
  misc_feature 1..1932: note = derived and/or modified CDS sequence (wt) from CCHFV(Iran-52)__DQ446215.1__Gc
  source 1..1932: mol_type = other RNA
tttctagatagtatagtcaaaggtatgaaaaatctgctaaactcaacaagtctagaaacaagcttatcaattgaggcaccatggggagcaattaatgttcagtcaacctacaaaccaactgtatcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagtcatggacttgtctcagatgtactctcctgtcttcgagtacttatcaggtgacagacaagtggaagagtggcctaaagcaacctgcacaggtgactgcccagaaagatgtggctgcacatcatcaacctgcttacacaaagagtggccccactcaaggaattggagatgtaatcctacttggtgctggggtgtagggactggctgcacctgttgtggtttagatgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagaaccaaggaacattcaacaaaagctccctcctgaaataatcacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacctgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacagctagatctgaaggcaaggccaacctatggtgcaggtgagatcaccgtgctggtggaagttgctgacatggagttacacacaaagaagattgaaatatcaggcttaaaatttgcaggcctaacttgcacaggttgttatgcttgtagttctggcatctcttgtaaagttagaattcatgtagaggaaccagatgaacttacagtacatgttaaaagtgatgacccagatgtagttgcagctagctcaagtctcatggcgaggaagcttgagtttggaacagacagtacatttaaagctttctcagccatgcctaaaacctccctatgtttctacattgtggaaagagaatactgtaagagctgcagtaaagaagatacacaaaaatgtgttaacacgaaactcgaacaaccacagagcattttgatcgaacataagggaactataattggaaagcaaaacaatacttgcacggctaaagcgagttgctggttagagtcagttaagagttttttttatggtctgaagaatatgctcggtggcatatttggcaatgtttttataggcattttcacatttcttaccccctttatcttgttaatacttttctttatgtttgggtggaggatcctgttttgcttcaagtgttgcagaagaaccagaggcctattcaagtacagacacctcaaagacgatgaagaaactggttacagaaagatcattgaaagactgaacaacaaaaagggaaaaaacaggctgcttgatggtgaaagacttgctgacagaaagattgctgaactgttctccacaaaaacacacattggc

SEQ ID NO: 4038 - RNA, 1932 nt, synthetic construct
  misc_feature 1..1932: note = derived and/or modified CDS sequence (wt) from CCHFV(Iran-53)__DQ446216.1__Gc
  source 1..1932: mol_type = other RNA
tttctagatagtatagtcaaaggtatgaaaaatctgctaaactcaacaagtctagaaacaagcttatcaattgaggcaccatggggagcaattaatgttcagtcaacctacaaaccaactgtatcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagtcatggacttgtctcagatgtactctcctgtcttcgagtacttatcaggtgacagacaagtggaagagtggcctaaagcaacctgcacaggtgactgcccagaaagatgtggctgcacatcatcaacctgcttacacaaagagtggccccactcaaggaattggagatgtaatcctacttggtgctggggtgtagggactggctgcacctgttgtggtttagatgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagaaccaaggaacattcaacaaaagctccctcctgaaataatcacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacctgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacagctagatctgaaggcaaggccaacctatggtgcaggtgaggtcaccgtgctggtggaagttgctgacatggagttacacacaaagaagattgaaatatcaggcttaaaatttgcaggcctaacttgcacaggttgttatgcttgtagttctggcatctcttgtaaagttagaattcatgtagatgaaccagatgaacttacagtacatgttaaaagtgatgacccagatgtagttgcagctagctcaagtctcatggcgaggaagcttgagtttggaacagacagtacatttaaagctttctcagccatgcctaaaacctccctatgtttctacattgtggaaagagaatactgtaagagctgcagtaaagaagatacacaaaaatgtgttaacacgaaactcgaacaaccacagagcattttgatcgaacataagggaactataattggaaagcaaaacaatacttgcacggctaaagcgagttgctggttagagtcagttaagagttttttttatggtctgaagaatatgctcggtggcatatttggcaatgtttttataggcattttcacatttcttaccccctttatcttgttaatactcttctttatgtttgggtggaggatcctgttttgcttcaagtgttgcagaagaaccagaggcctattcaagtacagacacctcaaagacgatgaagaaactggttacagaaagatcattgaaagactgaacaacaaaaagggaaaaaacaggctgcttgatggtgaaagacttgctgacagaaagattgctgaactgttctccacaaaaacacacattggc

SEQ ID NO: 4039 - RNA, 1932 nt, synthetic construct
  misc_feature 1..1932: note = derived and/or modified CDS sequence (wt) from CCHFV(Kosova Hoti)__EU037902.1__Gc
  source 1..1932: mol_type = other RNA
ttcttagacagtatagtcaaaggtatgaaaaatttgctaaactcaacaagcttagaaacaagcttatcaattgaggcaccatggggagcaataaatgtccagtcaaccttcaaaccaacagtgtcgactgcgaacatagcactcagttggagctcagtggaacacagaggcaacaagatcttagtcacaggcaggtctgagtcaattatgaaactagaggaaaggacaggaatcagctgggatctaggcgtagaagatgcctctgaatccaaattacttaccgtctctatcatggatttgtcacagatgtattccccagtttttgagtacttgtcaggggacagacaggttgaagaatggcccaaagcaacttgcacaggtgactgcccacaaaggtgtggctgcacatcatcaacctgcttgcataaagaatggcctcattcaagaaactggagatgtaatcccacttggtgctggggagtgggaactggctgcacctgctgcggggtggatgtaaaagacctttttacagatcacatgtttgtcaaatggaaggttgaatatataaaaactgaagccatagtgtgtgttgagctcaccagccaagaaagacagtgcagtctgattgaggcaggtactagattcaacttgggccctgtgactattaccctgtctgagccaagaaacattcagcagaagctcccccctgagatcattacgttgcatcccaaaattgaggaaggcttctttgacttgatgcatgtacaaaaagtgttgtccgcaagtacagtgtgtaaactgcagagttgcacacatggtataccaggagatctacaagtttaccacattggcaatttgttgaaaggggatagagtgaacgggcatctaattcacaaaattgaaccacatttcaacacctcttggatgtcctgggatggttgtgacttagactactactgcaacatgggggactggccttcttgtacatacacaggagtgacccagcataatcatgctgcatttgtaaacttgctcaacattgaaactgattacacaaaaaccttccacttccactctaaaagagtcacagcacatggtgacacaccacaattggacttaaaagcaaggccgacctacggtgcaggagagatcactgtgctggttgaggttgctgacatggagttgcataccaagaaagttgagatatcgggcttgaaatttgcaagtctggcttgcacaggttgctatgcctgtagctctggtatctcctgtaaagtcaggattcatgtagatgaaccagatgagctcacagtgcatgtaaagagcagtgatccagatgtggttgcagctggcacaagcctcatggcaaggaagcttgaatttgggacagacagcacattcaaggccttttcagctatgcccaaaacctctttatgtttttacattgtggagaaagaatactgcaagagctgcagtgaagatgatacaaaaaaatgtgttgacacaaaacttgagcagccacagagcatactaattgagcacagagggacgataattggaaagcagaatgatacttgcacagccaaggcaagctgttggctagagtcagtcaagagttttttttatggattgaagaatatgcttggcagtgtttttggtaattttttcataggtattttgttattccttgccccttttgtcctgttggtgcttttctttatgtttggatggaaaatcttgttttgctttaaatgttgcaggaggaccagaggcttgtttaagtatagacacctcaaagacgatgaggaaacaggctacagaaggattattgaaaggctgaacaacaaaaaagggaaaaatagactgcttgatggtgaaaggttggctgataggaaaattgccgagctgttttccacaaaaacacacattggc

SEQ ID NO: 4040 - RNA, 1932 nt, synthetic construct
  misc_feature 1..1932: note = derived and/or modified CDS sequence (wt) from CCHFV(YL04057)__FJ562094.1__Gc
  source 1..1932: mol_type = other RNA
ttcctggatagcatagccaagggaaagaaaagcctgttgaactccacaagcttagaaactagtctgtcaattgaagctccgtggggagcaatcaatgttcagtcaactttcaaaccaacagtttcagctgctaacatagcacttagctggagttcagttgaacacaggggcaacaaaattttagtttcaggtagatcagagtcaatcatgaaattagaagaaagaacaggagtcagctggaatctgggtgtagaagatgcttctgagtcaaagacgctcactgtttccgtcatggacctgtcacaaatgtactctcctgtttttgagtacttgtcaggtgacagacaagtggaggaatggccaaaggcaacttgcacaggtgactgtccagagagatgcggctgcacttcgtcaacctgcttacataaagagtggccacattcaagaaactggcgatgtagtcctacctggtgttggggggtggggactggctgcacttgctgtgggctggatgttaaggatttttttactgactacatgctggtaaaatggaaagtggaatatataaagacagaagctatagtgtgtgtcgagctgactagtcaagagaggcagtgtagtttaattgaagcaggcacaagatttaacctaggccctgtaacaataacactatcagagccaagaaatgtccagcagaggcttcctcccgaaattgtaacactgcatcctaaaatagaggaaggtttttttgatttgatgcatgtacaaaaaatactgtctgcaagcacagtttgcaagctacagagctgcacacacggtgtgccgggcgattttcaggtctaccatgtcggtaacctgctgaggggagacaaggttaatggacactcaattcacaagatagaaccacattttaatacttcatggatgtcatgggatggttgcgatctggactatttctgcaatatgggggactggccttcatgcacatacactggagtaacacagcataaccgtgctgcatttatcaacatgctcaacattgagactgactatacaaaaactttccactttcattcgaagagggtcacggcacatggagatactccccagctagacctgaaagcgagaccggcatatggtgctggcgaggtcactgttctagtggaggttgcagacttggagttgcacacaaagaaacttgaagtgtcaggtttgaaaattgcaagtttgacctgctctgggtgttatgcctgcagctctggcatctcctgcaaagttagaatccatgtaaatgaaccagatgaattcacagtacatgtaagaagtagcgacccagatgttgtagcagcaggatcaagtcttatggcaaggaaaatagagtttggggctgacagtacattcaaggccttttcatcaatgcccaaggactccttatgcttttacatagtagaaaaggattactgcagcagctgcaccgacgatgacacacaaaagtgtgtcaacacgaagcttgaccatccacagagcatactcattgagcacaaaggaacaataattggcaagcaaaatgacacttgttcgaccaagacaagctgctggctagaatcagttaagggttttttctatgggctcaaaaacatgctgagtggcatctttggaaatgtttttttaggcatcctcttattccttgctccttttgtactactgatattttttttcttttttgggtggaggcttctgttttgtctcaaatgttgcagaagaactagaggactgttgaaatataagcaccttaaggacgaagaggaggctggatacaaaaaaatcattgaaaggctaaatggcaaaaaaggtaaaagtcaattgtttgatggtgaaaggcttgcagacaggaagattgctgagcttttttctactaaaattcacataggt

SEQ ID NO: 4041 - RNA, 1932 nt, synthetic construct
  misc_feature 1..1932: note = derived and/or modified CDS sequence (wt) from CCHFV(V42/81)__GU477490.1__Gc
  source 1..1932: mol_type = other RNA
ttcttagacagtatagttaaaggtaagaaaaatttgttaaactcaacaagtttggaaacaagcttatcaattgaagcaccatggggagcaataaatatccagtcaacctttaaaccaacagtatcggctgcaaacatagcactcagttggagctcagtggagcacagaggcaacaagatcttagtctcaggcaggtctgaatcaattatgaaactagaggaaagaacaggagtcagctggaatctaggtgtagaagatgcctctgaatccaaattacttaccgtctctatcatggatttgtcacaaatgtattcccctgtttttgagtacttgtcaggagacagacaggttgaagaatggcctaaagcaacttgtacaggtgactgcccagaaaggtgtggttgcacatcatcaacctgcttgcataaagaatggcctcactcaagaaactggagatgcaatcctacttggtgctggggggtaggaaccggctgcacctgctgcggagtggatgtaaaagacctttttatagatcacatgtttgttaaatggaaggttgaatatataaaaactgaagccatagtatgtgttgagctcaccagccaagaaagacagtgcagtctgattgaggcaggtactagattcaacttgggccctgtgactattaccctatccgagccaagaaacattcagcagaagcttccccctgagattatcacgttgcaccccaaaattgaagaaggcttctttgacttgatgcatgtacaaaaagtgttgtctgccagtacagtgtgtaaactgcaaagttgcacacatggtataccaggagatctgcaagtctaccacattggcaacctattgaaaggggatagagtaaacgggcatctaattcacaaaatcgaaccacattttaacacctcttggatgtcctgggatggttgtgacctagactactactgcaacatgggggattggccttcttgcacatacacaggagtgacccagcacaatcatgctgcatttgtaaacttgcttaacattgaaactgattacacgaaaactttccacttccactctaaaagagttacagcacatggtgaaacaccacaattagacttaaaagcaaggccggcatacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgaaccagatgagctcacagtacatgtgaagagcaatgatccagatgtggttgcagctagcacaagtctcatggcaaggaagcttgaatctgggacagacagcacatttaaggccttttcagctatgcccaaaacctctttatgtttttacattgtggagagagaatactgcaagagctgcagtgaagatgatacacagaaatgtgttgaaacaaaacttgaacagccacaaagcatactaattgaacacaaaggaacgataattggaaagcagaatgatacttgcacagccaaggcaagctgttggctggaatcagtcaagagttttttttatggattgaagaacatgcttggcagtgtttttggtaattttttcataggcattttgttattccttgccccctttgtcctgttagtacttttctttatgtttggatggaaaatcttgttttgctttaaatgttgcaggaggaccagaggcttgtttaagtatagacacctcaaagaagatgaggaaacaggctacagaaggattattgagagactgaacagcaaaaaagggaaaaacagactgcttgatggtgaaaggttggctgataggaaaattgctgagctgttctctacaaaaacacacattggc

SEQ ID NO: 4042 - RNA, 1932 nt, synthetic construct
  misc_feature 1..1932: note = derived and/or modified CDS sequence (wt) from CCHFV(79121M18)__GU477493.1__Gc
  source 1..1932: mol_type = other RNA
ttcctggatagcacagccaagggaatgaaaagcctgttgaactccacgagcttagaaacaagtctgtcaattgaagctccgtggggagcaatcaatgtccagtcaactttcaaaccaacagtttcagctgctaacatagcacttagctggagttcagttgaacacaggggcaacaaaattttagtttcaggtagatcagagtcaatcatgaaattagaagaaagaacaggagtcagctggaatctgggtgtagaagatgcttctgagtcaaagacgcttactgtttccgtcatggacctgtcacaaatgtactctcctgtttttgagtacttgtcaggtgacagacaagtggaggaatggccaaaggcaacttgcacaggtgactgtccagagagatgcggctgcacttcgtcaacctgcttacataaagagtggccacattcaagaaactggcgatgtaatcctacctggtgttggggggtggggactggctgcacttgctgtgggctggatgtaaaggatttttttactgactacatgctggtaaaatggaaagtggaatatataaagacagaagctatagtgtgtgtcgagctgactagtcaagagaggcagtgtagtttaattgaagcaggcacaagatttaacctaggccctgtaacaataaccctatcagagccaagaaatgtccagcagaggcttcctcccgaaattgtaacactgcatcctaaaatagaggaaggtttttttgatttgatgcatgtacaaaaaatactgtctgcaagcacagtttgcaagctacagagctgcacacacggtgtgccgggcgattttcagatctaccatgtcggtaacctgctgaggggagacaaggttaatggacactcaattcacaagatagaaccacattttaatacttcatggatgtcatgggatggttgcgatctggactatttctgcaatatgggggactggccttcatgcacatacactggagtgacacagcataaccgtgctgcatttatcaacatgctcaacattgagactgactatacaaaaactttccactttcattcgaagagggtcacggcacatggagatactccccagctagacctaaaagcgagaccggcatatggtgctggcgaggtcactgttctagtggaggttgcagacttggagttgcacacaaagaaacttgaagtgtcaggtttgaaaattgcaagtttgacctgctctgggtgttatgcctgcagctctggcatctcctgcaaagttagaatccatgtaaatgaaccagatgaatttacagtacatgtaagaagtagcgacccagatgttgtagcagcaggatcaagtcttatggcaaggaaaatagagtttggggctgacagtacattcaaggccttttcatcaatgcccaaggactccttatgcttttacatagtagaaaaggattactgcagcagctgcaccgacgatgacacacaaaagtgtgtcaacacgaagcttgaccatccacagagcatactcattgagcacaaaggaacaataattggcaagcaaaatgacacttgttcgaccaagacaagctgctggctagaatcagttaagggttttttctatgggctaaaaaacatgctaagtggcatctttggaaatgtttttttaggcatcttcttattccttgctccttttgtgctactgatattttttttcttttttgggtggaggcttctgttttgtctcaaatgttgcagaagaactagaggactgttgaaatacaagcaccttaaggatgaagaggaggctggatacaaaaaaatcattgaaaggctaaatggcaaaaaaggtaaaagtcaattgtttgatggtgaaaggcttgcagacaggaagattgctgagcttttttctactaaaattcacataggt

SEQ ID NO: 4043 - RNA, 1932 nt, synthetic construct
  misc_feature 1..1932: note = derived and/or modified CDS sequence (wt) from CCHFV(Afg09-2990)__HM452306.1__Gc
  source 1..1932: mol_type = other RNA
tttctagatagtatagtcaaaggtatgaaaaatctgctaaactcaacaagtctagaaacaagcttatcaatagaggcaccgtggggagcaattaatgttcagtcaacctacaaaccaactgtatcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagttatggacttgtctcagatgtactctcctgtcttcgagtacttatcaggtgacagacaagtggaagagtggcctaaagcaacctgtacaggtgactgcccagaaagatgtggctgcacatcatcaacctgcttacacaaagagtggccccactcaaggaattggagatgtaatcctacttggtgctggggtgtagggactggctgcacctgttgtggtttagatgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagaaccaaggaacattcaacaaaagctccctcctgaaataattacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacctgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacaactagatctgaaagcaaggccaacctatggtgcaggtgagatcaccgtgctggtggaagttgctgacatggagttacacacaaagaagattgaaatatcaggcttaaaatttgcaggcctaacttgcacaggttgttatgcttgtagttctggcatctcttgtaaagttagaattcatgtagatgaaccagatgaacttacagtacatgttaaaagtgatgacccagatgtagttgcagctagctcaagtctcatggcgaggaagcttgaatttggaacagacagtacatttaaagctttctcagccatgcctaaaacctccctatgtttctacattgtggaaagagaatactgtaagagctgcagtaaagaagatacacaaaaatgtgttaacacgaaactcgaacaaccacagagcattttgatcgaacataagggaactataattggaaagcaaaacaatacttgcacggctaaagcgagttgctggttagagtcagttaagagtttcttttatggtctgaagaatatgctcggtggcatatttggcaatgtttttataggcattttcacatttcttaccccctttatcttgttaatacttttctttatgtttgggtggaggatcctgttttgcttcaagtgttgcagaagaaccagaggcctattcaagtacagacacctcaaagacgatgaagaaactggttacagaaagatcattgaaagactgaacaacaaaaaaggaaaaaacaggctgcttgatggtgaaagacttgctgacagaaagattgctgaactgttctccacaaaaacacacattggc

SEQ ID NO: 4044 - RNA, 1932 nt, synthetic construct
  misc_feature 1..1932: note = derived and/or modified CDS sequence (wt) from CCHFV(Sudan Al-Fulah 3-2008)__HQ378184.1__Gc
  source 1..1932: mol_type = other RNA
ttcctagacagtatagttaaaggcatgaaaaatctgctaaactcaacaagtttagaaacaagtctgtcaattgaggcaccatggggggcaataaatgttcagtcaacctacaagccaactgtgtcgactgcaaatatagcactcagctggagctcagtggaacacagaggcaataagatcttggtttcaggcagatcagaatcaattatgaagctggaagaaaggacagggatcagctgggatctcggcgtagaagacgcctctgagtctaaactgcttacagtctctgttatggatttgtctcagatgtactctcctgtcttcgagtacttatcaggagacagacaggtggaggagtggcccaaagcaacttgcacaggtgactgcccagaaagatgtggctgcacatcatcaacatgtctgcacaaagaatggccccactcaagaaattggagatgcaatcccacttggtgctggggtgtagggactggctgcacctgctgtggattagatgtgaaagacctttttacagattatatgtttgtcaagtggaaagttgaatacatcaagacagaggccatagtgtgtgtagaactcaccagtcaggaaaggcagtgtagcttgattgaagcaggcacaaggttcaatttaggtcctgtgaccatcacactgtcagaaccaagaaacatccaacagaagctccctcctgaaataatcacactacatcctaggattgaagaaggtttttttgacctgatgcacgttcagaaagtgttatcagcaagcacagtgtgtaagttgcagagttgcacacatggtgtaccaggagacctacaggtctaccacatcggaaatttattaaaaggggacaaggtaaatggacatctaattcataaaattgagccacacttcaacacttcctggatgtcctgggatggttgtgacctagactactactgcaacatgggagattggccttcttgcacatacacaggagtcacccaacacaatcatgcttcatttgtaaacctgctcaacattgaaactgattacacaaaaaacttccactttcactctaaaagggtcactgcacacggagacacaccacaactggatcttaaggcaagaccaacctatggtgcaggtgagattactgtactggtagaagttgctgacatggagttacacacaaagaagattgaaatatcgggcttaaaatttgcaagcttgacttgcacaggttgttatgcctgtagctctggcatctcatgcaaagttagaattcatgtagacgaaccagatgaacttacagtgcatgttaaaagtgatgatccagatgtagttgcagctagctcaagcctcatggcaagaaagcttgaatttggaacagacagtacatttaaagctttttcagccatgcctaaaacttcgctatgtttctacattgttgaaaaagaatactgcaagagctgcagtgaagaagacacaaaaaaatgtgttaacacaaaacttgagcaaccacagagcattttgatcgaacacaagggaactataatcggaaagcaaaacagcacttgcacagccaaggtgagttgctggttagagtcagccaagagttttttttatggtctaaaggacatgcttagtggcatttttggcaatgtctttataggtattttcttattccttgcccccttcgtcctgttagtgctgttctttatgtttgggtggaggatcctactttgctttagatgttgtagaagaactagaggcctgttcaagtatagacacctcaaggacgatgaagaaactggttatagaaggattattgaaagactaaacaataaaaagggaaaaaacaaactgcttgatggtgaaagacttgctgatagaaaaattgctgaactgttctccacaaaaacacacattggt

SEQ ID NO: 4045 - RNA, 1932 nt, synthetic construct
  misc_feature 1..1932: note = derived and/or modified CDS sequence (wt) from CCHFV(Sudan AB1-2009)__HQ378187.1__Gc
  source 1..1932: mol_type = other RNA
ttcttagatagtatagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatcttggcgtagaagatgcctctgagtctaaactgcttacagtctctgtcatggacttgtctcagatgtactctcctgtcttcgagtacttatcaggtgacagacaggtggaagagtggcccaaagcaacctgtacaggtgactgcccagaaagatgtggctgcacatcatcaacctgtttgcacaaagaatggcctcactcaagaaattggagatgcaatcccacctggtgctggggtgtagggactggctgcacctgttgtggattagatgtgaaggacctttttacagattacatgtttgtcaagtggaaagttgaatacatcaagacagaggccatagtgtgtgtagaacttactagtcaggaaaggcagtgtagcttgattgaagcgggcacaaggttcaatttgggtcctgtgaccatcacactgtcagaaccaagaaacatccaacaaaaactccctcctgaaataatcacactacatcctaggatcgaagaaggtttttttgacctgatgcatgtacaaaaggtgttatcggcaagcacagtgtgtaagttgcagagttgcacacatggtgtgccaggagacctacaggtctaccacatcggaaatttattaaaaggggataaggtaaatgggcatctaattcataaaattgagccacacttcaacacctcctggatgtcctgggatggttgtgacctagactactactgcaacatgggagattggccttcctgcacatacacaggggtcacccaacacaatcatgcttcatttgtaaacttactcaacattgaaactgattacacaaagaatttccactttcactctaaaagggtcactgcacacggagatacaccacaactagatcttaaggcaagaccaacctatggtgcaggtgagatcactgttctggtagaagttgctgacatggagttacatacaaagaagattgagatatcaggcttaaaatttgcaagcttgacttgcacaggttgttatgcttgcagctctggtatctcatgcaaagttagaattcatgtggatgaaccagatgaacttacagtacatgttaaaagtgatgatccagatgtggttgcagctagctcaagtctcatggcaagaaagcttgaatttggaacagacagtacatttaaagctttctcggccatgcctaaaacttctttatgtttctacattgttgaaagggaacactgtaagagctgcaatgaagaagacacaaaaaaatgtgttaacacaaaacttgagcaaccacaaagcattttgatcgaacacaagggaaccataatcggaaagcagaacagcacttgcacggctagggcgagttgctggttggagtcagtcaagagtttcttttatggcctaaagaacatgcttagtggcatttttggcaatgtctttatgggcatcttcttattccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaagactaaacaataaaaaaggaaaaaacaaactgcttgatggtgaaagacttgctgatagaagaattgccgaactgttctctacaaaaacacacattggc

SEQ ID NO: 4046 - RNA, 1932 nt, synthetic construct
  misc_feature 1..1932: note = derived and/or modified CDS sequence (wt) from CCHFV(NIVA 118595)__JN572083.1__Gc
  source 1..1932: mol_type = other RNA
tttctagatagtatagtcaaaggtatgaaaaatctgctaaactcaacaagtctagaaacaagcttatcaattgaggcaccgtggggagcaattaatgttcagtcaacctacaaaccaactgtatcagcagcaaacatagcactcagttggagctcagtggaacacagaggcaataagattttggtctcaggcagatcagaatcaattatgaagctggaagaaaggacaggaatcagctgggatctcggcgtagaagatgcctctgagtctaagctacttacagtctcagtcatggacttgtctcagatgtactctcctgtcttcgagtatttatcaggtgacagacaagtggaagagtggcctaaagcgacctgtacaggtgactgcccagaaagatgtggctgcacatcatcaacctgcttacacaaagagtggccccactcaaggaattggagatgtaatcctacttggtgctggggtgtagggactggctgcacctgctgtggattggatgtgaaagaccttttcacagattacatgttcgtcaagtggaaagttgagtacattaagacagaggccatagtatgtgtagaactaaccagtcaggaaagacagtgtagcttgattgaggcgggcacaagatttaatttaggttctgtgaccattacattgtcagaaccaaggaacattcaacaaaagctccctcctgaaataatcacactgcatcctagaattgaggaaggtttttttgacctaatgcatgtgcaaaaagtgctatcagcaagcacagtgtgtaagttacaaagctgcacacatggtgtgccaggagatctacaggtctaccacattggaaacctattaaaaggggacagagtaaacggacacctaattcacaaaattgaacaacacctcaacacttcttggatgtcctgggatggttgtgatctagactactactgcaatatgggagactggccttcttgcacatatacaggagtcacccaacataatcatgcttcatttgtaaacctgctcaacattgaaactgattacacaaaaaccttccactttcactctaaaagggttactgcacatggagacacaccacagctagatctgaaggcaaggccaacctatggtgcaggtgagatcactgtactggtggaagttgccgatatggagttacacacaaagaagattgaaatatcaggcttgaagtttgcaagcctatcctgcacaggttgttatgcttgtagttctggcatctcctgcaaagtcagaattcatgtagatgaaccagatgaacttacagtacatgttaaaagtgatgatccagatgtagttgcagctagctcaagtctcatggcaaggaagcttgaatctggaacagacagtacatttaaagctttttcagccatgcctaaaacttccttgtgcttctacattgtagagagagaatactgtaagggctgcagtaaagaagacacacaaaaatgtgttaacacgaaactcgagcaaccacagagcattttgatcgaacacaagggaactataattggaaagcaaaacaatacttgcacagctaaggcaagttgctggttagagtcagttaagagttttttttatggtctgaagaatatgcttagtggcatttttggcaatgtttttttaggcattttctcatttcttgccccctttgtcctattaatacttttctttatgtttgggtggaggatcctgttttgcttcaagtgttgcagaagaaccagaggcctattcaagtacagacacctcaaagacgatgaagaaactggttacagaaagatcattgaaagactgaacaacaaaaaggggaaaaacaaactgcttgatggtgaaaggcttgctgacagaaaaattgccgaactgttctccacaaaaacacacattggc

SEQ ID NO: 4047 - RNA, 1932 nt, synthetic construct
  misc_feature 1..1932: note = derived and/or modified CDS sequence (wt) from CCHFV(NIV 112143)__JN572085.1__Gc
  source 1..1932: mol_type = other RNA
tttctagatagtatagtcaaaggtatgaaaaatctgctaaactcaacaagtctagaaacaagcttatcaattgaggcaccgtggggagcaattaatgttcagtcaacctacaaaccaactgtatcagcagcaaacatagcactcagttggagctcagtggaacacagaggcaataagattttggtctcaggcagatcagaatcaattatgaagctggaagaaaggacaggaatcagctgggatctcggcgtagaagatgcctctgagtctaagctacttacagtctcagtcatggacttgtctcagatgtactctcctgtcttcgagtatttatcaggtgacagacaagtggaagagtggcctaaagcgacctgtacaggtgactgcccagaaagatgtggctgcacatcatcaacctgcttacacaaagagtggccccactcaaggaattggagatgtaatcctacttggtgctggggtgtagggactggctgcacctgctgtggattggatgtgaaagaccttttcacagattacatgttcgtcaagtggaaagttgagtacattaagacagaggccatagtatgtgtagaactaaccagtcaggaaagacagtgtagcttgattgaggcgggcacaagatttaatttaggttctgtgactattacattgtcagaaccaaggaacattcaacaaaagctccctcctgaaataatcacactgcatcctagaattgaggaaggtttttttgacctaatgcatgtgcaaaaagtgctatcagcaagcacagtgtgtaagttacaaagctgcacacatggtgtgccaggagatctacaggtctaccacattggaaacctattaaaaggggacagagtaaacggacacctaattcacaaaattgaacaacacctcaacacttcttggatgtcctgggatggttgtgatctagactactactgcaatatgggagactggccttcttgcacatatacaggagtcacccaacataatcatgcttcatttgtaaacctgctcaacattgaaactgattacacaaaaaccttccactttcactctaaaagggttactgcacatggagacacaccacagctagatctgaaggcaaggccaacctatggtgcaggtgagatcactgtactggtggaagttgccgatatggagttacacacaaagaagattgaaatatcaggcttgaagtttgcaagcctatcctgcacaggttgttatgcttgtagttctggcatctcctgcaaagttagaattcatgtagatgaaccagatgaacttacagtacatgttaaaagtgatgatccagatgtagttgcagctagctcaagtctcatggcaaggaagcttgaatttggaacagacagtacatttaaagctttttcagccatgcctaaaacttccttgtgcttctacattgtagagagagaatactgtaagggctgcagtaaagaagacacacaaaaatgtgttaacacgaaactcgagcaaccacagagcattttgatcgaacacaagggaactataattggaaagcaaaataatacttgcacagctaaggcaagttgctggttagagtcagttaagagttttttttatggtctgaagaatatgcttagtggcatttttggcaatgtttttttaggcattttctcatttcttgccccctttgtcctattaatacttttctttatgtttgggtggaggatcctgttttgcttcaagtgttgcagaagaaccagaggcctattcaagtacagacacctcaaagacgatgaagaaactggttacagaaagatcattgaaagactgaacaacaaaaaggggaaaaacaaactgcttgatggtgaaaggcttgctgacagaaaaattgccgaactgttctccacaaaaacacacattggc

SEQ ID NO: 4048 - RNA, 1932 nt, synthetic construct
  misc_feature 1..1932: note = derived and/or modified CDS sequence (wt) from CCHFV(SCT ex Afghanistan)__KC344856.1__Gc
  source 1..1932: mol_type = other RNA
ttcttaaacagtatagtcaagggcatgaaaaacctgctaaattcaactaacttggaaacaagcttatcaatcgaagcaccatggggagcaataaatgtccagtcaacctttaaacccactgtatcaactgcaaacatagcactcagctggagttcagtggaacacagaggtaataaaattctagtctcaggcagatcagagtcaattatgaagctagaagaaaggacaggaatcagctgggatttgggcgtagaagatgcctctgagtctaaatcgcttactgtttctgtcatggatttatcacagatgtattctcctgtcttcgagtatctgtcaggtgacagacaggtagaggagtggcctaaagcaacctgcacaggcgattgcccggagagatgtggctgcacatcatcaacctgcttacacaaggaatggccccattcaaggaattggagatgcaaccccacttggtgttggggagtcggcactggatgcacctgctgtgggctagatgtgaaagaccttttcacagattatatgtttgtcaagtggaaggttgaatacataaagacagaggccatagtgtgtgttgagctcactagccaagaaaggcagtgcagcttgattgaggcaggaacaaggttcaacttaggtcctgtgaccatcacgttgtcagagccaagaaacattcagcagaagcttcctcctgaaataatcacattgcatcctagaattgaggaaggctttttcgatctaatgcatgtacaaaaggtgctgtctgcaagtacagtgtgcaagctgcaaagctgcacacatggtgttccaggagacttgcaggtctaccacattggcaacttgttaaaaggggataagttaaacgggcatatgattcacaaaattgagccacacttcaatacctcttggatgtcctgggatggctgtgacctagactattactgtaatatgggggattggccctcttgcacatacactggggtgacccaacataaccatgctgcttttgttaacttacttaacatcgaaactgattacacaaagaacttccactttcactctaaaagagttactgcacatggagacacaccacaattggacttgaaagctagaccaacttacggtgcgggtgaaatcactgtactagtggaagttgctgacatggagttacacacaaaaaagattgatatatcaggtttgaaatttgcaagtctaacttgcgcgggttgctatgcttgtagctctggcatctcctgtaaagtcaggattcatgtagatgaacctgatgagcttacagtacatgtgaaaagtgaagatccggacattgttgcagctagcacaagcctcattgcaaggaagctcgaacttgggacagacagcacattcaaggccttctcagccatgcccaaaacctccttgtgcttctacattgtggagagagaatactgtaagagctgcagcaaagaggacacacagaaatgtgttaacacaaagcttgagcacccacaaggcattttaattgagcacaaaggaacaataatcggaaagcaaaatgacacctgcacagccaaagcaggctgctggttggagtcagtcaagagttttttttatggattgaagaacatgcttagtggcatcttcggcaacgtttttataggtattttcttattccttgctccttttgttctattgatactcttctttatgtttgggtggagactcctgttttgctttaagtgttgtagaagaaccagaggtttattcaagtacagacatctcaaggaagatgaagaatctggttatagaagaatcattgaaagattaaacaacaaaaaaggaaagaacaagctgcttgatggtgaaagactagctgatagaaggatcgctgagctgttctccacaaaaacacatattggt

SEQ ID NO: 4049 - RNA, 1932 nt, synthetic construct
  misc_feature 1..1932: note = derived and/or modified CDS sequence (wt) from CCHFV(Zahedan 2007)__KC867273.1__Gc
  source 1..1932: mol_type = other RNA
tttctagatagtatagtcaaagatatgaaaaatctgctaaactcaacaagtctagaaacaagcttatcaattgaggcaccatggggagcaattaatgttcagtcaacctacaaaccaactgtatcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagtcatggacttgtctcagatgtactctcctgtcttcgagtacttatcaggtgacagacaagtggaagagtggcctaaagcaacctgcacaggtgactgcccagaaagatgtggctgcacatcatcaacctgcttacacaaagagtggccccactcaaggaattggagatgtaatcctacttggtgctggggtgtagggactggctgcacctgttgtggtttagacgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagagccaaggaacattcaacaaaagctccctcctgaaataatcacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacttgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacaactagatctgaaggcaaggccaacctatggtgcaggtgagatcaccgtgcttgtggaagttgctgacatggagttacacacaaagaagattgaaatatcaggcttaaaatttgcaggcctaacttgcacaggttgttatgcttgtagttctggcatctcttgtaaagttagaattcatgtagatgaaccagatgaacttacagtacatgttaaaagtgatgacccagatgtagttgcagctagctcaagtctcatggcgaggaagcttgaatttggaacagacagtacatttaaagctttctcagccatgcctaaaacctccctatgtttctacattgtggaaagagaatactgtaagagctgcagtaaagaagatacacaaaaatgtgttaacacgaaactcgaacaaccacagagcattttgatcgaacataagggaactataattggaaagcaaaacaatacttgcacggctaaagcgagttgctggttagagtcagttaagagttttttttatggtctgaagaatatgctcggtggcatatttggcaatgtttttataggcattttcacatttcttaccccctttatcttgttaatatttttctttatgtttgggtggaggatcctgttttgcttcaagtgttgcagaagaaccagaggcctattcaagtacagacacctcaaagacgatgaagaaactggttacagaaagatcattgaaagactgaacaacaaaaagggaaaaaacaggctgcttgatggtgaaagacttgctgacagaaagattgctgaactgttctccacgaaaacacacattggc

SEQ ID NO: 4050 - RNA, 1932 nt, synthetic construct
  misc_feature 1..1932: note = derived and/or modified CDS sequence (wt) from CCHFV(SPU 44/08)__KJ682805.1__Gc
  source 1..1932: mol_type = other RNA
tttttggacagtattgttaaaggcatgaagaacttgctaaattcaacaagcctagaaacaagcttatcaattgaggcaccatggggggcaataaatgtccaatcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaattgctcactgtctctgtaatggacttgtcacaaatgtattctcctgtctttgagtacctatcaggtgatagacaagtggaagaatggcccaaggcaacctgcacaggagattgcccagaaagatgcggctgcacgtcatcaacctgcctacacaaggaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgaccatcacattgtcagagccaagaaacattcagcagaagctccctccagaaatagttacattgcatcctaggattgaagaaggcttctttgacttaatgcatatacaaaaagtgctatcagcaagtacagtatgtaagctacagagttgcacacatggcgtgccaggagacctacagatctaccacattggaaacttgttaaaaggagacaaggtgaacgggcacctgattcacaaaattgaaccacacttcaacacctcctggatgtcttgggacggctgtgacctagactactactgtaatatgggggattggccgtcttgctcatatactggcgtaacccaacacaatcatgctgcatttgtaaacatgctcaacatcgaaactgattatacaaaaaacttccactttcactctaagagagttacagcacatggggacacaccacaattagatttaaaagctagaccaacttatggtgcaggtgaaatcactgtgctggtagaggttgctgacatggagttgcatacaaagaaaattgagatatcaggtttgaagtttgcaagcttaacttgcacaggctgttatgcttgtagttctggcatctcctgtaaggttaggatccatgtagatgaaccagatgagcttacagtacatgtgaagagcgaggatccagacatagttgctgctagttcaagtctcatggctaggaagcttgaatttgggacagatagcacatttaaagccttttcagccatgcccaaaacctccttgtgcttttacattgtggagagggaatactgcaaaagctgtagtaaagaagacacacaaaaatgtgtcaacacaaagcttgaacaaccacaaagcattttaatcgagcacaaagggacgataatcggaaagcagaacgacacttgtacagccaaagcaagttgctggttagagtcaattaagagttttttttatggactaaagaatatgcttagtggcatttttggcaatgttttcatagggattttcttattcctcgctccttttatcatgctaatacttttcttcatgtttggatggaggatcctgttctgcttcaagtgttgcagaagaactagaggcttatttaagtatagacacctcaaagacgatgaagaaatcggttacaggaaaatcattgagaggctaaacaacaaaaaagggaaaaacaaactacttgacggtgaaagactagctgataggaagatcgctgagctgttctctacaaaaacacacattggc

SEQ ID NO: 4051 - RNA, 1932 nt, synthetic construct
  misc_feature 1..1932: note = derived and/or modified CDS sequence (wt) from CCHFV(SPU 383/87)__KJ682806.1__Gc
  source 1..1932: mol_type = other RNA
tttttggacagtattgttaagggcatgaagaacttgctaaattcaacaagcctagaaacaagcttatcaattgaggcaccatggggggcaataaatgtccagtcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaattgctcactgtctctgtaatggacttgtcacaaatgtattctcctgtctttgagtacctatcaggtgatagacaagtggaggaatggcccaaggcaacctgcacaggagattgcccagaaagatgcggctgcacgtcatcaacctgcctacacaaggaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgactatcacattgtcagagccaagaaacattcagcagaagctccctccagaaatagtcacattgcatcctaggattgaagaaggcttctttgacttaatgcatatacaaaaagtgctatcagcaagtacagtatgtaagctacagagttgcacacatggcgtgccaggagacctacagatctaccacattggaaacttgttaaaaggagacaaggtgaacgggcacctgattcacaaaattgaaccacacttcaacacctcctggatgtcttgggacggctgtgacctagactactactgtaatatgggggattggccatcttgctcatatactggcgtaacccaacacaatcatgctgcatttgtaaacatgctcaacatcgaaactgattatacaaaaaacttccactttcactctaagagagttacagcacatggagacacaccacaattagatttaaaagctagaccaacttatggtgcaggtgaaatcactgtgctggtagaggttgctgacatggagttgcatacaaagaaaattgagatatcaggtttgaagtttgcaagcttaacttgcacaggctgttatgcttgtagttctggtatctcctgtaaggttaggatccatgtagatgaaccagatgagcttacagtacatgtgaagagcgaggatccagacatagttgctgctagttcaagtctcatggctaggaagcttgaatttgggacagatagcacatttaaagccttttcagccatgcccaaaacctccttgtgcttttacattgtggagagggaatactgcaaaagctgtagtaaagaagacacacaaaaatgtgtcaacacaaagcttgaacaaccacaaagcattttaatcgagcacaaagggacgatatttggaaagcagaacgacacttgtacagccaaagcaagttgctggttagagtcagttaagagttttttttatggactaaagaatatgcttagtggcatttttggcaatgttttcataggggttttcttattcctcgctccttttatcatgctaatacttttcttcatgtttggatggaggatcctgttctgctttaagtgttgcagaagaactagaggcttatttaagtatagacacctcaaagacgatgaagaaatcggttacaggaaaatcattgagaggctaaacaacaaaaaagggaaaaacaaactgcttgacggtgaaagactagctgataggaagattgctgagctgttctctacaaaaacacacattggc

SEQ ID NO: 4052 - RNA, 1932 nt, synthetic construct
  misc_feature 1..1932: note = derived and/or modified CDS sequence (wt) from CCHFV(SPU 130/89)__KJ682807.1__Gc
  source 1..1932: mol_type = other RNA
tctttggacagtattgttaaaggcatgaagaacttgctaaattcaacaagcctagaaacaagcttatcaattgaggcaccatggggggcaataaatgtccagtcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaattgctcactgtctctgtaatggacttgtcacaaatgtattctcctgtctttgagtacctatcaggtgatagacaagtggaggaatggcccaaggcaacctgtacaggagattgcccagaaagatgcggctgcacgtcatcaacctgcctacacaaagaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgaccatcacattgtcagagccaagaaacattcagcagaagctccctccagaaatagtcacattgcatcctaggattgaagaaggcttctttgacttaatgcatatacaaaaagtgctatcagcaagtacagtatgtaagctacagagttgcacacatggcgtgccaggagacctacagatctaccacattggaaacttgttaaaaggagacaaggtgaacgggcacctgattcacaaaattgaaccacacttcaacacctcctggatgtcttgggacggctgtgacctagactactactgtaatatgggggattggccatcttgctcatacactggcgtaacccaacacaaccatgctgcatttgtaaacatgctcaacatcgaaactgattatacaaaaaacttccactttcactctaagagagttacagcacatggggacacaccacaattagatttaaaagctagaccaacttatggtgcaggtgaaatcactgtgctggtagaggttgctgacatggagttgcatacaaagaaagttgagatatcaggtttgaagtttgcaagcttaacttgcacaggctgttatgcttgtagttctggtatctcctgtaaggtcaggatccatgtagatgaaccagatgagcttacagtacatgtgaagagcgaggatccagacatagttgctgctagttcaagtctcatggctaggaagcttgaatttgggacagatagcacatttaaagccttttcagccatgcccaaaacctccttgtgcttttacattgtggagagggaacactgcaaaagctgtagtaaagaagacacacaaagatgtgtcaacacaaagcttgaacaaccacaaagcattttaatcgagcacaaagggacgataattggaaagcagaacgacacttgtacagccaaagcaagttgctggttagagtcaattaagagttttttttatggactaaagaatatgcttagtggcatttttggcaatgttttcataggggttttcttattcctcgctccttttatcatactaatacttttcttcatgtttggatggaggatcctgttctgctttaagtgttgcagaagaactagaggcttacttaagtatagacacctcaaagacgatgaggaaatcggttacaggaaaatcattgagaggctaaacaacaaaaaagggaaaaacaaactgcttgacggtgaaagactagctgataggaagatcgctgagctgttctctacaaaaacacacattggc

SEQ ID NO: 4053 - RNA, 1932 nt, synthetic construct
  misc_feature 1..1932: note = derived and/or modified CDS sequence (wt) from CCHFV(SPU 497/88)__KJ682808.1__Gc
  source 1..1932: mol_type = other RNA
tttttggacagtattgttaaaggcatgaggaacttgctaaattcaacaagcctagaaacaagcttatcaattgaggcaccatggggggcaataaatgtccagtcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaactgctcactgtctctgttatggacttgtcacaaatgtattctcctgtctttgaatacctatcaggtgatagacaagtggaggaatggcccaaggcaacctgcacaggagattgcccagaaagatgcggctgcacgtcatcaacctgcctacacaaggaatggccccattcaagaaactggagatgcaaccctacttggtgttggggagtcggcactggatgcacctgttgtgggttggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgaccatcacattgtcagaaccaaggaacattcagcaaaagctccctccagaaatagtcacattgcatcctaggattgaagaaggcttctttgacttaatgcatatacaaaaagtactatcagcaagtacagtatgtaagctacagagttgcacacatggcgtgccaggagacctacagatctaccacattggaaacttgttaaaaggagacaaggtgaacgggcacctgattcacaaaattgaaccacacttcaacacctcctggatgtcttgggacggctgtgacctagactactactgtaacatgggggattggccatcttgctcatatactggcgtaacccaacacaatcatgctgcatttgtaaacatgctcaacatcgaaactgattatacaaaaaacttccactttcactctaagagagttacagcacatggagacacaccacaattagatttaaaagctagaccaacttatggtgcaggtgaaatcactgtgctggtagaggttgctgacatggagttgcatacaaagaaaattgagatatcaggtttgaagtttgcaagcttaacttgcacaggctgttatgcttgtagttctggtatctcctgtaaggttaggatccatgtagatgaaccagatgagcttacagtacatgtgaagagcgaggatccagacatagttgctgctagttcaagtctcatggctaggaagcttgaatttgggacagatagcacatttaaagccttttcagccatgcccaaaacctccttgtgcttttacattgtggagagggaatactgcaaaagctgtagtaaagaagacacacaaaaatgtgtcaacacaaagcttgaacaaccacaaagcattttaatcgagcacaaagggacgataattggaaaacagaacgacacttgtacagccagagcaagttgctggttagagtcaatcaagagttttttttatggactgaagaatatgcttagtggcatttttggcaatgttttcatagggattttcttattcttcgctccttttatcatgctaatacttttctttatgtttggatggaggatcctgttctgctttaagtgttgcagaagaactagaggcttgtttaagtatagacacctcaaagacgatgaagaagtcggttacaggaaaatcattgagaggctaaacaacaaaaaagggaaaaacaaactgcttgacggtgaaagactagctgataggaagatcgctgagctgttctctacaaaaacacacattggc

SEQ ID NO: 4054 - RNA, 1932 nt, synthetic construct
  misc_feature 1..1932: note = derived and/or modified CDS sequence (wt) from CCHFV(SPU 18/88)__KJ682810.1__Gc
  source 1..1932: mol_type = other RNA
tttttggacagtattgttaaaggcaagaagaacttgctaaattcaacaagcctagaaacaagcttatcaattgaggcaccatggggggcaataaatgtccagtcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaattgctcactgtctctgttatggacttgtcacaaatgtattctcctgtctttgagtacctatcaggtgatagacaagtggaggaatggcccaaggcaacctgcacaggagattgcccagagagatgcggctgcacgtcatcaacctgcctacacaaggaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgaccatcacattgtcagagccaagaaacattcagcaaaagctccctccagaaatagtcacattgcatcctaggattgaagaaggcttctttgacttaatgcatatacaaaaagtgctatcagcaagtacagtatgcaagctacagagttgcacacatggcgtgccaggagacctacagatctaccacattggaaacttgttaaaaggagacaaggtgaacgggcacctgattcacaaaattgaaccacacttcaacacttcctggatgtcttgggacggctgtgacctagactactactgtaatatgggggattggccatcttgctcatatactggcgtaacccaacacaatcatgctgcatttgtaaacatgctcaacatcgaaactgattatacaaaaaacttccactttcactctaagagagttacagcacatggagacacaccacaattagatttaaaagctagaccaacttatggtgcaggtgaaatcactgtgctggtagaggttgcagacatggagttgcatacaaagaaaattgagatatcaggtttgaagtttgcaagcttaacttgcacaggctgttatgcttgtagttctggtatctcctgtaaggttaggatccatgtagatgaaccagatgagcttacagtacatgtgaagagcgaggacccagacatagttgctgctagttcaagtctcatggctaggaagcttgaatttgggacagatagcacatttaaagccttttcagccatgcccaaaacctccttgtgcttttacattgtggagagggaatactgcaaaagctgtagtaaagaagacacacaaaaatgtgtcaacacaaagcttgaacaaccacaaagcattttaatcgagcacaaagggacgataattgggaagcagaacgacacttgtacaggcaaagcaggttgctggttagagtcaatcaagagttttttttatggactaaagaatatgcttagtggcatttttggcaatgttttcatagggattttcttattcctagctccttttatcatgctaatacttttcttcatgtttggatggaggatcctgttctgctttaagtgttgcagaagaactagaggcctatttaagtatagacacctcaaagacgatgaagaaatcggttacaggaaaatcattgagaggctaaaaaacaaaaaagggaaaaacaaactgcttgatggtgaaagactagctgataggaagatcgctgagctgttctctacaaaaacacacattggc

SEQ ID NO: 4055 - RNA, 1932 nt, synthetic construct
  misc_feature 1..1932: note = derived and/or modified CDS sequence (wt) from CCHFV(SPU 431/85)__KJ682812.1__Gc
  source 1..1932: mol_type = other RNA
tttttagacagtattgttaaaggcaggaagaacttgctaaactcaacaagcttggaaacaagcttatcaattgaggcaccatggggtgcaataaatgtccaatcaaccttcaaacccactgtgtcagctgcaaacatagcacttagctggagctcagtggaacacagaggcaacaagattttggtttcaggcaggtcagaatcaatcatgaagctggaggaaaggacaggaatcagctgggatctgggagtagaagacgcctctgagtccaaattgctcaccgtctctgtcatggacttgtcacaaatgtattcccccgtctttgagtacctgtcaggtgatagacaggtagaagagtggcccaaggcgacctgtacaggcgattgcccagaaagatgtggctgcacatcatcaacctgtttgcacaaggaatggccccattcaaggaactggagatgcaaccccacttggtgttggggggtcggcactggatgcacctgttgtgggctagatgtaaaagacctctttacagattacatgtttgtcaagtggaaagttgaatacataaaaacagaggccatagtgtgtgtcgaacttactagccaagaaaggcaatgtagcttgattgaagcaggcacaagattcaatttaggtcctgtgactatcacattatcggagccaagaaacattcagcaaaagctccctccagaaataattacattgcatcctagaattgaagaaggcttttttgacttaatgcatgtgcaaagagtgctgtcagcaagcacagtgtgcaagctacagagttgcacacatggtgtgccaggagacctacaggtctaccacatcggaaacttgttaaaaggagacaaggtaaacgggcatctgattcacaagattgaaccacatttcaacacttcctggatgtcttgggatggctgtgacctagattactactgcaatatgggggattggccttcttgcacatacactggagtaacccaacataaccatgctgcatttgtaaatttgctcaatatcgaaaccgattatacaaaaaactttcattttcactccaagagagttactgcacatggagacacaccacaattagacttgaaggccagaccaacttatggtgcaggggaggttactgtactagtggaggttgctgacatggagctgcacacaaagaaaattgagatatcaggcttgaagtttgcaagtctaacttgcacaggctgctatgcttgtagctctggtatctcctgtaaggtcaagatccatgtagatgaaccagatgagcttacagtacatgtgaagagtgaagacccagacatagttgctgcaggctcaagtctcatggcaaggaagcttgaatttggggcagatagtacattcaaagccttttcagccatgcccaaaacctccttgtgcttttatattgtggagagagaatactgtaagagctgcagtagagaggacacacgaaaatgtgttaacactaagcttgatcgaccacagagcattttgatcgaacataaaggaacgattattggaaagcaaaacaacacatgcacagctaaagcaagctgctggctagagtcagtcaaaagttttttctacggattgaagaatatgcttagtggcattttcggtaatgttttcatagggattttcttattcattgctccttttgtcctgttaatacttttctttatgtttgggtggaggatcctgttctgctttaagtgctgcagaagaaccagaggcctatttaagtacagacacctcaaggacgatgaagaaaccggttacaggaaaatcattgagaggctaaataacaaaaagggaaaaaacaaactacttgatggggaaaggctagctgataggaaaatcgccgagttattctccacaaaatcacatatcggc

SEQ ID NO: 4056 - RNA, 1932 nt, synthetic construct
  misc_feature 1..1932: note = derived and/or modified CDS sequence (wt) from CCHFV(SPU 48/90)__KJ682813.1__Gc
  source 1..1932: mol_type = other RNA
ttccgagacagtatagttaaaggcatgaaaaatctgctaaactcaacaagtttagaaacaagtctatcaattgaggcaccatggggggcaataaatgttcagtcaacctacaagccaactgtgtcgactgcaaacatagcactcagctggagctcagtggaacacagaggcaataagatcttggtttcaggcagatcagaatcaattatgaagctggaagaaaggacagggatcagctgggatctcggcgtagaagacgcctctgagtccaaactgcttacagtctctgtcatggacttgtctcagatgtactctcctgtcttcgagtacttatcaggagacagacaggtggaagagtggcccaaagcaacttgtacaggtgactgcccagaaagatgtggctgcacatcatcaacatgtttgcacaaagaatggccccactcaagaaattggagatgcaatcctacttggtgctggggtgtagggactggctgcacctgttgtggattagatgtgaaagacctttttacagattatatgtttgtcaagtggaaagttgaatacatcaagacagaggccatagtgtgtgtagaacttaccagtcaggaaaggcagtgtagcttgattgaagcgggcacaaggttcaatttaggtcctgtgaccatcacactgtcagaaccaagaaacatccaacagaagctccctcctgaaataatcacactacatcctaggattgaagaaggtttttttgacctgatgcacgttcagaaagtgttatcagcaagcacagtgtgtaagttgcagagttgcacacatggtgtaccaggagacctacaggtctaccacatcggaaatttattaaaaggggacaaggtaaatggacatctaattcataaaattgagccacacttcaacacttcctggatgtcctgggatggttgtgacctagactactactgcaacatgggagattggccttcttgcacatacacaggagtcacccaacacaatcgtgcttcatttgtaaacctgctcaacattgaaactgattacacaaaaaacttccattttcactctaaaagggtcactgcacacggagacacaccacaactggatcttaaggcaagaccaacctatggtgcaggtgagattactgtactggtagaagttgctgacatggagttacacacaaagaagattgaaatatcaggcttaaaatttgcaagcttgacttgcacaggttgttatgcttgtagctctggcatctcatgcaaagttagaattcatgtggacgaaccagatgaacttacagtgcatgttaaaagtgatgatccagatgtagttgcagctagctcaagcctcatggcaagaaagcttgaatttggaacagacagcacatttaaagctttctcagccatgcctaaaacttcgctatgtttctacattgttgaaaaagaatactgcaagagctgcagtgaagaagacacaaaaaaatgtgttaacacaaaacttgagcaaccacaaagcattttgatcgaacacaagggaactataatcggaaagcaaaacagcacttgcacagccaaagtgagttgctggttagagtcagccaagagttttttttatggtctaaaggacatgcttagtggcatttttggcaatgtctttataggtattttcttgttccttgcccccttcatcctgttaatactattctttatgtttgggtggaggatcctactttgctttaaatgttgtagaagaactagaggcctgttcaagtatagacacctcaaggacgatgaagaaactggttatagaaggattattgaaagactaaacaataaaaaaggaaaaaacaaattgcttgatggtgaaagacttgctgatagaagaattgctgaactgttctccacaaaaacacacattggc

SEQ ID NO: 4057 - RNA, 1932 nt, synthetic construct
  misc_feature 1..1932: note = derived and/or modified CDS sequence (wt) from CCHFV(SPU 187/90)__KJ682814.1__Gc
  source 1..1932: mol_type = other RNA
ttcctagatagtatagttaaaggtatgaaaaatctgctaaattcaacaagtttagaaacaagtttatcaattgaggcaccatggggggcaataaatgttcagtcaacctacaaaccaactgtgtcaactgcaaacatagcactcagttggagctctgtggaacacagaggcaataagatcttggtttcaggcagatcagaatcaattatgaagctggaagaaaggacaggaatcagctgggacctcggcgtggaagacgcctctgagtctaaactgcttacagtctctgtcatggacttgtctcagatgtactctcctgtcttcgagtacttatcaggagacagacaggtggaagagtggcccaaggcaacttgtacaggtgactgcccagaaagatgtggctgcacatcatcaacatgtttacacaaagaatggccccactcaagaaattggaggtgcaatcccacttggtgctggggtgtagggactggctgcacctgttgtggattagatgtgaaggacctttttacagattatatgtttgtcaagtggaaagttgaatatattaagacagaagccatagtgtgtgtagaacttaccagtcaggaaaggcagtgtagcttgattgaagcaggcacaaggttcaatttaggtcctgtaaccatcacactgtcagaaccacgaaacatccaacagaagctccctcctgaaataatcacactgcatcccaggatcgaagaaggtttttttgacctgatgcatgtacagaaagtgttatcggcaagcacagtgtgtaagttgcagagttgcacacatggtgtgccaggagacctacaggtctaccacatcgggaatttattaaaaggggataaggtgaatggacatctaattcataaaattgagccacacttcaacacttcctggatgtcctgggatggttgtgacctagactactactgcaacatgggagattggccttcttgcacatacacaggagtcacccaacacaatcatgcttcatttgtaaacctgctcaacattgaaactgattacacaaaaaacttccactttcactctaaaagggtcactgcacacggagacacaccacaactagatcttaaggcaagaccaacctatggtgcaggtgagatcactgtactggtagaagttgctgacatggagttacacacaaagaagattgaaatatcaggcttaaaatttgcaagcttgacttgcacaggctgttatgcttgtagctctggcatctcatgcaaagttagaattcatgtggatgaaccagatgaacttacagtacatgttaaaagtgatgatccagatgtagttgcagctagctcaagtctcatggcaagaaagcttgaatttggaacagacagtatatttaaagctttctcagccatgcctaaaacttctctatgtttctacattgttgaaagagaacactgtaagagctgcagcgaagaagacactaaaaaatgtgttaacacaaaacttgagcaaccacaaagcattttgatcgaacacaagggaactataatcggaaagcaaaacagcacttgcacagccaagacgagttgctggttagagtcagtcaaaagttttttttatggtctaaagaacatgcttagtggcatttttggaaatgtttttataggtattttcttgttccttgcccccttcatcctgttaatactgttctttatgtttgggtggaggatcctattttgctttaaatgttgcagaagaactagaggcctgttcaagtatagacacttaaaggacgatgaagaaactggttatagaaggattattgaaagattaaacaataaaaaaggaaaaaacaaactgcttgatggtgaaagacttgctgatagaagaattgccgaactgttctctacaaaaacacacattggc

SEQ ID NO: 4058 - RNA, 1932 nt, synthetic construct
  misc_feature 1..1932: note = derived and/or modified CDS sequence (wt) from CCHFV(Haskovo-V46/13)__KR092379.1__Gc
  source 1..1932: mol_type = other RNA
ttcttagacagtatagttaaaggtatgaaaaatttgctaaactcaacaagcttggaaacaagcttatcaattgaggcaccatggggagcaataaatgtccagtcaacctttaaaccaacagtatcgactgcaaacatagcactcagttggagctcagtggagcacagaggcaacaagatcttagtcacaggcaggtctgaatcaatcatgaaactagaggaaaggacaggagtcagctgggatctaggcgtagaagatgcctcagaatccaaattacttaccgtttctatcatggatttatcacaaatgtattcccctgtttttgagtacttgtcaggggacagacaggttgaagaatggccaaaagcaacttgtacaggtgattgcccagaaaggtgtggctgcacatcatcaacctgcttacataaagaatggcctcactcaagaaactggagatgcaatcccacttggtgctggggagtaggaaccggctgcacctgttgcggggtggatgtaaaagacctttttacggatcacatgttcgtcaaatggaaagttgaatacataaaaactgaagccatagtatgtgttgagctcaccagccaagaaagacagtgcagtctgattgaggcaggtactagattcaacttgggccctgtgactattaccctgtctgagccaagaaacattcagcagaagcttccccctgaaattatcacgttgcatcccaaaattgaagaaggcttctttgacttgatgcatgtacaaaaagtgttgtctgcaagtacagtgtgtaaactgcagagttgcacacatggtataccaggagatctacaagtttaccacattggcaacttgttgaaaggggatagagtaaacgggcatctaattcacaaaattgaaccacatttcaacacctcttggatgtcctgggatggttgtgatttagattactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattggacttaaaagcaaggccgacctacggtgcaggtgagatcactgtgctggttgaggttgctgacatggagttgcataccaagaaagttgaaatatcaggcttgaaatttgcaagtttgacttgcacgggttgctatgcttgtagctctggcatctcctgcaaagttaggattcatgtagatgaaccagatgagcttacagtacatgtaaagagcagtgatcctgatgtggttgcagctggcacaagtcttatggcgaggaagcttgaatttggaacagacagcacattcaaggccttttcagctatgcccaaaacctctttatgtttttacattgtggagagagaatactgcaagagctgcagtgaagatgatacacaaaaatgtgttgacacaaaacttgagcagccacagagcatactaattgagcacaaaggaacaataattggaaagcagaatgatacttgcacagccagggcaagctgttggctagagtcagtcaagagttttttttatggattgaagaatatgcttggcagtgtttttggtaattttttaataggcattttgttattccttgccccttttgtcctgttggtgcttttctttatgtttgggtggaaaatcttgttttgctttaaatgttgcaggaggaccagaggcttattcaaatatagacacctcaaagacgatgaggaaacaggctacagaaggattattgaaagactgaacagcaaaaaagggaaaaacagactgcttgatggtgaaaggctggctgataggaaaattgctgagctgttctccacaaaaacacacattggc

SEQ ID NO: 4059 - RNA, 1932 nt, synthetic construct
  misc_feature 1..1932: note = derived and/or modified CDS sequence (wt) from CCHFV(24-R-2012)__KR814856.1__Gc
  source 1..1932: mol_type = other RNA
ttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacttgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 4060 - RNA, 1932 nt, synthetic construct
  misc_feature 1..1932: note = derived and/or modified CDS sequence (wt) from CCHFV(36-ST-2014)__KR814857.1__Gc
  source 1..1932: mol_type = other RNA
ttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccattctaaaagagtcacagcacatggagacacaccacaattagacttaaaagcaaggccgacttacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgatcagccacagagcatactaattgagcacaaagggaccataattggaaagcagaatgacacttgcacagccaaggcaagttgttggctagagtcagtcaagagttttttttatggattgaagaatatgcttggcagtgtttttggtaattttttcgtaggcattttgttattccttgccccctttgtcttgttggtgcttttctttatgtgtggatggaaattcttgttttgctttaagtgttgcaggaggaccagaggcttgtttaagtatagacacctcaaagatgatgaggaaacaggctacagaaggattattgaaagactgaacagcaaaaaaggaaagaacagactgcttgatggtgagaggttggctgataggaaaattgctgagctgttctctacaaaatcacacattggc

SEQ ID NO: 4061 - RNA, 1932 nt, synthetic construct
  misc_feature 1..1932: note = derived and/or modified CDS sequence (wt) from CCHFV(37-R-2013)__KR814858.1__Gc
  source 1..1932: mol_type = other RNA
ttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagatgatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacttgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgttacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 4062 - RNA, 1932 nt, synthetic construct
  misc_feature 1..1932: note = derived and/or modified CDS sequence (wt) from CCHFV(44-ST-2010)__KR814859.1__Gc
  source 1..1932: mol_type = other RNA
ttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccattctaaaagagtcacagcacatggagacacaccacaattagacttaaaagcaaggccgacttacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgatcagccacagagcatactaattgagcacaaagggaccataattggaaagcagaatgacacttgcacagccaaggcaagttgttggctagagtcagtcaagagttttttttatggattgaagaatatgcttggcagtgtttttggtaattttttcgtaggcattttgttattccttgccccctttgtcttgttggtgcttttctttatgtgtggatggaaaatcttgttttgctttaagtgttgcaggaggaccagaggcttgtttaagtatagacacctcaaagatgatgaggaaacaggctacagaaggattattgaaagactgaacagcaaaaaaggaaagaacagactgcttgatggtgagaggttggctgataggaaaattgctgagctgttctctacaaaatcacacattggc

SEQ ID NO: 4063 - RNA, 1932 nt, synthetic construct
  misc_feature 1..1932: note = derived and/or modified CDS sequence (wt) from CCHFV(46-ST-2012)__KR814860.1__Gc
  source 1..1932: mol_type = other RNA
ttcttagacagtatagttaaaggcatgaaaaatttgctaaactcaacaagcttagaaacaagcttatcaatcgaggcaccatggggagcaataaatgtccagtcaacctttaaaccaacagtatcgactgcaaacatagcactcagttggagctcagtggagcacagaggcaacaagatcttagtcacaggcaggtctgaatcaattatgaaactggaggaaaggacaggagtcagctgggatctaggcgtagaggatgcctctgaatccaaattacttaccgtctctatcatggatctgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaagtggaaggttgaatatataaaaactgaagccatagtatgtgttgagctcaccagccaagaaagacagtgcagtctgattgaggcaggtaccagattcaacttgggccctgtgactattaccctgtctgagccaagaaacatacagcagaagcttccccctgagattatcacattgcatcccaaagttgaagagggcttctttgacttgatgcatgtgcaaaaagtgttgtctgcaagtacagtgtgtaaactgcagagttgcacacacggtataccaggagatctacaagtttaccacattggcaacttactgaaaggagataggataaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcacaccaaaaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagccagcacaagtctcatggcgaggaagcttgagtttgggacagacagtaccttcaaggccttttcagctatgcccaaaacctctttatgtttttacattgtggagagagaatactgtaagagctgcagtgaagaggacacacaaaaatgtgttgacacaagacttgagcagccgcagagcatactaattgagcacaaaggaacgataattggaaagcagaatgatacttgcacagccaaggcaagctgttggttagagtcagtcaagagttttttttatggattgaagaatatgcttggtagtgtctttggtaattttttcataggcattctgttattccttgccccttttgtcctgttggtgcttttctttatgtttgggtggaaaatcttgttttgctttaaatgttgcaggaggaccagaggcttacttaagtatagacacctcaaagacgatgaggaaacaggctacagaaggattattgaaagactgaacaacaaaaaagggaaaaacagactgcttgatggtgaaaggttggctgataggaagattgctgagctgttctccacaaaaacacacattggt

SEQ ID NO: 4064 - RNA, 1932 nt, synthetic construct
  misc_feature 1..1932: note = derived and/or modified CDS sequence (wt) from CCHFV(47-ST-2013)__KR814861.1__Gc
  source 1..1932: mol_type = other RNA
ttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcctggtcacaggcaggtctgaatcaattatgaaactagaggaaaggacaggagtcagctgggatctaggtgtagaagatgcctctgaatccaaattacttaccgtctctatcatggatttgtcacaaatgtattcccctgtttttgagtacttatcaggagatagacaggttgaagaatggcccaaggcaacctgcacaggtgaatgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttaggtcctgtgactatcaccctgtctgagccaagaaacattcagcagaagcttccccctgagatcattacgctgcatcccaaaattgaagaaggcttctttgacttgatgcatgtacaaaaagtgttatctgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactactgcaacatgggggattggccttcttgcacatacacaggagtgacccaacataatcatgctgcatttgtaaacttgcttaacattgaaactgattacacaaaaaccttccacttccactctaaaagagtcacagcacatggagacacaccacaattagacttaaaagcaaggccgacctacggtgcaggtgagatcaccgtgctggttgaggttgctgacatggagttgcataccaagaaagttgaggtatcaggcttgaaatttgcaagtctggcttgcacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagtacattcaaggcattttcagctatgcctaaaacctctttatgcttttacattgtggagagggaatactgcaaaagctgcagtgaagatgatacaaaaaaatgtgttgacacaaaacttgaacagccacagagcatactaattgagcacaaagggacaataattggaaagcagaatgatacttgcacagccaaggcaagttgttggctagagtcagtcaagagttttttttatggattgaagaatatgcttggcagtgtttttggtaatttttttgtaggcattttgttattccttgccccttttgtcttgttggtgcttttctttatgtttggatggaaaatcttgttttgctttaagtgttgcaggaggaccagaggcttgtttaagtatagacacctcaaagatgatgaggaaacaggctacagaaggattattgaaagactgaacagcaaaaaagggaaaaacagactgcttgatggtgagaggttggctgataggaaaattgctgagctgttctctacgaaaacacacattggc

SEQ ID NO: 4065 - RNA, 1932 nt, synthetic construct
  misc_feature 1..1932: note = derived and/or modified CDS sequence (wt) from CCHFV(52-R-2014)__KR814862.1__Gc
  source 1..1932: mol_type = other RNA
ttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagatgatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacttgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaggctgttggctagagtcagtcaagagttttttttatggattgaaaaatatgcttggtagtgtatttggtaactttttcataggcattttgctattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgaactgttctccacaaaaacacacattggt

SEQ ID NO: 4066 - RNA, 1932 nt, synthetic construct
  misc_feature 1..1932: note = derived and/or modified CDS sequence (wt) from CCHFV(75-R-2012)__KR814863.1__Gc
  source 1..1932: mol_type = other RNA
ttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtccgaatcaattatgaaactggaggaaaggacaggagtcagctgggatctaggcgtagaagatgcctctgagtccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggtactggctgcacctgctgcggggtggatgtaaaagacctttttacagatcacatgtttgtcaaatggaaggttgaatatataaaaactgaagccatagtatgtgttgagctcaccagtcaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcaccgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttctttatggattgaaaaatatgcttggtagtgtatttggtaactttttcataggcattttgttattccttgccccttttgtcctgttggtgcttttctttatgtttggatggaaaatcttgttctgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 4067 - RNA, 1932 nt, synthetic construct
  misc_feature 1..1932: note = derived and/or modified CDS sequence (wt) from CCHFV(75-ST-2010)__KR814864.1__Gc
  source 1..1932: mol_type = other RNA
ttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaagtggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtacaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccaacctacggtgcaggtgagatcactgtgctggttgaggttgctgacatggagttgcataccaagaaagttgagatatcaggcctgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggcaactttttcataggcattttgttattccttgccccttttgtcctgttggtgcttttctttatgtttggatggaaaatcttgttttgcttcaaatgttgcaggagggccagaggcttgcttaagtatagacacctaaaagacgatgaggaaacaggctacagaaagattattgaaaggctgaacaacaaaaaaggaaaaaacagactgcttgatggtgaaaggttggctgataggaaaattgctgagctgttctccacaaaaacacacattggt

SEQ ID NO: 4068 - RNA, 1932 nt, synthetic construct
  misc_feature 1..1932: note = derived and/or modified CDS sequence (wt) from CCHFV(3756-ST-2007)__KR814866.1__Gc
  source 1..1932: mol_type = other RNA
ttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgttttcgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacaatgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggcataccaggagatctacaaatttaccacattggcaacttgttgaaaggggatagagtaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcggtcaagagttttttttatggattgaagaatatgcttggcagtgtttttggtagttttttcgtaggcattttgttattccttaccccttttgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaaggaaaaaacagactgcttgatggtgagaggttggctgataggaaaattgctgagctgttctctacaaaaacacacattggc

SEQ ID NO: 4069 - RNA, 1932 nt, synthetic construct
  misc_feature 1..1932: note = derived and/or modified CDS sequence (wt) from CCHFV(3809-ST-2007)__KR814867.1__Gc
  source 1..1932: mol_type = other RNA
ttcttagacagtatagtcaaaggcatgaagaatttgctaaactcaacaagcttagaaacaagcttatcaattgaagcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtggaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgtacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactatcaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatcttcaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagaaagaatactgcaggagctgcagtgaagaggacacacaaaaatgtgttgacacaaaacttgagcagccacagagcatactaattgagcacaaaggaacgataattggaaagcagaatgatacttgcacagccaaagcaagctgttggctagagtcagtcaagagttttttttatggattgaagaatatgcttggtagtgtctttggtaactttttcataggcattttgttattccttaccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaagggaaaaacagactgcttgatggtgaaaggttggctgataggaaaattgctgagctgttttccacaaaaacacacattggt

SEQ ID NO: 4070 - RNA, 1932 nt, synthetic construct
  misc_feature 1..1932: note = derived and/or modified CDS sequence (wt) from CCHFV(3820-ST-2007)__KR814868.1__Gc
  source 1..1932: mol_type = other RNA
ttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggacctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagagtaaacggccatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaaaaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtagttttttcgtaggcattttgttattccttgcccctttcgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaaggaaaaaacagactgcttgatggtgagaggttggctgataggaaaattgctgagctgttctctacaaaaacacacattggc

SEQ ID NO: 4071 - RNA, 1932 nt, synthetic construct
  misc_feature 1..1932: note = derived and/or modified CDS sequence (wt) from CCHFV(4495-ST-2008)__KR814869.1__Gc
  source 1..1932: mol_type = other RNA
ttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggaatcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaagtggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtacaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccaacctacggtgcaggtgagatcactgtgctggttgaggttgctgacatggagttgcataccaagaaagttgagatatcaggcctgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagggaatactgcaagagctgcagtgaagaggacacacaaagatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggcaactttttcataggcattttgttattccttgccccttttgtcctgttggtgcttttctttatgtttggatggaaaatcttgttttgcttcaaatgttgcaggagggccagaggcttgcttaagtatagacacctaaaagacgatgaggaaacaggctacagaaagattattgaaaggctgaacaacaaaaaaggaaaaaacagactgcttgatggtgaaaggttggctgataggaaaattgctgagctgttctccacaaaaacacacattggt

SEQ ID NO: 4072 - RNA, 1932 nt, synthetic construct
  misc_feature 1..1932: note = derived and/or modified CDS sequence (wt) from CCHFV(4691-ST-2009)__KR814871.1__Gc
  source 1..1932: mol_type = other RNA
ttcttagacagtatcgttaaaggtatgaaaaatttgctaaactcaacaagcttagaaacaagcttatcaattgaggcaccatggggagcaataaatgtccagtcaacctttaaaccagcagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacattggcaacctgttgaaaggggatagagtaaacgggcatctaattcacaaaattgaaccacattttaacacctcttggatgtcctgggatggttgtgacctagactactattgcaacatgggggattggccttcttgcacatacacaggagtgacccaacacaatcatgctgcatttgtaaacttgcttaacattgaaactgattacacgaaaaccttccacttccactctaaaagagtcacagcgcatggagacacaccacaattggacttaaaagcaaggccgacctacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcataaagggacgataattggaaagcagaatgatacttgcacagccaaggcaagttgttggctagagtcagtcaagagttttttttatggattaaagaatatgcttggcagtgtttttggtaattttttcgtaggcattttgttattccttgccccttttgtcttgttggtgctcttctttatgtttggatggaaaatcttgttttgctttaagtgttgcaggaggaccagaggcttgtttaagtatagacacctcaaagatgatgaggaaacaggctacagaaggattattgaaagactgaacagcaaaaaaggaaaaaacagactgcttgacggtgagaggttggctgataggaaaattgctgagctgttctctacaaaaacacacattggc

SEQ ID NO: 4073 - RNA, 1932 nt, synthetic construct
  misc_feature 1..1932: note = derived and/or modified CDS sequence (wt) from CCHFV(4701-ST-2009)__KR814872.1__Gc
  source 1..1932: mol_type = other RNA
ttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgtacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagagtaaacggccatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaatattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaaaaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtggttttttcgtaggcattttgttattccttgcccctttcgtcttgttggtacttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaaggaaaaaacagactgcttgatggtgagaggttggctgataggaaaattgctgagctgttctctacaaaaacacacattggc

SEQ ID NO: 4074 - RNA, 1932 nt, synthetic construct
  misc_feature 1..1932: note = derived and/or modified CDS sequence (wt) from CCHFV(Oman-199809166)__KR864901.1__Gc
  source 1..1932: mol_type = other RNA
tttttagacagtattgctaagggtatgaagaacctgctgaattcaacaagcttagaaacaagcttatcaattgaggcaccatggggagcaataaacgtccaatctactttcaaacctactgtgtcaactgcaaacatagcacttagttggagctcagtggaacacagaggtaataagatcttggtttcaggcagatcagagtcaatcatgaagctagaagaaagaacaggaatcagctgggatttgggagtagaagatgcctctgagtccaaattacttactgtttccgtcatggacttatcacagatgtactctcctgtctttgagtacctatcaggtgacagacaagtagaggaatggccaaaggcaacctgtacaggcgattgcccggaaagatgtggctgcacatcatcaacctgcctacacaaggaatggcctcactcaagaaactggagatgcaaccccacttggtgttggggagtcggcaccggatgcacctgttgtggactagatgtaaaggacctttttacagattacatgtttgttaaatggaaggtcgaatatataaaaacagaggctatagtgtgtgttgagcttactagccaagaaagacaatgtagcttgattgaggcaggcacaagattcaacttaggtcctgtgactatcacattatcagagccaagaaacattcagcaaaagctccctccagaaattgtcacattacatcctagaattgaagaaggtttttttgacttaatgcatgtacagaaggtactatcagcaagcacagtgtgcaagctacagagttgcacacatggcgtaccaggagacttacaggtctaccacatcggaaacttactaaaaggagacaaagtgaatgggcatctgatacataaagttgaaccacatttcaacacctcctggatgtcttgggacggctgtgacctagattactactgcaatatgggggattggccctcttgcacgtatactggagttacccaacataatcatgctgcatttgtaaacctacttaacattgaaactgattacacaaagaacttccactttcactctaagagagtcactgcacatggggacactccacaattagatttaaaagccagaccaaattatggtgcaggtgaaatcactgtgctggtggaagttgctgacatggagttacacacaaagaaaattgagatatcaggtttgaagtttgcaagcctaacctgcacaggttgttatgcttgtagctctggcatctcatgtaaggttaggatccatgtagatgaaccagatgagcttacagtacatgtgaagagtgaagacccagacatagttgctgctagctcaagtctcatggcaagaaagcttgaattcgggacggatagtacattcaaagccttctcagccatgcctaaaacctccttgtgcttttacattgttgagagagaatactgtaaaagctgcagtaaagaagacacacaaaagtgtgttaacgcaaagcttgagcgaccacagagcattttaattgagcacaaaggaacgataattggaaagcagaacgacacttgcacagctaaagcaagctgctggctagagtcagtcaagagtttcttttatggactaaagaacatgcttagtggcatttttggcaatgttttcatagggattttcttattccttgctccttttatcctgttaatacttttctttatgtttgggtggagaatcctattctgctttaagtgctgcaggagaactagaggcctatttaagtacagacacctcaaagatgatgaagaaaccggttataggaaaatcattgagagactaaacaacaaaaaaggtaaaaacaagctgcttgacggtgaaagattagctgatagaaagatcgctgagctgttctctacaaaaacacacattggc

SEQ ID NO: 4075 - RNA, 1932 nt, synthetic construct
  misc_feature 1..1932: note = derived and/or modified CDS sequence (wt) from CCHFV(200406546-Turkey)__KR864902.1__Gc
  source 1..1932: mol_type = other RNA
ttcttagacagtatagttaaaggcatgaaaaatttgctaaactcaacaagcttagaaacaagtttatcaattgaggcaccatggggagcaataaatgtccagtcaacctttaaaccaacagtatcgactgcaaatatagcactcagttggagctcaatagagcacaggggcaacaagatcttagtcacaggcaggtctgaatcaattatgaagctggaggaaaggacaggggtcagctgggatctaggcgtagaagatgcctctgaatctaaattactcactgtctctattatggatttgtcacaaatgtactcccctgtttttgagtacttgtcaggagacagacaggttgaggaatggcccaaagcaacgtgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtgaaagacctttttacagatcacatgtttgtcaaatggaaggttgaatatataaaaactgaagccatagtatgtgttgagctcaccagccaagaaagacagtgcagtctgattgaggcaggtactagattcaacttgggccctgtgactattaccctgtctgagccaagaaacattcagcagaagcttccccctgagattatcacgttgcatcccaaagttgaagaaggcttctttgacttgatgcatgtacaaaaagtgttgtctgcaagtacagtgtgtaaactgcaaagctgcacacatggtataccaggagatctacaagtttaccacattggcaacttgctgaaaggtgatagagtaaacgggcatctaattcacaaaattgaaccacatttcaacacctcttggatgtcctgggatggttgtgacttagactactactgcaacatgggggattggccttcttgcacatacacaggagtgacccagcataaccatgctgcatttgtaaacttgcttaacattgaaactgattacacgaaaaccttccacttccactctaaaagagtcacagcacatggtgacacaccacaattagacttaaaagcaaggccgacctacggtgcaggtgagatcactgtgctggttgaagttgctgatatggagctgcataccaagaaagttgagatatcaggcttgaaatttgcaagtctagcttgcacgggttgctatgcttgtagctctggcatctcctgtaaagtcaggattcatgtagatgagccagatgagctcacagtacatgtaaagagcagtgatcctgatgtggttgcagctagcacaagtctcacggcgaggaagcttgaatttgggacagacagcacattcaaggccttttcagctatgcccaagacctctttatgtttttacattgtggagaaagaatactgcaagagctgcaatgaagatgacacacaaaaatgtgttgacacaaagcttgagcagccacagagcatactaattgagcacaaaggaacgataattggaaagcagaatgatacttgcacagccaaggcaagctgttggctggagtcagtcaagagttttttttatggattaaagaatatgcttggtagtgtctttggtaattttttcataggcattttgttattccttgccccttttgtcctgttggtgcttttctttatgtttggatggaaaatcttgttttgctttaaatgttgcaggaggaccagaggcttatttaagtatagacacctcaaagacgatgaggaaacaggctacaaaaggattattgaaagattgaacaacaaaaaagggaaaaacagactgcttgatggtgaaaggttggctgataggaaaattgctgagctgttctccacaaaaacacacattggt

SEQ ID NO: 4076 - RNA, 1932 nt, synthetic construct
  misc_feature 1..1932: note = derived and/or modified CDS sequence (wt) from CCHFV(1-CR/HU-2015)__KU161584.1__Gc
  source 1..1932: mol_type = other RNA
ttcctagacagtatagttaaaggtatgaaaaatttgctaaactcgacaagcttagaaacaagcttatcaattgaggcaccatggggagcaataaatgtccagtcaacctttaaaccaacagtatcaactgcaaacatagcactcagttggagctcagtggagcacagaggcaacaagatcttagtcacaggcaggtctgaatcaattatgaaactagaggaaaggacaggagtcagctgggatctaggcgtagaagatgcctctgaatccaaattacttaccgtctctataatggatttatcacaaatgtattcccctgtttttgagtacttgtcaggagacagacaggttgaagagtggcccaaagcaacttgtacaggtgattgcccagaaaggtgtggctgcacatcatcaacctgcttgcataaagaatggcctcactcaagaaactggagatgtaatcccacttggtgctggggagtaggaaccggctgcacctgttgcggggtggatgtaaaagacctttttacagatcacatgtttgtcaaatggaaggttgaatatataaaaactgaagccatagtatgtgttgagctcaccagccaggaaagacagtgcagtcttattgaggcaggtacaagattcaacttaggccctgtgactatcaccctgtctgagccaagaaacattcagcagaagcttccccctgagatcattacgttgcatcccaaaattgaagaaggcttctttgacttgatgcatgtacaaaaagtgttgtctgcaagtacagtgtgtaaactgcagagttgcacacatggtataccaggagacctacaagtttaccacattggcaacttgttgaaaggggatagagtaaacgggcatctaattcacaaaattgaaccacattttaacacctcttggatgtcctgggatggttgtgatctagactactactgcaacatgggggactggccttcttgcacatacacaggagtgacccagcataatcatgctgcatttgtaaacttgcttaacattgaaactgattacacgaaaaccttccacttccactctaaaagagtcacagcacatggtgacacaccacaattagacttaaaagcaaggccgacctacggtgcaggtgagatcactgtgctggttgaggttgctgacatggagttgcataccaaaaaagttgagatatcaggcttgaaatttgcaagcctggcatgcacgggttgctatgcttgtagctctggcatctcctgtaaagtcagaattcatgtagatgaaccagatgagctcacagtgcatgtaaagagcagtgatccagacgtggttgcagctagcacaagtcttatggcaaggaagcttgaatttgggacagacagcacattcaaggccttttcagctatgcctaaaacctctttatgtttttacattgtggagagagaatactgcaagagctgcagtgaagatgataccaaaaaatgtgttgacacaaaacttgagcagccacagagcatactaattgagcacaaagggacgataattggaaagcagaatgatacttgcacagccaaggcaagctgttggctagagtcagtcaagagttttttttatggattgaagaatatgctcggcagtgtttttggcaatttttttataggcattttgttattccttgccccttttgtcctgttggtgcttttctttatgtttggatggaaaatcttgttttgctttaaatgttgcaggaggaccagaggcttgtttaagtatagacacctcaaagacgatgaggaaacaggctacagaaggattattgaaagactgaacaacaaaaaggggaaaaacagactgcttgatggtgaaaggttggctgataggaaaattgctgagctgttctccacaaaaacacacattggc

SEQ ID NO: 4077 - RNA, 1932 nt, synthetic construct
  misc_feature 1..1932: note = derived and/or modified CDS sequence (wt) from CCHFV(Gaib)__KX013445.1__Gc
  source 1..1932: mol_type = other RNA
ttctcagacagcatagttaagggcatgaaaaacctgctgaactcaacaagtttagagacaagtttatcaattgaggcaccatggggagcgataaatgtccaatcaacctttaaacctactgtatcaactgcaaatatagcactcagttggagctcaatagagcacagaggcaacaagattctggtctcaggcagatcagagtcaatcatgaagctagaagagaggacaggaatcagctgggacctaggcgtggaagatgcttccgagtctaggttacttactgtttctgttatggatttgtcacaaatgtactctcccgtttttgaatacctgtcaggtgacagacaggtggaggaatggcctaaagcaacctgcacaggcgactgtcctgaaagatgtggatgcacatcgtcaacctgcttacacaaagaatggcctcattcaagaaattggagatgcaatcccacttggtgctggggagttggtaccgggtgcacctgctgtggactagatgtaaaagacctttttacagactatatgtttgtcaaatggaaagtcgagtacataaagacagaggctatagtgtgtgttgaacttacaagccaagaaaggcaatgcagtttgattgaggcaggcacaagattcaacttaggtccagtgaccatcacattgtcagaaccgagaaacattcagcaaaagcttcctcctgaaataatcacattgcaccctagaattgaagaaggcttctttgacctaatgcacgtgcagaaagtgctgtctgctagtacggtgtgtaaactacagagttgcacacacggtgtgccgggggatctacaggtctaccacattggcaatttgttaaaaggggataaggtgaacggacatctgattcacaagattgaaccacacttcaacacttcttggatgtcctgggatggttgtgacctggactactactgcaatatgggggattggccttcctgcacgtatactggagtaacccaacataaccacgccgcatttgtgaacctgctcaacattgaaactgattataccaaaaacttccacttccactctaagagagttactgcacatggagacacaccgcaattggatttgaaggctagaccaacctatggtgcaggcgagatcactgtgctggtagaagttgctgacatggagctacacacaaaaaagattgagatatcaggcctgaaatttgcgagtctaacttgcacaggttgctatgcttgcagctctggcatctcctgtaaagttaggatccatgtagatgaaccagatgagcttacagtgcatgtgaaaagtgaagatccagacatagttgcagctagctcaagtctcatggcaaggaagcttgaatttggtacagacagtacctttaaagccttttcagctatgcccaaaacctctttatgcttttacattgtagagagagaatattgcaagagctgcagtagagaagacacacaaaaatgtgtcagcacaaaacttgagcaaccacagagcattttaattgaacacaaaggaacgataatcggaaaacagaataacacctgcacaactaaaacaacctgttggttggaatcagtaaagagtttcttttatggactaaagaacatgcttagcagtatttttggcaatgttttcgtgggcattttctcattccttgcccctttcatcttactgatacttttcttcatgtttgggtggagaatcctattttgctttaagtgttgcagaaggactagaggcttatttaagtacagacatctcaaagacgatgaagagaccggttataggaggatcattgaaagattaaacaacaaaaaaggaaagagcaagttgcttgatggtgaaaggttggctgataggaagattgctgagctgttctccacaaaaacacacattgga

SEQ ID NO: 4078 - RNA, 1932 nt, synthetic construct
  misc_feature 1..1932: note = derived and/or modified CDS sequence (wt) from CCHFV(Hodzha)__KX013448.1__Gc
  source 1..1932: mol_type = other RNA
ttcctggatagtatagttaaaggcaagaaaaatctgttaaactccacaagtttagaaacaagcttgtcgattgaggcaccatggggggcaataaatgttcagtcaacctacaaaccaactgtatcaactgcaaacatagcacttagttggagttcagttgaacacagaggtaataagattttggtttcaggcagatcagaatcaattatgaagctggaagaaagaacaggaatcagctgggatcttggcgttgaagatgcctctgaatctaagctacttactgtctctgtcatggacttgtctcagatgtactcccctgtcttcgagtacttatcgggtgacagacaagtagaagagtggcccaaggcaacctgcacaggtgactgctcagaaagatgtggctgcacatcatcaacctgcttacataaagaatggccccattcacgaaactggagatgcaatcccacttggtgctggggggtggggactggctgcacctgttgtggattagatgtgaaagacctatttacagattatatgttcgtcaagtggaaagttgattacattaaaacagaggccatagtgtgtgtagaactcaccagtcaggaaaggcagtgtagcttggttgaggcgggcacaaggttcaatttaggtcctgtaaccatcacattgtcagaaccgaggaacatacaacaaaagctccctcctgaaataatcacattgcatcctaggattgaagaaggtttttttgacctgatgcatgtacaaaaagtgctgtcagcaagcacagtgtgtaaattgcagagttgcacacatggtgtgccaggagatctacaggtctaccacatcggaaatttattaaaaggagataaagtgaacggacacctaattcataaaattgagccgcacttcaatacttcctggatgtcctgggatggctgtgacctagactactactgcaacatgggagactggccttcttgcacatataccggagttactcaacacaatcatgcttcatttgtaaacctgctcaacattgaaactgactatacaaaaagcttccactttcactctaaaagggttactgcacatggagacacaccacaattggatctgaaggcaagaccaacctacggcgcaggagaaatcactgtactggtagaagttgctgatatggagttacacacaaagaagatcgaaataacaggcctcaaatttgcaagcctgacttgcacaggttgttatgcttgtagttcaggcatctcctgcaaagttaggattcacgtggatgaaccagatgagctaacagtacatgttaaaagtgatgatccagatgtagttgcagccagctcaagtctcatggcaaggaaacttgagtttggaacagacagtacattcaaagctttctcagccatgcctaaaacttccttatgcttctacattgtcgaaagggagtactgtaagagctgcagtaaagaagacacacagaaatgtgttaacacaaaacttgagcaaccacagagcattttgatcgaacaaaagggaactataatcggaaagcaaaacaatacttgcacagccaaggcaagttgctggttagagtcagttaaaagtttcttttatggtctaaagaacatgcttagtggcatttttggcaatgtttttgtaggcattttcttatttcttgccccctttatcttgttaatacttttcttcatgtttggatggaggatcctgttttgcttcaagtgttgcagaagaaccaggggcctgtttaagtataaacatctcaaagacgatgaagaaactggttacagaaggatcattgaaagactgaacaacaagaaggggaaaaacaagctgcttgacggtgaaagacttgccgatagaaggattgccgaactattctccacaaaaacacacattggc

SEQ ID NO: 4079 - RNA, 1932 nt, synthetic construct
  misc_feature 1..1932: note = derived and/or modified CDS sequence (wt) from CCHFV(IbAn7620)__KX013451.1__Gc
  source 1..1932: mol_type = other RNA
ttcctagatagtatagctaaaggcatgaaaaatccgctaaattcaacaagtttagaaacgagtttatcaattgaggcaccatggggagcaatagatgttcagtcaacctacaaaccaactgtgtcaactgcaaacatagcactcagttggagctcagtggaacacagaggtaataagatcttggtttcaggcagatcagaatcaattatgaagctagaagaaaggacgggaatcagctgggatctcggcgtagaagatgcctctgagtctaaactgcttacagtctctgtcatggacctgtctcagatgtactctcctgtcttcgagtacttatcaggggacagacaggtggaagagtggcccaaagcaacttgtacaggtgattgcccagaaagatgtggttgcacatcatcaacctgtttgcacaaagaatggcctcactcaagaaattggagatgcaatcccacttggtgctggggagtagggactggctgcacctgttgtggattagatgtgaaagacctttttacagattatatgtttgtcaagtggaaagttgaatacatcaagacagaggccatagtgtgtgtagaacttaccagtcaggaaaggcagtgtagcttgattgaagcgggcacgaggttcaatttaggtcctgtgaccatcacactgtcagaaccaagaaacatccaacaaaaactccctcctgaaataatcacactgcatcctaggatcgaagaaggtttttttgatctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacttcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagacacaccacaactagatcttaaggcaagaccaacctatggtgcaggcgagatcactgttctggtagaagttgctaacatggagttacatacaaagaagattgaaatatcaggcttaaaatttgcaagcttgacttgtacaggttgttatgcttgtagctctggcatctcatgcaaagttagaattcatgtggatgaaccagatgaacttacagtacatgttaaaagtgatgatccagatgtggttgcagctagctcaagtctcatggcaagaaagcttgaatttggaacagacagtacatttaaagctttctcggccatgcccaaaacttctctatgtttctacattgttgaaagagaacactgtaagagctgcagtgaagaagatacaaaaaaatgtgttaacacaaagcttgagcaaccacaaagcattttgatcgaacacaagggaactataataggaaagcaaaacagcacttgcacggctaaggcgagttgctggttggagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtacagacacctcaaagacgatgaagaaactggttatagaaggattattgaaagactaaacaataaaaaaggaaaaaacaagctgcttgatggtgaaagacttgctgatagaagaattgccgaactgttctctacaaaaacacacattggc

SEQ ID NO: 4080 - RNA, 1932 nt, synthetic construct
  misc_feature 1..1932: note = derived and/or modified CDS sequence (wt) from CCHFV(K128_76)__KX013454.1__Gc
  source 1..1932: mol_type = other RNA
tttcaggacagtatagtcaaaggcatgaaaaacctgctaaactcaacaagtttagaaacaagcttgtcgattgaggcaccatggggggcaataaatgttcagtcaacctacaaaccagctgtgtcagctgcaaacatagcacttagttggagttcagttgaacacagaggtagtaagattttggtttcaggcagatcagaatcaattatgaagctggaagaaaggacaggaatcagctgggatcttggcgtagaagatgcctctgaatctaagctacttacagtctctgtcatggacttgtctcagatgtactcccctgtcttcgagtacttgtcaggtgacagacaagtagaagagtggcccaaggcaacctgtacaggtgactgcccagagagatgtggttgtacatcatcaacctgtttgcataaagaatggccccattcaagaaactggaggtgtaatcccacttggtgctggggggtagggactggctgcacctgttgtggtttagatgtgaaagacctttttacagactatatgttcgtcaagtggaaagttgaatatattaagacagaggccatagtgtgtgtagaacttaccagtcaggaaaggcagtgtagtttaattgaggcaggtacaaggttcaatttaggtcctgtgaccatcacattgtcagaaccgaggaacatccaacaaaagctccctcctgaaataatcacactgcatcctaggattgaagaaggtttttttgacctgatgcatgtgcaaaaggtgctgtcagcaagcacagtgtgtaagttgcagagttgcacacatggtgtgccaggagatctacaagtctaccacatcgggaatttactaaaaggagatagagttaacggacacctaattcataaaattgagccacactttaacacttcttggatgtcctgggatggctgtgacctagactattactgcaacatgggagactggccttcttgcacatataccggagttacccagcacaatcatgcttcatttgtgaacctgctcaacattgaaactgactatacaaaaagcttccattttcactctaaaagggttactgcacatggagacacaccacaattagatctgaaggcaaggccaaactatggcgcaggagagatcaccgtactggtagaggttgccgatatggagttacacacaaagaagattgaaatatcaggcctaaagtttgcaagcttgacttgtacaggttgttatgcttgtagttccggtatctcctgtaaagttaggattcatgtggatgaaccagatgaacttacagtacatgttaaaagtgatgatccagatgtagttgcagctagctcaagtctcatggcaaggaagcttgaatttggaacagacagtacatttaaggctttctcagccatgcccaaaacctccttatgtttctacattgtcgaaagggagtactgcaagagctgcagtaaagaagacacacaaaaatgtgttaacacaaaacttgagcagccacagagcattttaatcgaacataagggaactataatcggaaagcaaaacaatacctgcacagcaaagacaagttgctggttagagtcagttaaaagtttcttttatggtttaaagaacatgcttagtggcatttttggcaatgtttttgtgggtattttcttatttcttgcccccttcatcttgctaatacttttctttatgtttgggtggaggatcctgttttgcttcaagtgctgtagaagaaccagaggcctgttcagatataagcatctcgaaaacgatgaagaaactggttacagaagaatcattgaaagactgaacaacaaaaaaggaaaaaacaagctgcttgatggtgaaagacttgctgatagaagaatcgccgaactattctccacaaaaacacacattggc

SEQ ID NO: 4081 - RNA, 1932 nt, synthetic construct
  misc_feature 1..1932: note = derived and/or modified CDS sequence (wt) from CCHFV(K168_40)__KX013457.1__Gc
  source 1..1932: mol_type = other RNA
tttctggacggtatagtcaaaggcatgaaaaacctgctaaactcaacaagtttggaaacaagcttgtcgattgaggcaccatggggggcaataaatgttcagtcaacctacaaaccaactgtatcagctgcaaacatagcacttagttggagttcagttgaacacagaggtaataagattttggtttcaggcagatcagaatcaattatgaagctggaagaaaggacaggaatcagctgggatcttggcgtagaagatgcctctgaatctaagctactcacagtctctgtcatggacttgtctcagatgtactctcctgtcttcgagtacttgtcaggtgacagacaagtagaagagtggcccaaggcaacctgtacaggtgactgcccagagagatgtggctgtacatcatcaacctgtttgcataaagaatggccccattcaagaaactggaggtgtaatcccacttggtgctggggggtagggactggctgcacctgttgtggtttagatgtgaaagacctttttacagactatatgtttgtcaagtggaaagtcgaatacattaagacagaggccatagtgtgtgtagaacttaccagtcaggaaaggcagtgtagcttaattgaggcgggtacaaggttcaatttaggtcccgtgaccatcacattgtcagaaccgaggaacatccaacaaaaactccctcctgaaataatcacactgcatcctaggattgaagaaggtttttttgacctgatgcatgtacaaaaggtgctgtcagcaagcacagtgtgtaagttgcagagttgcacacatggtgtgccaggagatctacaggtctaccacatcggaaatttactaaaaggagataaagttaacggacacctaattcataaaattgaaccacacttcaacacttcttggatgtcttgggatggctgtgacctagactactactgcaacatgggagattggccttcttgcacatataccggggttacccagcacaatcatgcttcatttataaacctgctcaacattgaaactgactatacaaaaagcttccattttcactctaaaagggttactgcacatggagacacaccacaattagatctgaaggcaaggccaaactatggcgcaggagagatcaccgtactggtagaggttgccgatatggagttacacacaaagaagattgaaatatcaggactaaagtttgcaagcttgacttgtacaggttgttatgcttgtagttccggtatctcctgtaaagttaggattcatgtggatgaaccagatgaacttacagtacatgttaaaagtgatgatccagatgtagttgctgctagctcaagtctcatggcaaggaagcttgaatttggaacagacagtacatttaaggctttctcagccatgccaaaaacctccttatgtttctatattgtcgaaagggaatactgcaagagctgcagtaaagaagacacacaaaaatgtgttaacacgaagcttgagcatccacagagcattttgatcgaacataagggaactataatcggaaagcagaacaatacctgcacagcaaagacaagttgctggttagagtcagttaagagtttcttttatggtttaaagaacatgcttagtggcattttcggcaacgtttttgtaggcattttcttatttcttgcccccttcatcttgctaatacttttctttatgtttgggtggaggatcctattttgcttcaagtgctgtagaagaaccagaggcctgtttagatataaacatctcgaagacgatgaagaaactggttacagaagaatcattgaaagactgaacaacaaaaaaggaaaaaacaagctgcttgatggtgaaagacttgctgatagaagaattgccgaactattctccacaaaaacacacattggc

SEQ ID NO: 4082 - RNA, 1932 nt, synthetic construct
  misc_feature 1..1932: note = derived and/or modified CDS sequence (wt) from CCHFV(K168_125)__KX013460.1__Gc
  source 1..1932: mol_type = other RNA
tttctggacagtatagtcaaaggcaagaaaaacctgctaaactcaacaagtttggaaacaagcttgtcgattgaggcaccatggggggcaataaatgttcagtcaacctacaaaccaactgtatcagctgcaaacatagcacttagttggagttcagttgaacacagaggtaataagattttggtttcaggcagatcagaatcaattatgaagctggaagaaaggacaggaatcagctgggatcttggcgtagaagatgcctctgaatctaagctactcacagtctctgtcatggacttgtctcagatgtactctcctgtcttcgagtacttgtcaggtgacagacaagtagaagagtggcccaaggcaacctgtacaggtgactgcccagagagatgtggctgtacatcatcaacctgtttgcataaagaatggccccattcaagaaactggaggtgtaatcccacttggtgctggggggtagggactggctgcacctgttgtggtttagatgtgaaagacctttttacagactatatgtttgtcaagtggaaagtcgaatacattaagacagaggccatagtgtgtgtagaacttaccagtcaggaaaggcagtgtagcttaattgaggcgggtacaaggttcaatttaggtcccgtgaccatcacattgtcagaaccgaggaacatccaacaaaaactccctcctgaaataatcacactgcatcctaggattgaagaaggtttttttgacctgatgcatgtacaaaaggtgctgtcagcaagcacagtgtgtaagttgcagagttgcacacatggtgtgccaggagatctacaggtctaccacatcggaaatttactaaaaggagataaagttaacggacacctaattcataaaattgaaccacacttcaacacttcttggatgtcttgggatggctgtgacctagactactactgcaacatgggagattggccttcttgcacatataccggggttacccagcacaatcatgcttcatttataaacctgctcaacattgaaactgactatacaaaaagcttccattttcactctaaaagggttactgcacatggagacacaccacaattagatctgaaggcaaggccaaactatggcgcaggagagatcaccgtactggtagaggttgccgatatggagttacacacaaagaagattgaaatatcaggcctaaagtttgcaagcttgacttgtacaggttgttatgcttgtagttccggtatctcctgtaaagttaggattcatgtggatgaaccagatgaacttacagtacatgttaaaagtgatgatccagatgtagttgctgctagctcaagtctcatggcaaggaagcttgaatttggaacagacagtacatttaaggctttctcagccatgccaaaaacctccttatgtttctatattgtcgaaagggaatactgcaagagctgcagtaaagaagacacacaaaaatgtgttaacacgaagcttgagcatccacagagcattttgatcgaacataagggaactataatcggaaagcagaacaatacctgcacagcaaagacaagttgctggttagagtcagttaagagtttcttttatggtttaaagaacatgcttagtggcattttcggcaacgtttttgtaggcattttcttatttcttgcccccttcatcttgctaatacttttctttatgtttgggtggaggatcctattttgcttcaagtgctgtagaagaaccagaggcctgtttagatataaacatctcgaagacgatgaagaaactggttacagaagaatcattgaaagactgaacaacaaaaaaggaaaaaacaagctgcttgatggtgaaagacttgctgatagaagaattgccgaactattctccacaaaaacacacattggc

SEQ ID NO: 4083 - RNA, 1932 nt, synthetic construct
  misc_feature 1..1932: note = derived and/or modified CDS sequence (wt) from CCHFV(K229_194)__KX013463.1__Gc
  source 1..1932: mol_type = other RNA
tttttagacagtatagttaaaggtaagaaaaatctgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggacctgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacctgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctattcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttatgtttttacattgtggagagggaatactgcaagagctgcagtgaagatgatacaaaaaaatgtgttgacacaaaacttgagcagccacagagcatactaattgagcacaaagggacgataattggaaagcaaaatgacacttgcacagccaaggcaagttgttggctagagtcagtcaagagttttttttatggattgaagaatatgcttggcagtgtttttggtaattttttcgtaggcattttgttattccttgccccctttgtcttgttggtgcttttctttatgtttggatggaaaatcttgttttgctttaagtgttgcaggaggaccagaggcttgtttaagtatagacacctcaaagatgatgaggaaacaggctacagaaagattattgaaagactgaacagcaaaaaaggaaaaaacagactgcttgatggtgagaggttggctgataggaaaattgctgagctgttctctacaaaaacacacattggc

SEQ ID NO: 4084 - RNA, 1932 nt, synthetic construct
  misc_feature 1..1932: note = derived and/or modified CDS sequence (wt) from CCHFV(K229_243)__KX013466.1__Gc
  source 1..1932: mol_type = other RNA
ttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtggaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgtacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactatcaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatcttcaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagaaagaatactgcaagagctgcagtgaagaggacacacaaaaatgtgttgacacaaaacttgagcagccacagagcatactaattgagcacaaaggaacgataattggaaagcagaatgatacttgcacagccaaagcaagctgttggctagagtcagtcaagagttttttttatggattgaagaatatgcttggtagtgtctttggtaactttttcataggcattttgttattccttaccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaagggaaaaacagactgcttgatggtgaaaggttggctgataggaaaattgctgagctgttctccacaaaaacacacattggt

SEQ ID NO: 4085 - RNA, 1932 nt, synthetic construct
  misc_feature 1..1932: note = derived and/or modified CDS sequence (wt) from CCHFV(K315_14)__KX013469.1__Gc
  source 1..1932: mol_type = other RNA
ttcttagacagtatagttaaaggtatgaaaaaattgctaaactcaacaagcttagaaacaagcttatcaattgaggcaccatggggagcaataaatgtccagtcaacctttaaaccaacagtatctactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggacttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacatcggtaacttgttgaaaggggatagagtaaacgggcatctgattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcctgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagccatgcccaaaacctctttatgcttttacattgtagagagggaatactgcaagagctgcagtgaagatgatacaaaaaaatgtgttgacacaaaacttgagcagccacagagcatactaattgagcacaaggggacaataattggaaagcagaatgatacttgcacagccaaggcaagttgttggctagagtcagtcaagagttttttttatggactgaagaatatgcttggcagtgtttttggtagttttttcgtaggcattttgttattccttgccccttttgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaagggaaaaacagactgcttgatggtgagaggttggctgataggaaaattgctgagctgttctctacaaaaacacacattggc

SEQ ID NO: 4086 - RNA, 1932 nt, synthetic construct
  misc_feature 1..1932: note = derived and/or modified CDS sequence (wt) from CCHFV(K323_27)__KX013472.1__Gc
  source 1..1932: mol_type = other RNA
ttcttagacagtatagccaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatacataaaaaccgaagccatagtatgtgttgagctcaccggccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgttgttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctggagtcagtcaagagttttttttatggattgaagaatatgcttggcagtgtttttggtagttttttcgtaggcattttgttattccttgccccttttgtcttgttggtgcttttctttatgtttggatggaaaatcttgttttgctttaagtgttgcaggaggaccagaggcttgtttaagtatagacacctcaatgatgacgaggaaacaggctacagaaggatcattgaaagactgaacagcaaaaaaggaaaaaacagactgcttgatggtgagaggttggctgataggaaaattgctgagctgttctctacaaaaacacacattggc

SEQ ID NO: 4087 - RNA, 1932 nt, synthetic construct
  misc_feature 1..1932: note = derived and/or modified CDS sequence (wt) from CCHFV(K340_6)__KX013475.1__Gc
  source 1..1932: mol_type = other RNA
tccttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagagtaaacggccatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttactgacatggagttgcataccaaaaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtagttttttcgtaggcattttgttattccttgcccctttcgtcttgttggtgcttttctttatgtttggatggaaaatcttgttttgctttaagtgttgcaggaggaccagaggcttgtttaagtatagacacttcaaagatgacgaggaaacaggctacagaaggattattgaaagactgaacagcaaaaaaggaaaaaacagactgcttgatggtgagaggttggctgataggaaaattgctgagctgttctctacaaaaacacacattggc

SEQ ID NO: 4088 - RNA, 1932 nt, synthetic construct
  misc_feature 1..1932: note = derived and/or modified CDS sequence (wt) from CCHFV(Mamon)__KX013478.1__Gc
  source 1..1932: mol_type = other RNA
ttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtgtgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggtgatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctcgttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaagacaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 4089 - RNA, 1932 nt, synthetic construct
  misc_feature 1..1932: note = derived and/or modified CDS sequence (wt) from CCHFV(Min)__KX013481.1__Gc
  source 1..1932: mol_type = other RNA
ttcttagacagtatagttaaaggcacgaagaatttgctaaactcaacaagcttagaaacaagcttatcaattgaggcaccatggggagcaataaatgtccagtcaacctttaaaccaacagtgtcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcctacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggataggataaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 4090 - RNA, 1932 nt, synthetic construct
  misc_feature 1..1932: note = derived and/or modified CDS sequence (wt) from CCHFV(Nakiwogo)__KX013484.1__Gc
  source 1..1932: mol_type = other RNA
tacctggatagcatagccaaggggatgaaaagtctgttaaattctacgaacttagagacaagcctgtcgattgaggccccatggggagcaatcaatgttcagtcaacttttaaaccaacagtttcagctgccaacatagcacttagctggagttcagttgaacacaggggcaacaaaatcctagtttcgggcaggtcagagtcaattatgaaactggaagaacggaccggcatcagctggagcctaggtgtagaggatgcttctgagtcaaagacgcttactgtttctgtcatggatctgtctcaaatgtattctcctgtctttgagtatctgtcaggtgatagacaagtagaagagtggccaaaggccacttgcacaggcgactgcccagagagatgtggctgcacctcctcaacctgcttgcataaagaatggccgcactcgagaaactggcgatgcaaccccacttggtgttggggagtagggactggctgcacctgctgcggactggatgttagagaccttttcacggactacatgatggtcaagtggaaagtggaatatgtaaaaacagaagctataatgtgtgttgagctaactagtcaggaaaggcagtgtagtttaattgaggcaggtacaaggtttaacctgggccctgtgacaataaccctgtcagagccaagaaatgtccagcaaaggctcccttccgaaatcgttacactgcaccctaagatagaggaaggattctttgatttgatgcatgtgcaaaaagtactattctgcaagcacagtttgcaagctacaagctgcacacacggtgtcccaggcgatttgcaggtctaccatgttggcaacctactgaaaggagacaaggttaatgggcactcaattcacaagatagagtctcatttcaacacttcatggatgtcatgggatggatgtgacctagactacttttgcaacatgggtgactggccttcatgtacatatactggagtgacacagcacaaccgtgcggcattcgtcaacatgctcaatattgagactgattacacaaagacttttcacttccattccaagagggttacggcacacggtgacacccctcaactggatctgaaggcaagaccaacatatggtgcaggcgaggtcactgttctagtggaggttgcagatctggagctacacactaagaaaatagaagtgtcagggttgaagtttgcaagtctgacctgctctggttgttatgcctgcagttccggcatctcctgcaaagttagaattcatgtgaatgaaccagatgagttcacagtacacgtgaaaagcaatgatccagacgttgtggcagcaggatcaagtctgatggcaaggaaaatagagttaggggctgacagcacctttaaagccttttcatcaatgcctaaaaactctttgtgcttttatatagtggaaagagactactgcagcagctgcaccgatgatgacactcagaagtgtgttaacacaaagctcgaacatccacaaagcatattaattgagcataagggaacaataattggtaagcaaaatgacacctgtccgaccaaaacaagctgctggctagaatcagtcaagagttttttttatggactgaaaaacatgctgggtggcatcttcggtaatgtcttcttaggcatcttcctattccttgctccttttgcactgctgatactcttcttcttcttcgggtggaggcttctgttctgtctgaagtgttgcagaaggaccaggggtctgctaaagtataaacaacttaaggatgaagaagaagccgggtacaagaaaatcatcgagaggctgaatgacaaaaagggcaaaagtcgactttttgacggagagaggctcgctgacaggaagattgctgaactcttttcaaccaaaactcatataggg

SEQ ID NO: 4091 - RNA, 1932 nt, synthetic construct
  misc_feature 1..1932: note = derived and/or modified CDS sequence (wt) from CCHFV(Saf)__KX013487.1__Gc
  source 1..1932: mol_type = other RNA
ttctcagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgagactgattacatgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgtaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggt

SEQ ID NO: 4092 - RNA, 1932 nt, synthetic construct
  misc_feature 1..1932: note = derived and/or modified CDS sequence (wt) from CCHFV(Ast199)__KX056051.1__Gc
  source 1..1932: mol_type = other RNA
ttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaaggaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgaggtatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttgtgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggtgcttttctttatatttggatggaaaatcttgttttgctttaagtgttgcaggaggaccagaggcttgtttaagtatagacacctcaaagatgatgaggaaacaggctacagaaagattattgaaagactgaacagcaaaaaaggaaaaaacagactgcttgatggtgagaggttggctgataggaaaattgctgagctgttctctacaaaaacacacattggc

SEQ ID NO: 4093 - RNA, 1932 nt, synthetic construct
  misc_feature 1..1932: note = derived and/or modified CDS sequence (wt) from CCHFV(Ast149)__KX056054.1__Gc
  source 1..1932: mol_type = other RNA
ttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaaggaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgaggtatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttgtgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggcgcttttctttatatttggatggaaaatcttgttttgctttaagtgttgcaggaggaccagaggcttgtttaagtatagacacctcaaagatgatgaggaaacaggctacagaaagattattgaaagactgaacagcaaaaaaggaaaaaacagactgcttgatggtgagaggttggctgataggaaaattgctgagctgttctctacaaaaacacacattggc

SEQ ID NO: 4094 - RNA, 1932 nt, synthetic construct
  misc_feature 1..1932: note = derived and/or modified CDS sequence (wt) from CCHFV(Ast137)__KX056057.1__Gc
  source 1..1932: mol_type = other RNA
ttcttagacagtatagttaaaggtacgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaaggaacattcagcagaagcttccccctgagatcattacgctgcatcctaaaattgaagaaggcttctttgacttaatgcatgtgcaaaaagtgttatctgcaagtacagtgtgtaaactgcagagttgcacacatggtataccgggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagggtcacagcacatggagacacaccacaattagacttaaaagcaaggccgacctacggtgcaggtgagatcactgtgctggttgaggttgctgacatggagttgcataccaagaaagttgaggtatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttgtgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggtgcttttctttatatttggatggaaaatcttgttttgctttaagtgttgcaggaggaccagaggcttgtttaagtatagacacctcaaagatgatgaggaaacaggctacagaaagattattgaaagactgaacagcaaaaaaggaaaaaacagactgcttgatggtgagaggttggctgataggaaaattgctgagctgttctctacaaaaacacacattggc

SEQ ID NO: 4095 - RNA, 1932 nt, synthetic construct
  misc_feature 1..1932: note = derived and/or modified CDS sequence (wt) from CCHFV(Ast133)__KX056060.1__Gc
  source 1..1932: mol_type = other RNA
ttctcagacagtatagttaaaggtatgaaaaatttgctaaactcaacaagcttagaaacaagcttatcaattgaggcaccatggggagcaataaatgtccaatcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactattaccctgtctgagccaagaaacattcagcagaagcttccccctgagatcattacgctgcatcccaaaattgaagaaggcttctttgacttgatgcatgtgcaaaaagtgttatccgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaagaaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtagtttttttgtaggcattttgttattccttgccccttttgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaaggaaaaaacagactgcttgatggtgagaggttggctgataggaaaattgctgagctgttctcttcaaaaacacacattggc

SEQ ID NO: 4096 - RNA, 1932 nt, synthetic construct
  misc_feature 1..1932: note = derived and/or modified CDS sequence (wt) from CCHFV(SK/2015/human)__KX458183.1__Gc
  source 1..1932: mol_type = other RNA
ttcctggatagtatagtaagaggcatgaaaaatctgctaaactcaacaagtttggagacaagcttatcgattgaggcaccatggggagcaataaatgttcagtcaacctacaagccaactgtgtcaactgcaaacatagcacttagttggagttcagttgaacacagaggtaataagattttggtttcaggcagatcagaatcaattatgaagctagaagaaaggacaggagtcagctgggaccttggcgtagaagatgcctctgaatctaagctacttacagtctctgtcatggacttatctcagatgtactctcctgtcttcgagtacttatcaggtgacagacaagtagaagagtggcccaaggcaacctgtacaggtgactgcccagaaagatgtggctgcacaacgtcaacctgcttgcataaagaatggcctcattcaagaaactggagatgtaatcccacttggtgctggggagtggggactggctgcacttgttgtggattagatgtgaaagacctttttactgattatatgttcgtcaagtggaaagttgaatacattaaaacagaggccatagtgtgtgtggaactcaccagtcaaggaaggcaatgcagcttgattgaggcgggcacaaggttcaatttaggttctgtgaccatcacattgtcggaaccgaggaacattcaacataagctccctcctgaaataatcacattgcatcctaggattgaagaaggtttctttgacctgatgcatgtacaaaaagtgttgtcagctagcacagtgtgtaagttgcagagttgcacacacggtgtgccaggtgatctacaggtctatcatatcggaaatttattaaaaggggataaagtgaatggacacctaattcataaaattgagccacacttcaacacttcctggatgtcctgggatggctgtgacttagactactactgcaacatgggagactggccttcttgtacatataccggagttacccaacacaatcatgcttcatttgtaaacctactcaacattgaaactgactatacaaaaaacttccactttcactctaaaagggttactgcgcatggagacacaccacaattagatctgaaagcaagaccaacttacggcgcaggagaaatcactgtactggtagaagttgctgacatggagttacacacgaagaaaattgaaatatcaggcctaaaatttgcaagcctgacttgcacaggctgttatgcttgtagttctggcatttcctgcaaagttaggattcatgtggatgaaccagatgaacttacagtacacgttaagagtgatgatccagatgtagtggcagctagctcaagtctcatggcaaggaagcttgagtttggaacagacagtacgtttaaagctttctcagccatgcccaaaacctccttatgtttctacattgtagaaagggagtactgtaagagctgcagtaaagaagacacacaaaaatgtgttaacacaaaacttgagcaaccacagagcatcttgatcgaacataggggaactataatcggaaagcagaacaatacctgcatagccaaagcaagttgctggttagagtcagttaaaagtttcttttatggtctaaagaacatgcttagtggcatttttggcaatctctttctgggcatcttcttatttcttgccccctttatcttgttaatactttttttcatgtttggatggaggatcctgttttgctttaagtgttgcagaagaaccaggggcctgttcaagtatagacatctcaaagacgatgaagaaactggttacagaaggatcattgaaagactgaacaacaagaaagggaagaacaagctgcttgatggtgaaagacttgccgatagaagaattgccgaactattctccacaaagacacacattggc

SEQ ID NO: 4097 - RNA, 1932 nt, synthetic construct
  misc_feature 1..1932: note = derived and/or modified CDS sequence (wt) from CCHFV(YL16070)__KY354081.1__Gc
  source 1..1932: mol_type = other RNA
ttcctggatagcatagccaagggaatgaaaagcctgttgaactccacgagcttagaaactagtctgtcaattgaagctccgtggggagcaatcaatgttcagtcaactttcaaaccaacagtttcagctgctaacatagcacttagctggagttcagttgaacacaggggcaacaaaattttggtttcaggtagatcagagtcaatcatgaaattagaagaaagaacaggagtcagctggaacctgggtgtagaagatgcttctgagtcaaagacgcttactgtttccgtcatggacctgtcacaaatgtactctcctgtttttgagtacttgtcaggtgacagacaagtggaggaatggccaaaggcaacttgcacaggtgactgtccagagagatgcggctgcacttcatcaacctgcttacataaagagtggccacattcaagaaactggagatgtaatcctacttggtgttggggggtggggactggctgcacttgctgtgggctggatgtgaaggatttttttactgactacatgttggtaaaatggaaagtggaatatataaagacagaagctatagtgtgtgtcgagctaactagtcaagagaggcagtgtagtttaattgaagcaggcacaagatttaacctaggccctgtaacaataaccctatcagagccaagaaatgtccagcagaggcttcctcccgaaattgtaacactgcatcctaaaatagaggaaggtttttttgatttgatgcatgtacaaaaaatactgtctgcaagcacagtttgcaagctacagagctgcacacacggtgtgccgggcgattttcaggtctaccatgtcggtaacctgctgaggggagacaaggttaatggacactcaattcacaagatagaaccacattttaatacttcatggatgtcatgggatggttgcgatctggactatttctgcaatatgggggactggccttcatgcacatacactggagtaacacagcataaccgtgctgcatttatcaacatgctcaacattgagactgactatacaaaaactttccactttcattcgaagagggtcacggcacatggagatactccccagctagacctaaaagcgagaccggcatatggtgctggcgaagtcactgttctagtggaggttgcagacttggagttgcacacaaagaaacttgaagtgtcaggtttgaaaattgcaagtttgacctgctctgggtgttatgcatgcagctctggcatctcctgcaaagttagaatccatgtaaatgaaccagacgaattcacagtgcatgtaagaagtagcgacccagatgttgtagcagcaggatcaagtcttatggcaaggaaaatagagtttggggctgacagtacattcaaggccttttcatcaatgcccaaggactccttatgcttttacatagtagaaaaggattactgcagcagctgcaccgacgatgacacacaaaagtgtgtcaacacgaagcttgaccatccacagagcatactcattgagcacaaaggaacaataattggcaagcaaaatgacacttgttcgaccaaaacaagctgctggctaaaatcatttaagggtttcttctatgggctcaaaaacatgctgagtggcatctttggaaatgtttttttaggcatcctcttattccttgctccttttgtactactgatattttttttcttttttgggtggaggcttctgttttgtctcaaatgttgcaaaaaaactaaaggactgttgaaatataagcaccttaaggacaaggaggaggctggatacaaaaaaatcattgaaaggctaaatggcaaaaaaggtaaaagtcaattgtttgatggtgaaaggcttgcaaacaggaaaattgctgagcttttttctactaaaattcacataggt

SEQ ID NO: 4098 - RNA, 1932 nt, synthetic construct
  misc_feature 1..1932: note = derived and/or modified CDS sequence (wt) from CCHFV(Oman_812956)__KY362518.1__Gc
  source 1..1932: mol_type = other RNA
ttttttgacagtattgctaagggtatgaagaacctgctgaattcaacaagcttagaaacaagcttatcaattgaggcaccatggggagcaataaacgtccaatctactttcaaacctactgtgtcaactgcaaacatagcacttagttggagctcagtggaacacagaggtaataagatcttggtttcaggcagatcagagtcaatcatgaagctagaagaaagaacaggaatcagctgggatttgggagtagaagatgcctctgagtccaaattacttactgtttccgtcatggacttatcacagatgtactctcctgtctttgagtacctatcaggtgacagacaagtagaggaatggccaaaggcaacctgtacaggcgattgcccggaaagatgtggctgcacatcatcaacctgcctacacaaggaatggcctcactcaagaaactggagatgcaaccccacttggtgttggggagtcggcaccggatgcacctgttgtggactagatgtaaaggacctttttacagattacatgtttgttaaatggaaggtcgaatatataaaaacagaggctatagtgtgtgttgagcttactagccaagaaagacaatgtagcttgattgaggcaggcacaagattcaacttaggtcctgtgactatcacattatcagagccaagaaacattcagcaaaagctccctccagaaattgtcacattacatcctagaattgaagaaggtttttttgacttaatgcatgtacagaaggtactatcagcaagcacagtgtgcaagctacagagttgcacacatggcgtaccaggagacttacaggtctaccacatcggaaacttactaaaaggagacaaagtgaatgggcatctgatacataaagttgaaccacatttcaacacctcctggatgtcttgggacggctgtgacctagattactactgcaatatgggggattggccctcttgcacgtatactggagttacccaacataatcatgctgcatttgtaaacctacttaacattgaaactgattacacaaagaacttccactttcactctaagagagtcactgcacatggggacactccacaattagatttaaaagccagaccaaattatggtgcaggtgaaatcactgtgctggtggaagttgctgacatggagttacacacaaagaaaattgagatatcaggtttgaagtttgcaagcctaacctgcacaggttgttatgcttgtagctctggcatctcatgtaaggttaggatccatgtagatgaaccagatgagcttacagtacatgtgaagagtgaagacccagacatagttgctgctagctcaagtctcatggcaagaaagcttgaattcgggacggatagtacattcaaagccttctcagccatgcctaaaacctccttgtgcttttacattgttgagagagaatactgtaaaagctgcagtaaagaagacacacaaaagtgtgttaacgcaaagcttgagcgaccacagagcattttaattgagcacaaaggaacgataattggaaagcagaacgacacttgcacagctaaagcaagctgctggctagagtcagtcaagagtttcttttatggactaaagaacatgcttagtggcatttttggcaatgttttcatagggattttcttattccttgctccttttatcctgttaatacttttctttatgtttgggtggagaatcctattctgctttaagtgctgcaggagaactagaggcctatttaagtacagacacctcaaagatgatgaagaaaccggttataggaaaatcattgagagactaaacaacaaaaaaggtaaaaacaagctgcttgacggtgaaagattagctgatagaaagatcgctgagctgttctctacaaaaacacacattggc

SEQ ID NO: 4099 - RNA, 1932 nt, synthetic construct
  misc_feature 1..1932: note = derived and/or modified CDS sequence (wt) from CCHFV(UCCR4405)__KY484029.1__Gc
  source 1..1932: mol_type = other RNA
ttcttagacagtacagttaaaggtatgaaaaatttgctaaactcaacaagcttggaaacaagcttatcaattgaggcaccatggggagcaataaatgtccagtcaacctttaaaccaacagtatcgactgcaaacatagcactcagttggagctcagtggagcacagaggcaacaagatcttggtcacaggcaggtctgaatcaattatgaaactagaggaaaggacaggagtcagctgggatctaggcgtagaagatgcctctgaatccaaattacttaccgtctccatcatggatttgtcacaaatgtattcccctgtttttgagtacttatcaggagatagacaggttgaagaatggcccaaggcaacctgtacaggtgattgcccagaaaggtgtggctgcacatcatcaacctgcttgcataaagaatggcctcactcaagaaactggagatgtaaccccacttggtgctggggagtaggaaccggctgcacatgctgcggagtggatgtaaaagacctttttacagatcacatgtttgtcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtacaaaaagtgttatctgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactattgcaacatggggaattggccttcttgcacatacacaggagtgacccaacataatcatgctgcatttgtaaatttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctggtttgcacgggttgctatgcttgtagctctggcatttcctgtaaagtcagaattcatgtagatgaaccagatgagctcacagtgcatgtaaagagcagtgatccagatgtggttgcagctagcacaagccttatggcaaggaagcttgaatttgggacagatagcatattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggtgcttttctttatgtttggatggaaaatcttgttttgctttaagtgttgcaggaggaccagaggcttgtttaagtatagacacctcaaagacgatgaggaaacaggctacagaaggattattgaaagactgaatagtaaaaaaggaaaaaacagactgcttgatggtgagaggttggctgataggaaaattgctgagctgttctccacaaaaacacacattggc

SEQ ID NO: 4100 - RNA, 1932 nt, synthetic construct
  misc_feature 1..1932: note = derived and/or modified CDS sequence (wt) from CCHFV(UCCR4401)__KY484035.1__Gc
  source 1..1932: mol_type = other RNA
ttcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctggcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatagaagaattgccgaactgttctctacaaaaacacacattggc

SEQ ID NO: 4101 - RNA, 1932 nt, synthetic construct
  misc_feature 1..1932: note = derived and/or modified CDS sequence (wt) from CCHFV(UCCR4448)__KY484042.1__Gc
  source 1..1932: mol_type = other RNA
ttcctagatagtatagttaaaggcatgaaaaatctgctaaactcaacaagtttagaaacaagtttatcaattgaggcaccatggggggcaataaatgttcagtcaacctacaaaccaactgtgtcaactgcaaacatagcactcagttggagctctgtggaacacagaggtaataagatcttggtttcaggcagatcagaatcaattatgaagctggaagaaaagacaggaatcagctgggatctcggcgtagaagacgcctctgagtctaaactgcttacagtctctgtcatggacttgtctcagatgtactctcctgtcttcgagtacttatcaggagacagacaggtggaagagtggcccaaagcaacttgtacaggtgactgcccagaaagatgcggctgcacatcatcaacgtgtttgcacaaagaatggccccactcaagaaattggagatgcaatcccacttggtgctggggtgtagggactggctgcacctgttgtggattagatgtgaaagacctttttacagattatatgtttgtcaagtggaaagttgaatatattaagacagaggccatagtgtgtgtagaacttaccagtcaggaaaggcagtgtagcttgattgaagcgggcacaaggttcaatttaggtcctgtgaccatcacactgtcagaaccaagaaacatccaacagaagctccctcctgaaataatcacactgcatcccaggatcgaagaaggtttttttgacctgatgcatgtacaaaaagtgttatcggcaagcacagtatgtaagttgcagagttgcacacatggtgtaccaggagacctacaggtctaccacatcggaaatttattgaaaggggataaggtaaatggacatctaattcataaaattgagccacacttcaacacttcctggatgtcctgggatggttgtgacctggactactactgcaacatgggagattggccttcttgcacatatacaggagtcacccaacacaatcatgcttcatttgtaaacctgctcaacattgaaactgattacacaaaaaacttccactttcactctaaaagggtcactgcacatggagacacaccacaactagatcttaaggcaagaccaacctatggtgcaggtgagatcactgtactggtagaagttgctgacatggaattacacacaaagaagattgaaatatcaggcttaaaatttgcaagcttgacttgcacaggttgttatgcttgtagctctggcatctcatgcaaagttagaattcatgtggatgaaccagatgaacttacagtacatgttaaaagtgatgatccagatgtagttgcagctagctcaagtctcatggcaagaaagcttgaatttggaacagacagtacatttaaagctttctcagccatgcctaaaacttctctatgtttctacattgttgaaagagaacactgtaagagctgcagcgaagaagacacaaaaaaatgtgttaacacaaaacttgagcaaccacaaagcattttgatcgaacacaagggaactataatcggaaagcaaaacagcacttgcacagccaaggcgagttgctggttagagtcagtcaaaagtttcttttatggtctaaagaacatgcttagtggtatttttggcaatgtttttataggtattttcttgttccttgcccccttcatcctattaatactattctttatgtttgggtggaagatcctattttgctttaaatgttgtagaagaactagaggcctattcaagtatagacacctcaaggacgatgaagaaactggttatagaaggattattgaaagactaaacaataaaaaaggaaaaaacaaactgcttgatggtgaaatacttgctgatagaagaattgccgaactgttctctacaaaaacacacattggc

SEQ ID NO: 4102 - RNA, 1932 nt, synthetic construct
  misc_feature 1..1932: note = derived and/or modified CDS sequence (wt) from CCHFV(U2-2-002/U-6415)__AY900144.1__Gc
  source 1..1932: mol_type = other RNA
tttcaggacagtatagtcaaaggcatgaaaaacctgctaaactcaacaagtttagaaacaagcttgtcgattgaggcaccatggggggcaataaacgttcagtcaacctacaaaccaactgtgtcagctgcaaacatagcacttagttggagttcagttgaacacagaggtaataagattttggtttcaggcagatcagaatcaattatgaagctggaagaaaggacaggaatcagctgggatcttggcgtagaagatgcctctgaatctaagctactcacagtctctgtcatggacttgtctcagatgtactcccctgtcttcgagtacttgtcaggtgacagacaagtagaagagtggcccaaggcaacctgtacaggtgactgcccagagagatgtggctgtacatcatcaacctgtttgcataaagaatggccccattcaagaaactggaggtgtaatccaacttggtgctggggggtagggactggctgcacctgttgtggtttagatgtgaaagacctttttacagactatatgttcgtcaagtggaaagtcgaatacattaagacagaggccatagtgtgtgtagaacttaccagtcaggaaaggcagtgtagcttaattgaggcgggtacaaggttcaatttaggtcctgtgactatcacactgtcagaaccgaggaacatccagcaaaagctccctcctgaaataatcacactgcatcctaggattgaagaaggtttttttgacctgatgcatgtacagaaggtgctatcagcaagcacagtgtgtaagttgcagagttgcacacatggtgtgccaggagatctacaggtctaccacatcggaaatttactaaaaggagataaagttaacggacacctgattcataaaattgagccacacttcaacacttcttggatgtcctgggacggctgtgacctagactactactgcaacatgggagactggccttcttgcacatataccggggttacccagcacaatcatgcttcatttgtaaacctgctcaacattgaaactgactatacaaaaagcttccattttcactctaaaagggtaactgcacatggagacacaccacaattagatctgaaggcaaggccaagctatggcgcaggagagatcaccgtactagtagaggttgctgatatggagttacacacaaagaagattgaaatatcaggcctaaagtttgcaagcttgacttgtacaggttgttatgcttgtagttccggtatctcctgtaaagttaggattcatgtggatgaaccagatgagttcacagtacatgttaaaagtgatgatccagatgtagttgcagctagctcaagtctcatggcaaggaagcttgaatttggaacagacagtacatttaaggctttctcagccatgcccaaaacctccttatgtttctatattgtcgaaagggaatactgcaagagctgcagtgaagaagacacacaaaaatgtgttaacacaaagcttgagcagccacagagcattttgatcgaacataagggaactataatcggaaagcagaacaacacctgcacagctaaggcaagttgctggttagagtcagttaaaagtttcttttatggtttaaagaacatgcttagtggcatttttggcaatgtttttgtgggcattttcttatttcttgcccccttcatcttgctaatacttttctttatgtttgggtggaggatcctattttgcttcaagtgctgtagaagaaccaggggcctgttcagatataaacatctcgaaaacgatgaagaaactggttacagaagaatcattgaaagactgaacaacaaaaaaggaaaaaacaagctgcttgatggtgaaagacttgctgatagaagaattgccgaactattctccacaaaaacacacattggc

SEQ ID NO: 4103 - RNA, 1932 nt, synthetic construct
  misc_feature 1..1932: note = derived and/or modified CDS sequence (wt) from CCHFV(SPU 45/88)__KJ682809.1__Gc
  source 1..1932: mol_type = other RNA
tttttggacagtattgttaaaggcaagaagaacttgctaaattcaacaagcctagaaacaagcttatcaattgaggcaccatggggggcaataaatgtccagtcaactttcaaaccaactgtgtcagctgcaaacatagcacttagttggagctcagtagaacatagaggtaacaagattttggtttcaggcaggtcagagtcaatcatgaaattagaggaaaggacaggaattagctgggatctgggtgtggaagacgcctctgaatccaaattgctcactgtctctgttatggacttgtcacagatgtattctcctgtctttgaatacctatcaggtgatagacaagtggaggaatggcccaaggcaacctgcacaggagattgcccagaaagatgtggctgtacgtcgtcaacctgcctacacaaggaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtatgtgttgagcttactagccaggaaagacaatgtagcttgattgaggcaggcacaagattcaacttgggtcctgtgactatcacattgtcagagccaagaaacattcagcaaaagctccctccagaaatagtcacattgcatcctaggattgaagaaggcttctttgacttaatgcatgtacaaaatgtgctatcagcaagtacagtgtgcaagctacaaagttgtacacatggtgtgccaggagacctacagatttaccacattggaaacttgttaaaaggagacaaggtgaatgggcacctgattcacaagattgaaccacacttcaacacttcctggatgtcttgggacggctgtgacctagactactactgtaatatgggggattggccatcttgctcatacactggcgtaacccaacacaatcatgctgcatttgtaaacatgctcaacatcgaaactgattatacaaaaaacttccactttcactctaagagagttacagcacatggagacacaccacaattagatttaaaagccagaccaacttatggtgcaggtgaaatcactgtgctggtggaggttgctgacatggagttgcatacaaagaaaattgagatatcaggtttgaagtttgcaagcttaacttgcacaggctgttatgcttgtagttctggtatctcctgtaaggttagaatccatgtggatgaaccagatgagctcacagtacatgtgaagagtgaggatccagacatagttgctgctagctcaagtctcatggctaggaagcttgaatttgggacagatagcacatttaaagccttttcagccatgcccaaaacctccttatgcttttacattgtggagagggaatactgcaaaagctgcagtaaagaagacacacaaaaatgtgtcaacacaaagcttgagcaaccacaaagcattttaatcgagcacaaagggacgataattgggaagcagaacgacacttgtacagccaaagcaagttgctggctagagtcagtcaagagttttttttatggactaaagaatatgcttagtggcatttttggcaatgttttcatagggattctcttattcctcgctccttttatcatgctaatacttttcttcatgtttggatggaggatcctgttctgctttaagtgttgcagaagaactagaggcctatttaagtatagacacctcaaagacgatgaagaaatcggttacaggaaaatcattgagaggctaaacaacaaaaaagggaaaaacaaactgcttgacggtgaaaggctagctgataggaaaatcgctgagctgttctccacaaaaacacacattggc

SEQ ID NO: 4104 - RNA, 1932 nt, synthetic construct
  misc_feature 1..1932: note = derived and/or modified CDS sequence (wt) from CCHFV(SR3)__AJ538199.1__Gc
  source 1..1932: mol_type = other RNA
tttctagatagtatagtcaaaggtatgaaaaatctgctaaactcaacaagtctagaaacaagcttatcaattgaggcaccgtggggagcaatcaatgttcagtcaacctacaaaccaactgtctcaactgcaaacatagcacttagttggagctcagtggaacacagaggcaataaggttttggtctcaggcagatcagaatcaattatgaagctggaagaaaggacaggaatcagctgggatcttggcgtggaagatgcctctgagtctaagctacttacagtttcagttatggacttgtctcagatgtactctcctgtcttcgagtacttatcaggtgacagacaagtggaagagtggcctaaagcaacctgcacaggtgactgcccagaaagatgtggctgcacatcatcaacctgcttacacaaagagtggccccactcaaggaattggagatgtaatcctacttggtgctggggtgtagggactggctgcacctgttgtggtttagatgtgaaagaccttttcacagattacatgttcgtcaagtggaaagttgagtacattaagacagaggccatagtatgtgtagaactaaccagtcaggaaagacagtgtagcttgattgaggcgggcacaagattcaatttaggttctgtgactattacattgtcagaaccaaggaacattcaacaaaagctccctcctgaaataatcacactgcaccccaagattgaggaaggtttttttgacctaatgcatgtacaaaaagtgctatcggcaagcacagtgtgtaagttgcagagttgcacacatggtgtgccaggagatctgcaggtctaccacatcggaaacctattaaaaggggacagagtaaacggacacctgattcataaaattgagcaacacttcaacacatcctggatgtcttgggatggttgtgacctagactactactgtaacatgggagactggccttcctgcacatataccggagtcactcagcataaccatgcttcatttgtaaacctgctcaacattgaaactgattatacaaaaacctttcactttcactctaaaagggttactgcacatggagacacaccacaactagatctgaaggcaaggccaacctatggtgcaggtgagatcaccgtgctggtggaagttgctgacatggagttacacacaaagaagattgaaatatcaggcttaaaatttgcaggcctaacttgcacaggttgttatgcttgtagttctggcatctcttgtaaagttagaattcatgtagatgaaccagatgaacttacagtacatgttaaaagtgatgacccagatgtagttgcagctagctcaagtctcatggcgaggaagcttgaatttggaacagacagtacatttaaagctttctcagccatgcctaaaacctccctatgtttctacattgtggaaagggaatactgtaaaagctgcaataaagaagatacacaaaaatgtgttaacacgaaactcgaacaaccacagagcattttgatcgaacataagggaactataattggaaagcaaaacaatacttgcacggctaaagcgagttgctggttagagtcagttaagagtttcttttatggtctgaagaatatgctcggtggcatatttggcaatgtttttataggcattttcacatttcttaccccctttatcttgttaatacttttctttatgtttgggtggaggatcctgttttgcttcaagtgttgcagaaggaccagaggcctattcaagtacagacacctcaaagacgatgaagaaactggttacagaaagatcattgaaagactgaacaacaaaaaaggaaaaaacaggctgcttgatggtgaaagacttgctgacagaaagattgctgaactgttctccacaaaaacacacattggc

SEQ ID NO: 4105 - RNA, 4656 nt, synthetic construct
  misc_feature 1..4656: note = derived and/or modified CDS sequence (wt) from DUGV(ArD44313)__NC_004158.1__GP
  source 1..4656: mol_type = other RNA
atgtctaagagggtactgatcatagccgtagtggtttatctggtattcaccactcaaaaccagataaccggcaaccacacaacaatcaacagcagcagcccgtccacaacagaggcaagcagcacgccaacagtcagcagaactccacaaacaaccaccacctccactgcagtatccaccaccatcaccgcaaccaccactccaacagcttcatggaccacacagagtcaatattttaataaaacaacacaacaccattggagagaagaaaccatgatctcaaggaatcctactgtgctggacagacagagcagagcaagttctgtgagagaactactcaacaccaagttcttaatgttgttaggtttcattccaaagggtgaagtcaatcacctagaaaatgcctgcaacagggaagggaaaaactgcacagaattaatactgaaagaaaggatagctcggttcttttctgagacagaaaaagagtcatgttataacacttacctagaaaaacaccttcgcagtgttagccctgaagttagtctcaccccttacagggtcctcgggctaagagaagacattttgctgaaagaaattgaccgtagaatcatcagatttgaaacagactcccaaagagtgacctgtctctcagcatctctgctaaaacctgatgtctttattagggaacagagaattgatgctaagccctccaacggtcctaaaatagtgcctgtggacagcgtcgcctgcatgaacttagaagctaacgtagatgtgagatcaaacaaattagtgatacagtctttgatgactacagttaaaattagcctgaaaaactgtaaggtcgtagtcaattctagacagtgcatccatcagcaaacaggctctggtgttatcaaagtcccaaaattcgaaaagcagcagggtggaacttggtcaagctacatcgccggggtatacacagcaaccattgacctgttagatgaaaacaaccaaaactgcaagctatttacagaatgtattgtcaaaggtagagagttggttaaaggacaaagtgaacttaagtccttcaatatagaagtcctcctaccgagagtgatgaagactagaagaaagctgttagctgtcactgatggtagcactgaatgtaactcagggacacagctaattgaaggaaagtccatagaggtccacaaacaagacataggagggccggggaaaaaactgaccatttgtaacggcactagtgttctcgatgtacccctggatgaaggacatggatgctacaccattaatgtaatcacgtccaaaagggcatgcagaccaaagaacagcaagttacagtgttcaattgacaaagagcttaagccttgtgactcaggcaagtgtttgagtatcagccaaaaaggagcaggccacattaaggtgagcagagggaaaaccattcttattactgaatgcaaagaacactgccagatcccagtaccaactggaaaaggggatataatggtggactgctcaggaggccgtcagcactatttggaggtgaacatcgttgatatccactgccctaacacaaaattcttaggaggaataatgctttatttctgtagaatgtcaagcagacctacagtagcattgcttcttggcatctggattggctgcggctatatactcacatgcatcttctcatttttgctataccacttaattttattctttgcaaactgtataaaacagtgcagaaagaaaggagagaggcttggagaaatctgtgtcaagtgcgagcagcaaacagttaaccttatggaccaagagttgcatgacctcaattgcaatttcaatctttgtccttattgctgcaatcgaatgtcagacgaaggtatgagcaggcatgtaggtaagtgtcctaaaagattagaaagacttaatgaaatagagctctatctaactacaagcgagtgcctctgcctaagtgtatgctatcaacttctaataagcgtaggcattttcttgaaaagaacaacttggctggttgtacttctggttctgttagggttagccatttcaccagttcaaggagctccaacagaggtcagtaatgttaagcaggacggtgactacagtatctgctattttatttttggttgtttggtgacagctgcacttttgttgaaggtcaagagaacaaactctaatggcattgtggtagtggtcgatagctttggaaggtgtccatactgtaatgaattcactgattcattgtttgaggaagtgcttcacgatacactatgcagtctctgtgtctgtcctttctgtgagaaacaggctcttgatctggtgacccttgaagaacatgtcaaagaatgctacaaagttgcaactaggaaggacatattcaagatattagggagaaagttcaccaatgctctagttagaagggaaaaactgttcacaacaggactgcagctcttcataaataaaacaaatgttgtcgtctttgctctcattatgtgcttcttgctactgttaacaggacataacgcaagtgcttttgattctggtgacttgccagatggggtatgggaagaatcaagccaacttgttaagtcatgtacacagttttgttatatagaagaagatgtctgctactgccctgctgaggatggcgtaggaaggaaattgctgttcttcaatggccttcagaattcagtgaaaagactttcagattctcacaagttgttgacaagtgtctcaattgatgcaccttggggtcgaattaatgttgaatcaacttggaaaccaacactggcagcatccaacattgccatgagctggagctccactgacatcaaaggtgagaaggtcatactatcaggaaggagcacatccataataaagcttaaagaaaaaactggtgtgatgtggaagctcgttgggtcaggactagcatcagaaaaaaagaaaccttttaggtttccgataatggattttgcccaagtctacaattcagtattccagtacataacaggtgatagactactaagtgaatggccaaaagccgtctgcacaggagattgtcctcatagatgtggctgccaaacatcaacttgtatggccaaagagtgccacacacaagaatgcgtgtcaacccacatggtgttgggaattggtactggttgcacctgctgtggtatggatgtggaaaggccatttaataaatatcttggtgttaagtggtcaacagaatatcttagaactgaggtgttggtctgcgtggaggtcacggaggaggagaggcactgtgaaattgtcgaggcaggaaccagattcaacattggccctataacaataacgatttctgatccccaaaacattggaagtaagcttccagaaagtttaatgacagtccaagaaattgatgacagcaactttgtcgacataatgcatgttggtaatgttatctctgctgacaacagttgtaggcttcaaagctgcactcatggcagtgcggtgactaccagatttacagcactgacagctttaatcaaagatgatcacagttctggactcaacctagctgtgttagatcccaaagtcaatagtagctggctatcatgggaagggtgtgacatggactactactgtaatgttggcgattggccaacctgtacctacactggtgtagtgactcaaaaactcagagagtttctcaaacttgatcaacatagaaaaagattacacacaacgctttcattttcactcaaaaagaatctcagcaaaaggtcacacacttcagttagacttgaaggcaagaccgtaaccaggatggaggtgaaagtgacagcactgattgaagttgatggtatggagttacattcaaagacaataaggctaagtggtataagactaactggactgaaatgcagtggttgttttagttgcacttctggcatatcatgcagcgtcaatgccaagttgacttctccagacgaatttacactgcatctgaggagcaccagtcccaatgtggtagtggcagaaactagcataattgcaagaaagggtccaagtgccacaactagcaggtttaaagtgttctctgttcgtgatacaaagaaaatttgctttgaggtagtggaaagagaatactgcaaagattgtactcctgatgaactcactacatgcactggtgttgagttagaacctaccaaagacatattgttagaacatagaggaacaatagtacagcaccaaaacgacacttgcaaatctaagattgactgttggtcaaattctataagttcattcgcatctggtataggagatttttttaagcattacattggaagcattgctgtcggagtacttggcacggttcttcctttcgcccttttaattctttttttcatatacggtgacaaaatgctttggcctttcaaagttttttgtaggccatgtagaaggtgctgtagaaaaaatgaaggatacaacaaactggctgaagaagaagagctgagagacataattagaaagttcagtaaaagtggtgaacttatcaacaaagatgcaaaagataagagaactcttgcaagactattcatgtctgacaacccaaaattaaaaaaggaaaaaaaactttctgaaattgcttaa

SEQ ID NO: 4106 - RNA, 4656 nt, synthetic construct
  misc_feature 1..4656: note = derived and/or modified CDS sequence (wt) from DUGV(IbAr1792)__KU925456.1__GP
  source 1..4656: mol_type = other RNA
atgtctaagagggtactgatcatagccgtagtggtttgtctggtattcaccactcaaaaccagatagccggcaaccacacaacagccaacagcggcagcccgtccacaaaagaggcaagcagcatgccaacagtcagcgacactccacaaacaaccaccacctccactgcagtgtccaccaccatcaccgcaaccaccactccaacagcttcatggaccacacagagtcaatattttaataaaacaacacaacaccattggagagaagaaaccatggtctcaaggaatcctactgtgctgaacagacagagaagagcaagttctgtgaaagaactactcaacaccaagttcttaatgttgttaggtttcattccaaagggtgaagtcaatcacctagaaaatgcctgcaacagggaagggaaaaactgtacagaattgatactgaaagaaaggatagctcggttcttttctgagacagaaaaagagtcatgttataacacttacctagaaaaacacctttgcagtgttagccctgaagttagtctcaccccttacagggtcctcgggctaagagaagacattttgctaaagaaaatcgaccgtagaatcatcagatttgaagcagactcccaaagagtgacctgtctctcagcatctctactaaaacctgatgtctttattagggaacagagaattgatgctaagccctccaacggtcctaaaatagtgcctgtggacagcgtgcgctgcataaacttagaagctaacgtagatgtgagatcaaacaaattagtgatacagtctttgatgaccacagttaaaattagcctgaaaaactgtaaggtcgtagtcaattctagacagtgcatccatcagcaaacaggttctggtgttatcaaagtcccaaaattcgaaaagcagcagggtgggacttggtcaagctacatcgccggggtgtacacagcaaccattgacctgttagatgaaaaaaaccaaaactgcaagctatttacagaatgtattgtcaaaggtagagagttggttaaaggacaaagtgaacttaagtccttcaatatagaagtcctcctaccgagagtgatgaagactagaagaaagctgttagctgtcactgatggtagcactgaatgtaattcagggacacagctaattgaaggaaagtccatagaggtccacaaacaagacataggagggccagggaaaaagctgaccatttgtaacggcactagtgttctcgatgtacccctggatgaaggacatggatgctacaccattaatgtaatcacgtccaaaagggcatgcagaccaaagaacagcaagttacagtgttcaattgacaaagagcttaagccttgtgactcaggcaagtgtttgagtatcagccaaaaaggagcaggccacattaaggtgagcagagggaaaaccattcttattaccgaatgcaaagaacactgccagatcccagtaccaactggaaaaggggatataatggtggactgctcaggaggccgtcagcactatttggaggtgaacatcgttgatatccactgccctaacacaaaattcttaggaggaataatgctttatttctgtagaatgtcaagcagacctacagtagcattgcttcttggcatctggattggctgcggctatatactcacatgcatcttctcatttttgctataccacttaattttattctttgcaaactgtataaaacagtgcagaaagaaaggagagcggcttggagaaatctgtgtcaagtgcgagcagcaaacagttaaccttatggaccaagagctgcatgacctcaattgcaatttcaatctttgtccttattgctgcaatcgaatgtcagacgaaggtatgagcaggcatgtaggtaagtgtcctaaaagattagaaagacttaatgaaatagagctctatctaaactacaagcgagtgccttcttgcctaaggtgtatgctatcaacttctataagcgtaggcattttcttgaaaagaacaacttggctggttgtacttctggttctgttaggattagccatttcaccagttcaaggagctccagcagaggtcagtaatgttaaacaggacggtgactacagtatctgctactttatttttggttgtttggtgacagctgcacttttgttgaaggtcaagagaacaaactctaatggcattgtggtagtggtcgatagctttggaagatgtccatactgtaatgaattcactgattcattatttgaggaagtgcttcacgatacactatgcagtctctgtgtctgtcctttctgtgagaaacaggctcttgatctggtgacccttgaagaacatgtcaaagaatgctacaaagttacaactaggaaggacatattcaagatattagggagaaagttcaccaatgctctagttagaagggaaaaactgttcacaacaggactgcagctcttcataaataaaacaaatgttgtcgtctttgctctcattatgtgcttcttgctactgttaacaggacataacgcaagtgcttttgattctggtgacttgccagatgggatatgggaagaatcaagccaacttgttaagtcatgtacacagttttgttacatagaagaagatgtctgctactgccctgctgagaatggcgtaggaaggaaattgctgttcttcaatggccttcagaattcagtgaaaagactttcagattctcacaagttgttgacaagtgtctcaattgatgcaccttggggtgcaattaatgttgaatcaacctggaaaccaacactggcagcatccaacattgccatgagctggagctccactgacatcaaaggtgagaaggttatactatcaggaaggagcacatccataataaagcttaaagaaaaaactggtgtgatgtgggagcttgggtcagaactagcatcagaaaaaaagaaacttttagtttcgataatggattttgcccaagtctacaattcagtattccagtacataacaggtgatagactactaagtgaatggccaaaagccgtctgcacaggagattgtcctcatagatgtggctgccaaacatcaacttgtatggccaaagagtggccacacacaagaaactggcggtgcaaccccacatggtgttggggaattggtactggttgcacctgctgtggtatggatgtggaaaggccatttaataaatatcttggtgttaagtggtcaacagaatatcttagaactgaggtgttggtctgcgtggaggtcacggatgaggagaggcactgtgaaattgtcgaggcaggaaccagattcaacattggccctataacaataacgatttccgatccccaaaacattggaagtaagcttccagaaagtttaatgacagtccaagaaattgatgacagcaactttgtcgacataatgcatgttggtaatgttatctctgctgacaacagttgtaggcttcaaagctgcactcatggcagtgccggtgactaccagatttacagcactgacagcttaatcaaagatgatcacagttctggactcaacctagctgtgttagatcccaaagtcaacagtagctggctatcatgggaagggtgtgacatggactactactgtaatgttggcgattggccaacctgtacctacactggtgtagtgactcaaaactcagagagtttctcaaacctgatcaacatagaaaaagattacacacaacgctttcattttcactcaaaaagaatctcagcaaaaggtcacacacttcagttagacttaaaggcaagacctaaccaggatggaggtgaagtgacagcactgattgaagttgatggtatggagttacattcaaagacaataaggctaagtggtataagactaactggactgaaatgcagtggttgttttagttgcacttctggcatatcatgcagcgtcaatgccaagttgacttctccagacgaatttacactgcatctgaggagcaccagtcccaatgtggtagtggcagaaactagcataattgcaagaaagggtccaagtgccacaactagcaagtttaaagtgttctctgttcgtgatacaaagaaaatttgctttgaggtggtggaaagagaatactgcaaagattgttctcctgatgaactcactacatgcactggtgttgagttagaacctcccaaagacatattgttagaacatagaggaacaatagtacagcaccaaaacgacacttgcaaatctaagattgactgttggtcaaattctataagttcattcgcatctggtataggagatttttttaagcattacattggaagcattgctgtcggaatacttggcacggttcttcctttcgcccttttaattctttttttcatatacggtgacaaaatgctttggcctttcaaagttttttgtaggccatgtagaaggtgctgtagaaaaaatgaaggatacaacaaactggctgaagaagaagagctgagagacataataagaaagttcagtaaaagtggtgaacttatcaacaaagatgcaaaagataagagaactcttgcaagactattcatgtctgacaacccaaaattaaaaaaagaaaaaaaactttctgaaattgcttaa

SEQ ID NO: 4107 - RNA, 4884 nt, synthetic construct
  misc_feature 1..4884: note = derived and/or modified CDS sequence (wt) from NSDV(Jilin)__NC_034391.1__GP
  source 1..4884: mol_type = other RNA
atggtgtcgttggaaaaagggttgatcctcttgctgctgatgcacatcgcaattgcctccaccggagggtcccttgggttgcctggcctaaatggtgaggaccacactgacgatccagaggttggtggcgatggtccaactgaggagtacacagaagatgaccctgaatcaacaacggtctcgatacctacgactcccccagtcttaggacaggggacagaagaggtgcctgcaacttctggagaggcggaagcagggtattctaccacggatgtgccggacactgtgtctgaaaaggtggaagatgaacaggacacgacccctagcacgcaggtgaccccagaccagccagaacaaagtacgactagtttgcctgacccctggacagcaatctcgacaaggattggtagggagctattaagcgtggagtctgacaccacaaagtcaagcttggtcactgtaggacatcctcaacagccaatattcttggatgggcagccggtagaagaagtgactcatccagtcaatgaaagagacgttactgaagctctgaggaagtatgacaaaatgaaaaaactgcttagccaaagaattttatcaaaaatgggcatggccagagacttcacagatgaggagttagacgtctggtgtcacgagcggtttgacaactgtagctctaatgacattgaaaatagaatcagggatttttttctcatcagtgatcagactgagtgctttgatgaagtgctagtgaaaaggctatgtgaatcaaccaaccctattgtaggcgagccttggcaggtggcaggtatcaaggaagaaattgttcggagagaaatgggtagaagaatctttagattcttcactccaactttgaaggtgacatgtgtgtcaggctcattgaatccttcagaccagtttgtgaggttctatgatcctgtcatagaacgaacttcaggccccactatccaaaactatgatagcatgcactgcttaaacatagagaatgggttagctaaaccatccaaaatggttgttcttaatgtattaatgacaacagtagaggttagactggaatcctgccgtgcgttcataaatgcacatcaatgcatttacacacaacatgcagatgggcaagtgatggtgcccactttcgtggaccacagtggtacaaggagaaccattggtgcgtatacaatgagcttcaacttgactgatgaaagaaatagagcatgcatcatcagaacaacttgtgtggtcaaaggaaaagaggtaaagaagggacagagtcaattgagaggtttcccaacaagtatcagactcttcaagtctgtgacaggcaaaagaaggctcatggcagaagaaggagactggactgactgcggatctggcacacagcttgatatgacaatggctgtgtctgtacacaatgacaaaaaaggaggacctggtaagaagctcaccatatgcaatggtaccacagtctcagattcaacactcaatgaagggcttggatgttacacgattaacaaggtgataacaggaaaggcatgcaaagtaggaaactccacaggatcctgtgaggtgcaaacagagctacagaagtgcgagactggaaaatgcatactggtgaaacagaaaagcaaaggagtggtgaaactgaaaagaggaaagactgtaatcataactgaatgccaaggaagctgcctctttgccatcccacaggacacaggagacatcacaattgactgctctggaggaaggcagcattacctggaaattaatatagttgacatacactgtccagggaaagacaaatggaaagggtttatgctctacatatgcagggtgtcaagcaggcctttaattgccttgacatttggattgtggcttgcagcaggctatctaataacatgccttgtttcctttatcatctacaatgctgtcctacttcttagtattgctatcaaaaaagtgaggcaagggagagaaaagaaaggagacctgtgcataaaatgtgaacagcactgcatgaacctgtatgatcaagaactacatgaactgaactgcagcttcaacctctgcccgtactgtgccaataggctttcagatgaaggactacccagacacgtaccaagatgcccaaaaaaatcagaaagattggaggagattgagctctacatcaattataccagggtcccgtgcattctgagatggatactatcaacctctgtccaagtagggacggccgtgaagagactgtcttggttcagtgtgctagtaaccctttttattctgacaatttcaccggtgcagggattcccattggagagtccacctattggcgcagcaactgacagtagaatcatgtatggggtagtggggttcatgtttgcactaataatgatgcttaatcttaaaaaatcacactacggttccatctttcatgtgatcgatggcttcggacgttgcaatctctgtgacacaagaattgacagcttgatggaagaaactgcccacgatctctgttgcatgtttgactgttgcccctactgtcaccgagtgtcagaaagtaatggatcccactgcttccacgtgaggatatgtgtggccaaagagatttccaaaaagatgttgaaggcaggaggaagattgttcaccaacaaacttgtctctagagaagggacttttgccaacaggatccaactcctttatagaaggtccaaagttgtaagcacacttgtggttacagtccttctacttcttgtccttttgaagccaaccactgcctttgactcaggcccccttcccgacggcacctgggaagaagaagaaaaacttgtcaggaactgtggacaagaatgcattctagatcaaggcgagtgcctatgcccaggagagcacagagccgggagaaaactccttttcctaaatgggctccaagacgccgcacgtagaatgactgaatctcacagactcctcacaagtgtttccatagacgccccctggggtgcaataaatatagagtccactttcaagcctgtacttgctgcatcaaacatcgacctgagctggaactcagcagaagaacaaggagacaagattatactttctggaaggtcaacaggaatcataaaactccaggaaagaactggtctgatgtggaagatgtcatcagaaaaggcatcagaaagcaaaaaccttcttgtttcagtgatggatttttcccagctctacaattccatatttcagtatataacgggtgacaggagtctttcagaatggccaaaagctgtctgcacaggagattgtccggataggtgcggctgtcaaacatctacatgttaccacaaagaatggccgcacactagaaactggagatgcaatcccacttggtgctggggcatcgggaccggttgcacctgctgtgggatggatgttgagaggtactttaataaatacttcggtgtgaaatgggccttagaatatgttagaactgatgtagtagtgtgtgtggaactcacaaatgaggaaagacattgtgaccttgtgcaggccggaagccgcttttccataggtcctgtgtctgtaactctgtctgacccccagaatgtggtgaaccgtctctcgagcaacatcatgacaattcaagaaattgctgataacggcatcttggacttgatgcatgtgagcaaagtcatatccgcagagaatgcctgcaaacttcagagctgtacacatggaagcccaggagatctccaaatccttcacactgacaacctaataaagggtgacatgtcaggaggtatcaacctcgctcacctggacccacaagtcaatacaagctggatgtcgtgggaaggttgtgacttagattattactgcacagttggtgattggcctagctgcacgtacaccggagtgaattctataaatacagatagtttcaccaatctcataaacacagagaccgattacacaggcaagttccactttcactccaaaaggatttcagctagagatgacactttgcaaatggatctgaaagcaagacctaactccggaggcggtgaaatgacagttttggtagaggttaatgggttggagctgcattcaaaaaggataagtctcaaagggctacggctaactaatttgaagtgtgatggttgctttgcctgcagtcaaggcctgacatgcacgataactgcaaagttagagtcaccggacgaatttaccatccacctgagaagcaccagtagggacgtggtggttgctgagaccagtgtaacagccaggaaggtagagacaggagctaggagcggcttcagagcctttgcagtaagggatgtaaagaagttgtgcctggaagtggttgagaaggactactgtccttcctgcaccgtagaagatttgaagatatgtgttgatgtgtctcttgagccccctaaagacatactcattgagcacaaagggaccatcatacagcactacaacaaaagttgtgatgagggatataattgctgggttggatctgtttctggattctttgttggagtgaaagacttttttgaaaagaaccttggaggtgtacttattggtcttgtaagcacaatacttcctttagtgctgacagttctgttctttatttatggcaagaagctgttctgcctgtgccgactgtgccacaagaaatgttgtagaggctcaggaaggggaagagatggctacagtagattatcacaagaggaggaaatcaaggaaataataaaaaaattcagcaggaacggcgaactactagggaagggtgaaaatgacaaaagaactgtggcaaggatgttcatggatgggcaaagtacaaagaaggcaatcaaggaagtagcttaa

SEQ ID NO: 4108 - RNA, 4884 nt, synthetic construct
  misc_feature 1..4884: note = derived and/or modified CDS sequence (wt) from NSDV(708)__EU697952.1__GP
  source 1..4884: mol_type = other RNA
atggtgtcgttggaaaaagggtttttcttcctactgctgttgcacatcgttacggcctccacaggaggaccccctgggttgcccggaccaaatggtaaggaccagactgatggtccggaaggtggcggtgatggtcctactgaggaatacacagaagatgattttgagtcaacaacattctcgatacccacgacccccccagtctcagaacaggatgctaaagaagtgtctgcaacttcggaagaggcagaagtggaggattcaaccttgattgtgccaaaaactatgtctgaaaaagtgggagatgaacaaagcacaacttcgaacatgcaggtgaccacaagccaaccagaacaaagcacaactggcatgcctggtccctggatggcaagctcaataaagataggtagagagttgttgagtgtagagtctgacaccacaaagtcaagcctggtcactgtggggtatcctcaacagccgatattccttgatgggcagcctgtagaagaggtgacccaccctgtcagtgaaagagatgttgccgaggccttgagaaagtatgacaaaatgaaaaaactccttagtcaaagaattttatcaaagatgggcatggccagagatttcacagatgatgagttggatgcctggtgtcatgagcgatttgacaactgcagctccaatgacatcgagaatagaattaaggactttttcctcatcagtgatcaaactgagtgctttgatgaagtgctggtgaaaaggttgtgtgaatctaccaatcccattataggtgagccttggcaggtggcaggtatcaaggaggaagtcgtgcgtagagaaatgggcagaaggatcttcagattcttcactccaaccctaaaggtgacatgtgtgtcagggtccttgaatccttccgaccagtttgtaaggttctataatcctgttatagaacgaacttcaggccctactatccaaaactatgacagcatgcactgcttaaatatagagaacggtttaattaaaccatccaaagtggtcatccttaatgtgctaatgacaacagtggaagtcaggctggaatcttgccgtgcatttgtaaatgcacaccagtgcatttacacacaacatgcagatgggcaagtgagagtacccacctttgtagaccacagtggcacaaaaagaaccattggtgcttacacaatgagcttcaacctgactgatgaaaggaacaaagcatgcatcatcagaacaacttgtgtggttaaaggaaaagaggtaaagaaaggccaaagtcagttgagaggtttcccaacaagtatcagactttttaagtctgtaacaggcaaaagaaggctcatggcagaagaaggagactggactgactgcggatctggcacacagcttgatatgacaacagctgtgtcagtgcataatgatagaaaaggaggacctggaaagaagctcaccatttgcaatggcaccacagtctcagattcaacactcaatgaaggacttggatgttacacgattaacaaagtgatgacaggaaaagcatgcaaggtggggaactccacaggatcctgtgaagtgcaacctgagctacagaagtgcgagaccggaaagtgcatactggtaaaacagaaaaataaaggggtggtgaaattgaaaagagggaagactgttatcataactgagtgccagggaagctgcctttttgccatcccgcaggacacaggggacatcacgattgactgctctgggggaaggcaacactatctggaggttaacattgtggacatacactgtccagggaaagataaatggaaagggtttatgctctacatgtgcagggtgtcaagcaggcccttgattgctttgacatttggattgtggcttgcagcaggctatctaataacatgccttgtttcctttatcatctacaatgctgtcctacttcttagtattgctatcaaaaaagtgaggcaagggagagaaaggaaaggtgacctgtgtataaaatgtgaacaacactgtatgaatctgtatgatcaagaactacatgaactgaactgcagcttcaacctctgcccttactgtgccaacaggctttcggacgaaggacttcctagacatgtgccaagatgcccaaaaaaaacagagagattggaagaaattgagctctacatcaactatacaagagttccttgcattcttagatggatactgtcaacctctgtccaggtaggaacggctgtgaagagattatcttggttcagtgtgttggtgatcctttttgttctgacaatttcaccagtacaggggttccccttagagaacacacccattggttcaacaactgacagtagaatcatttacggagtggtaggattcatatttgcactaataatgatgctcaatcttaaaaaatcacactacggctccatcttccatgtgatcgatggcttcgggcgttgcaacctttgtgatacaagaattgacagtctgatggaagaaaccgcccacgacctttgttgcatatttgactgttgcccttactgtcaccgagtgtcagagagtaatgggtcccactgcttccatgtgagaatgtgtgtagccaaagaaatttctaaaaaaatgttgaaggcagcaggaagactgttcaccaataagcttgtttctagggaagggatttttgctaatagggtccaactcctttatagaaggtccaaggttgtgagcacatttgtggttacagttcttctacttctcgtctttttaaggccagcaactgcttttgactcaggccctcttcccgatggcacctgggaagaggaagaaaggctcgtcagaaactgtgggcaagaatgtgtactggatcaagatgagtgtctgtgcccaggggaaaacagagccgggagaagacttctctttctaaatggacttcaagatgctgtacgtagaatgactgaatctcacagacttctcacaagtgtttctatagatgccccttggggtgcaataaacatagagtctactttcaagcctgtacttgctgcatcaaacatcgacctaagctggaactcagcagaagaacaaggagacaagattatactttctggaagatcaacaggaatcataaaattgcaagaaagaactggtctaatgtggaggatgtcatctgaaaaagcatcagaaagtaaaaaccttcttgtttctgtcatggatttctctcagctctataattccatatttcaatacataacaggtgatagaagcctttcagaatggccaaaagctgtctgcacaggagattgtccggacaggtgcggctgtcaaacatccacctgttaccacaaagaatggcctcacaccagaaactggaggtgcaaccctacttggtgttggggtatcgggactggttgcacttgttgtgggatggatgtcgagaagtacttcaacaaatacttcggtgtgaagtgggctctagaatatgtaagaactgatgtggtagtgtgtgtagaactcactaatgaggaaagacactgtgacctcgtgcaggctggaagccgtttctccataggccctgtgtctgtgacactgtcagatccccagaatgtggtgaaccgtctctcgagtaacattatgacaattcaagagattgctgataacggtatcttggacttgatgcatgtgagcaaagtcatttcagcagagaacgcctgtaaacttcaaagctgtacgcatggtagtcctggggacctccagatccttcataccgacaacttaataaagggtgacatgtcaggcggtatcaacctcgcccacttggacccacaagtcaacacgagctggatgtcatgggaaggttgtgacttggattattattgcacggttggtgactggcctagctgcacatacactggagtaaactccataaatacagacagcttcaccaatcttataaacacagaaactgattacacaagcaagttccattttcactcaaaaaggatctcagccagggatgatactctgcagatggatttgaaagcaaggccaaatactgggggcggtgagatgacagttttagtagaagtcaatgggctggaactgcactcaaaaagaataaacctcaaagggctacgactgaccaatctgaagtgtgacgggtgtttcgcctgtagccagggtttgacatgtacagtaattgccaaactggtgtcaccagatgagttcaccatccacctaagaagcactagcagagacgtggtagttgctgaaaccagtataaccgccagaaaggtagatacgggagctaggagcagctttagagctttcgcagtgagggatgtaaagaagttgtgcctagaagtggttgagaaggactactgtccttcttgcaccgtggatgatttgaagatgtgtgttgatgtgtctcttgagccccctaaagacatccttattgagcataagggaactattatacagcactacaacaaaagctgtgatgaagggtataactgctgggttggatctgtttctggatttttcgttggggtgaaagatttctttgaaaagaacctggggggtgtgcttattggacttgtgggcacaatacttcctttagtattgacaattctattctttatatatgggaaaaaattattttacttgtgcagactgtgccataagaaatgttgtaaaggctcaggaagagggagagatggttacagcagaatatcacgagaagaggaaatcaaggagataataaaaaaattcagcagaaacggtgaacttcttgggaagggcgagaatgacaagagaactgtggcaaggatgttcatggatgggcaaagcacaaaaaaggcaatcaaggaagttgcttaa

SEQ ID NO: 4109 - RNA, 4875 nt, synthetic construct
  misc_feature 1..4875: note = derived and/or modified CDS sequence (wt) from NSDV(779)__HQ286599.1__GP
  source 1..4875: mol_type = other RNA
atggcattagtggcaaagggtttaatcctcatgctactactatatatgttcaaggcctctgaagtcaaccttgaactccctagttggaacagcactgaagggacagagtatgctgatgaactgcccactgaacctccttcggaagaggagcccaaactagcagcagttagcacggtcaccacaccagcacctcccaaagagtctactgaagacaccatcgagagccctgatggaggggaaacaatggcacccacaaccccagcacctgtgactgattcagccagtaaactggaagaggagccaggcacaacccagcaggcccagtcaactcaaatgcagaacagccaggcaccgataggaatgcctgaagcctggtcgacaagtccctcgagagttggtagaaaacctctaagtgctagccctgatgtgtctgagccagaccagaacacagaagcacaaacacatccaccagtcttccttgacggacggcctgtagaagaagaagaacactcagttggcacaagagatgtagctagtgatctaagagaatacaatcaaatgaaacaactcttgagccaaagaatactagcaaagatgggtatggctgtagactttaccgatgatgagttggacacttggtgttacagaagatacagcaattgtagctcaaatgacattgaatcaagaattagggacttcttcctcattactgataggtctgagtgctttgatgaagtcctggtgaaaagattgtgtgagaccaccagcccgattatagatagggcttggaagatagcaggactcaaagaagaagttgtcttgagggagatgggaagaaggatctttaggttttttacacctgccctaaaagtgacatgcatgtctggctcattaaatccctctaatcaatttgtaaggttctacaatcccactttagaaaggacatcaggccctaccatccaaaactacgatggcatgcactgtctaaacatagagaatgggctcatcaaaccttccaaagtggttgttatcaatgttctgatgaccacagttgacatcagactggaatcctgccgagcattcataaatgctcaacagtgtacttatacccaacatgctgatggactggtgagggtgcctacctttgtgggtcctcatggtgaaaagaggattattggtgcctataccatgagcttcaacctaactgatgaaaagaacaaagcctgcacaatcaagacaacttgtgttgttaagggaaaggaagtaaaaaagggacaaagccaacttagaggttttcctacaactatcaggctctttaagtctgtaacaggaaagagaaggctcatgtcaaatgaagaagagtggactgaatgcggttcagggacgcaactaaacatggcaacagctgtctcagtgcacaacgacaagctaggaggacctgggaaaaagctcactatctgcaatggaacaacagtctcagacattgctctaaacgagggtcttgggtgctacacaataaacaagatcattacagggaaggtctgcaagacaggcaatacaacaggttcttgtgaagtgcaaccagagctgcagaaatgtgagacaggaaaatgcatactgatcaagcaaaagaacaagggtgttgtgaaattgaagaggggcaagactgtgattataacggaatgccaaggaagctgtctttttgcaataccacaggacacgggagacattacaattgactgctctggtggaagacagcattacctggagatcaacattgtagatatacactgcccagggaaggataaatggaagggcttcatgctctacatatgcagagtctcaagcagaccactcgttgctctaacatttggaatatggcttacagcaggctacttgataacttgtctggcctccttcatcctgtacaatgccatactgcttattagcattgcaatcaagaaactgaaacagaagagagaaaaaaaaggtgacctatgtataaagtgtgagcagcactgcatgaacctgtatgatcaggaattgcacgagctaaactgcagctttaacctatgtccttactgtgctaataggctctcagacgatgggctcccaagacacgtgcccagatgtcccaaaaggggagagaggttagaagaaattgagctctatatcaattatacaagagtaccctgtcttctgcggtgggcgctctcaacttctgtccaagttggcacagttattaaaagattgtcttggttcggcgtgctactaacactattcttcttgactatatctcctgtgcagggctttccactggaaaatccacccatcggcacagcaactgacagcaacatcatctacggactggccgggttcatatttgcgctcgtgctaatgctgaatctaaaaaaaacacactatggatctgttttccacgtgattgacggccttggactctgcagtctctgcgatacaaggatcgatagtctgatggaggagactgctcatgagctttgctgtgcctttgactgctgtccctactgtcatcaggtgtctgaaagcaacggttctcactgttttcacatgaggatctgtgtgtccaaagaaatatcaaagaagatgctaaaagcagcaggcaaattatttaccaacaaacttgtctcaagagaaggcttttttgccaacaaaatccaactcttgtaccagaggtctaaggttgtgagcacacttattttaacagtccttctgctcttaattatcttgaagcctgcagcagcctttgactcagggcctcttcccgacggtacctgggaggaagaagagagtctcataagaagctgcgatcaagagtgtgtgcttgaacaggatgagtgcctgtgtcccggagaacatagggctggaaggaggctcctttttctgagcggccttcaagatgctgcaaggaggatgacagagtctcacagactacttacaagtgtctcgattgatgcgccctggggtgcgataaacattgaatccactttcaagcctcttcttgcagcatccaacattgacttgagttggaactcagcagaagaacagggagacaaaattgtactgtcaggtagatccacaggtatcataaagctacaagagaggactggtctgatgtggaaaatgtcatctgaaaaggcttctgaaagtaaaaatcttcttgtgtctataatggacttctcacagctttacaactcaattttccagtacatcacaggtgacagaagcctttcggaatggccaaaggctgtatgcacaggagagtgccctgacagatgtgggtgtcaaacctccacttgttatcataaagagtggccccacaccaggaactggagatgtaaccctacgtggtgctggggcatcggaactgggtgtacttgttgtggaatggatgttgaaaggtacttcaacaagtactttggggtaaagtgggcattggagtatgtaagaactgatgtggtggtttgtgtggagctgaccaatgaggaaagacactgtgatttagttcaagctggcagtcgcttttctatagggccagtctctgtgacactgtcagaccctcaaaatgtggtaaacagactatcaagtagcataatgacaatacaggagatatcagacaacgggatcttagatgtcatgcatgttagtaaagtaatttcagcagaaaatgcttgcaaacttcaaagttgcacacatgggagcccaggagatctccagatccttcacactgacaacttaataaaaggtgaaatgtcatccggcataaatcttgctcacctggaccctcaggttaacacaagttggatgtcgtgggagggttgcgatctagactacttctgtacagtgggagattggcctagctgcacgtatacaggagtgaactccataaatacagacagcttcacaaacctcataaacacagaaactgattatacaagcaagtttcatttccactcaaaaagaatttctgctaggggtgacactctgcagatggatttaaaagcaagaccaaacgttggaggtggagaaatgacagttctggtggaagtgaatggcctggagctgcactcaaaaaaaataagccttaaaggattaaagctgtctaacctcaagtgcagtggatgctttgcttgtagtcctggtctgtcgtgcacagtgattgccagattagaatcaccagatgagttcactatacatttaagaagcaccagcagagatgtggtggttgctgaaaccagtgtgacagctagaaaggcagaaacgggggccaagagcagttttagggcctttgctgtgaaagatgttaaggagatatgtctagaggtggtcgagaaggaatattgtccgtcttgctccatagaagacttgaaaatttgcattagtgtcactcttgagcctccaaaggacattctcattgagcataaaggcaccattgtacagcattacaataaaagctgtgatgagggctacaactgctggattggatctgtctctgggttttttgtaggggttaaggatttttttgaaaaaaactttgggagtgtgatcattggaattgtcagcacagttcttcccttgatactcactgttttgttctttgtctatggaagaaggctattttgtctgtgcaggttatgtcacaagaaatgctgcagaggttcatctagaggaagagacggttacagcagactgtcacaagaagaagaaataaaagaaataataaaaaaattcaacagaaatggagagttactgggaaggggcgagaacgataaaagaactgtagcaaggatgttcatggatagccaaagtgcaagaaaagcagttaaagaggttgcctag

SEQ ID NO: 4110 - RNA, 4302 nt, synthetic construct
  misc_feature 1..4302: note = derived and/or modified CDS sequence (wt) from BUNV__NC_001926.1__GP
  source 1..4302: mol_type = other RNA
atgagaattctaatactgcttttagcagtcactcaactggctgtgagtagcccagttatcactagatgctttcatggtgggcaactgattgcagaaaggaaatcccaaacatcgatttcagaattctgcattaaagatgacgtttctatgttaaaatcagagattgtctacacaaaaaatgatactgggatttttggccacagtaaagtgtttcgtcactggacgatcacagactggaaagcatgcaaccctgttgttacggccggtggtagtataaatgttatagaggttgataaaaatctaaaccttgtaactagaaattatgtgtgcacaggggattgcactataacagttgataggaaaaatgcccaaattatatttcagacagacaaacttaatcattttgaagtgacaggaactactatcagcactggctggtttaagtctaaagcatctgttactctcgatagaacatgtgaacatataaaagtaagctgtggaaagaaaacattacaattccatgcttgctttaagcaacacatgtcttgtgttcgattcttacacaggagcatactaccagggtcaatggcaatttcgatctgccaaaatattgagctgattataataacaatattggcattatgtatatttataattatgataatcttaacaaaaacatacatttgctacgtgttgatcccagtgtttatgcccatagcttttgcttatggatgggcgtacaacaggagttgtaagaaatgcacttgttgcggattggcatatcatccctttacaaactgtggctcatattgtgtctgtggctccaaatttgaaacatcggacagaatgaggatgcaccgagaatcagggttatgtcagggttttaaaagcctgagagtagcaagaaggctttgcaaatcaaaaggctcatcattgatcatatccatcttactctcagtgctgattctatcctttgtaacacccatagaagggactctcacaaactaccctactgatcagaaatatactttagatgagatagcagatgtccttcaagctaaaacacatgaagattctacaaaatactatataatattatatacatcactcttcggtgcaggtctgaccatcatttttgcaggagtagcattggggttaacaattatactagaagtattaaccaagattaatgttattttttgcaacgaatgcaacatgtaccatagcaaaaaatcaatcaaatatgtaggtgatttcactaataaatgtgggttttgtacgtgtgggctgctagaggatccagagggtgttgttgtacataaagctaaaaaatcctgtacatattcatatcagattaactgggtcagaggcatcatgatatttgttgcctttttatttgtaatacagaatacaattataatggtcgcagcagaagaagactgctggaaaaatgaagaattaaaagaagattgtgtagggcctttaattgcacctaaggattgtactgataaagaccataaaacctacttgagtgaggcttcattgttagcaacagcaaagaaaataactcaggtggatgctgaaaatgtggagatattggggaaaactatggaatcagcaattagagtaattgaaagacagaagacataccacagaatgcacttgcttgaggcagtatttctaaataagcactgcgattattataaaatgtttgaacataacagtggatattcccaagtaaagtggaggatgatgataaaaacacaacactttgatatctgtgccttacaagcaaatagcccgttttgtgctcagtgcattgctgacaattcttgtgcgcaaggttcttgggaatttgatacacatatgaactccacatattcaagtaaagtcgacaattttaaacatgacttctctctattcctcagaatctttgaagcagcatttccaggcactgcttatgttcacttgctaacaaatataaaagaaaagaagccctatcaggcagtcagcatgattgagaaaataaagaagaagtttccgaataataaactgcttattggatatttagattttggcaagtacttgctaggcttaagtcatgcaagcacatacgagttgcaacagagacaactagataagttatatcagccaacagaattaacccgatctggtggtcaacaaacatcattagcaaattctgtagtaggtcaagcaacgaaagaatgtaaaaagtacaaagatgttagttgcttaagcccaagatttggaattccgctggaagatttaataagctgctgtgaccaaccaaattacaatatttataaaaagccaaaaaaagtctacaaagctcatgacaaagaagaaacatggtgcattaatgatcagcattgcctagtagactttgtcccagctgaagccgatactgtagaaaaattgaaacctatgaaatgttggttagttgaccctggcaagaatgatgatgtctactctattgcaataaaaacatgtagagtggttgataagggagtttgtactgttaattcacaaaaatggaatataatcaaatgtgattctggtccgctctactacagtgaccacataccaggggaagatacaggcaatgatataggacattattgtgtatcagcaggatgcaaaactgacagatacccaattaatcctgatgttgttactgactgtgtgtgggaatttacttctaggaaatcacaatatataggcaagatctccatgcagtctcttgaagattacgaaaaggctttaactgacagattgacccataccttggaaacctatagttttgccccgttagaaaatctcccgcatataaaaccagtttacaaatatattactgcacaaggagtcgaaaactcagacggtatagaaggggcattcataacagccagtatcccagccgctgggggcactagcataggctacaatgttagatcaaaagatggcttcccactccttgatctaatagtttttgtgaagagtgctgtgataaaaagcacatacaaccatatatatgatactgggccaacaattagcataaatacaaagcatgacgaacattgcactggccaatgtccaagcaatatagaacatgaggctaactggttgacattttcacaagaaagaactagcagatggggatgcgaagagtttgggtgcttggctgtcaacacaggttgtgtgtttgggtcttgtcaagatgtaattagaccagaaacaaaagtttacaggaaagctgtagatgaagttgttattttaacagtttgtattacatatccaggacacactttttgcacagaaattaatgccatagagccaaaaataacggaagaaattgaactccagtttaaaacagttgacacgaaaacactaccatatatagtagccgtaaacaatcataaactttatagtggtcagataaatgatttagggacatttgggcaaatgtgcggaaatgtccaaaaaacaaacagcagcattttaggaactgggacaccaaaatttgattatacttgccatggtgctagtaggaaggatatcattgttaggagatgctataataacaattttgactcctgcaaacttctaaaggaagaaacacagcttatatttaatgatgaccatgatacaataactgtttataatacaaatcacttaattggtgagttagctataaaattgatattaggggatatccagtataaattattcacagaaacattggacctccagattgatgcgaaatgtgttggctgccctgattgctttgagagctattcctgcaatttccaaatagtatcaaatatagacacaatctgcagccttgaagggccttgtgacacattccataataggatctcaattaaagcaatgcagcaaaattatgctgtaaaactctcctgccagaaggatccaagaccatcagggacttttaaaatttgcaacagggaatatactgttgtcttccatacagtagcaaaagatgacaaaatagaaataaatgttggagaccagacttcattcattaaagagaaagatgacaggtgcaaaacatggctgtgtagggtcagagatgaaggtattagtgtaatttttgaaccaattaaagccttctttgggagttatttcagcatcttcttctacataattgttgttgtagtagtgggatttttaataatatatatttttatgccaatgtttatgaagttaaaggaagtgttgaaagcaaatgagaagctttacttgcaagaaattaagcaaaagtga

SEQ ID NO: 4111 - RNA, 4311 nt, synthetic construct
  misc_feature 1..4311: note = derived and/or modified CDS sequence (wt) from BUNV(SFCrEq231)__KP063893.1__GP
  source 1..4311: mol_type = other RNA
atgaagatgattcttctaataataatactatgtgtgaaccttgctgctgccaatccagtagcaacaagatgtttccatggaggtcaattaatagcagagacaagatctgcaacatcgatttcagagttctgtttaaaggatgacgtttctatgataaaatcggagataacctatacaaaaaatgatactggcatcttcggccatagcaaaatatacaagagttggttaataaaagattggaagctttgcaacccagtaccaactgcaggtggaagtataaatgttatagaagtgaactctgatttgagtttaactacaaaggcatatgtttgtagcagagattgtactataacaatagacaaagaggaggctcagattatattccaaacagacaaactcaaccattttgaggtatctggcacaaccctgagttcaggttggttcaaaacaaaagcttctgtaacattggatagaacttgtgagcatataaaagtaacttgtggcaaaaaaacattgcagtttcatgcttgttttagacaccacatgtcatgtgtaagatttttccacaacacaatattacccggtactatggtcaattcaatgtgtcaaaatatagaactaattataatattaggcttaacattaatcatatttacattaatggttatactgacaaagacctatatctgttatattctaatgccactatttatgcctattgcatatgcttatgggtgggcatacaacaaaagttgcaaaaaatgcaattgctgtggtctagcatatcacccatttactaattgcggatcccattgtgtctgtggcttaaagtttgaagcttcagataggatgaggatacacagagagtctggcctctgccaaggctataaaagcttaagaatagcacgattattatgtaaatccaaaggctcatccttaataatttccaccctactatctatgctacttctaagttttatcacaccaattgagggaacaatgacaaattacccagaaacaaggcaatactctcttgaagagattgctgatgttgttgaggggcttttatcagagcaaaatattaaagaatatgttgttttctatacatcattattcgggagcttaatattactattggcattcattttatcaatcactctgacaaaagtaactaatgctctagccagaacaaatgtaatttactgtgaagaatgctcaatgtaccatgcaaagaaaggcataaagtataatggtgatttcacaaacaaatgtggattttgcacttgtgatgaacaggaagatgaagagggcataataatacataaagtaagtaaaaaatgcacatatagatatcaactacagtgggctaagatcattatgataatattagttatgttgttgatgatgcaaaatacaatacttattgttgctgccgaaacagactgttggactaagaattcactagagttagattgtattgggcctctactcaccatcagtgattgctcaaacaaagagagtaaaaattatgaagaagaagcagcaaaacttgttagtcaatccaaaataacacaggcagatgcagaacaggttacaatattaggcaacacaatagatacagcactcaaagcaatcagatcacaaaaaacatatcaaactatgcatttattggaatcagtgtttttgatgaagaattgtgattattatagcagttttgaacccaatagtggatactctcaggcaaaatggagattaattgcaaagacaagtcactttgacatatgttctagacatagcatgcaccatttctgcagatgtgtcgcagatggcaccaaatgccaaaacggtgattgggattttgctggagagatgaataatatatacagtactaaaaatgacttttaccttcatgacttgaatttatttttcaccttacatgagacagcctttccaggtacaactgaatccttattttatcagctgattgcaaaaaagaacactacaggtgcttctaagctgcttgggaaattaattacaaaatatggtaacaacaagctgttcgttgggatatggaaattcggccaatatttattgactttaccatatgtaaatacaacagagttatccaagactaggagagagacaatattgaaaacacatcagatcttgacaagatctcagggaggaagatcagaatctatgtctagtgctgaggtgggtcaaatagctaaagaatgtgctaatgcaaagaatgttggttgcattagtcctaggtttgggatccctattggtaatctaactgcttgcggaaatagccctaattataaaatatataaaacacctaacaagatctataagtcaaacaacagaggtgaggtgtggtgttcagaagatgttcattgcctggccgattttgaacctgctgacacagaagtagtcaacaaagttaagaagatgacatgcttcttgtctgatgtgaacactagagcagatattttctctattgcaatttctgcatgcagaatggttgataaaggagtgtgtactgttaatggtgcaaaatggaatatattgaagtgtgagagtggtctttattattttactgatcatagggaaggacaagacactggaaatgattttggagaatattgcatctctcatagttgcaatacagagaggtacccaatcaacccagacatattaaaagagtgtatatgggaatatcactctaggaaatcaaaatatatctcaactatcaacttagaatccctagaggaatttaaaagggcaatgtccgataaattatctcacactttgatggtttataactttaaaccgactgcaaacttaccacacataaaaccaagttataagtttattactgcaaatggtattgaaaactcagatggcttagaatcagcatatatactttcaagtattccagctataggaggaatgagtataggttataatatccaaacaaaagacaatttccccttactagatttaatagtctttgttaaaagtgcagtgataaaaacaacatacaaccatatttatgatactggtcccacaataggaattaatacaaatcatgatgaacactgcacagggccctgtcctacgataataccacataaagagaattggctaacattctcacaagaaagaacaagtaggtggggttgtgaggaatttggatgtctagcaatcaatactgggtgtgtatttggatcatgtcaagatgtaatacatcccgagacaaagatctatcggaaagctgttgaagaggaggttgttctaactgtttgtataaattttccaggcaatacattctgtacagagataaatgcaattgagcctaaaattacagatgagatagaacttcagtttaaaaccgttgatacaaaaacattaccaaatttgctagcagttcagaatcataagttatatagtggtcagataaatgatttagggtcattttcccaaggatgtgggaatgttcaaaaaacaaatcagtcaatacttggtgctgggacagtaaagtttgattatgtgtgccatggtgcaagcaggaaagatataatagttcgtagatgctacaccaacaattatgattcatgcaaactactcaaagaagagagatccctgatatttgctgataaccatgaaactttagaagttgcaaacactaggcatttgattggagaattgcaattcaagattatgttaggagatattcgatataaggcctttgcagaaaagcctgagctggaaattgatgcaaaatgtgttggatgcccatcatgtttcgaaagctattcatgtaatttccaaatagtgactagcatagatacagtctgctctgttgagggaccttgtaccttgtttcataatagaattattatcacagctgcaaaacaatcatatggagttaaaatgagttgcaagacaaagccaggaccagttgaagaattcacaatatgtaatcggaattatagagtaagttttgctactattgataaaaatgataaaattgagataaacacaggggatcaaacttcttacatagttgagaaagatagcagatgtaaaacatggttatgcagagtcagagatgaagggatcagtgtcatctttgagcctctaaaagcattctttggtagttactttagtatagccttctatattatcataggaattgctgctttattcctcataatatatattttcctacccatgtttttcaaacttagagatgttttgaaaaagaatgagtatttatatttgcaagaattaaaacataagtaa

SEQ ID NO: 4112 - RNA, 4302 nt, synthetic construct
  misc_feature 1..4302: note = derived and/or modified CDS sequence (wt) from BUNV(GSA/S4/11232/WT)__KM507339.1__GP
  source 1..4302: mol_type = other RNA
atgaggattctaatactgcttttagcagttactaaactggctgtgggtagcccagttgtcactagatgctttcatggtgggcaactgattgcagaaaggaaatcccaaacatcaatctcagaattctgcattaaagatgacgtttctatgttaaaatcagagattgtctacacaaaaaatgatactgggatttttggccacagtaaagtttttcgtcactggacaatcacagactggaaagcatgcaaccctgttgttacagccggtggtagtataaatgttatagaggttgataaaaatctaaaccttgtaactagaaattatgtgtgcacaggggattgcactataacagttgataaggaaaatgcccagattatatttcagacagacagactgaaccattttgaagtgacaggaaccaccattagcactggctggtttaagtccaaagcatctgttactctcgatagaacatgcgaacatataaaagtaagctgtggaaagaaaacattacaattccatgcttgctttaagcaacatatgtcttgtgttcgattcttacacaggagcatactaccagggtcaatggcaatttcgatctgccaaaatattgagttgattataataacaatattagcattatgcatatttataattatgataatattaacaaaaacgtatatttgctacgtgctgatcccagtatttatgcccatagcttttgcttatggatgggcgtacaacaggagttgtaagaaatgcacttgttgcggattggcataccacccctttacaaactgtggctcatattgtgtctgtggctccaaatttgaaacatcagacagaatgagaatgcaccgagaatcagggttgtgccagggttttaaaagcctgagagtagcaagaaggctttgcaaatcaaaaggctcatcattgatcatatctatcttactctcagtgttgattctatcctttgtaacacccatagaggggactcttacaaattaccctactgatcagaaatatactttagatgaaatagcagatgtcctccaggctaaaacacatgaagattctacaaaatactatataatattatatacatcactttttggtgcaggtttgactatcatttttgcaggagtagcattgggattaacaattatactggaagtattaaccaaaattaatgttattttctgcaacgagtgcaatatgtaccatagcaaaaaatcaatcaaatatgttggtgatttcactaacaaatgtgggttttgtacatgcgggctactagaggatccagagggtgttgttgtacataaagccaagaaatcctgtacatattcatatcagattagctgggtcaaaggtatcatgatatttgttgcctttttatttgtaatacagaatacaattataatggtcgcagcagaagaagactgctggaaaaatgaagaattaaaagaggattgtgtagggcctttaattgcacctaaggattgtactgataaagatcgtaaaacctacttgagtgaggcttcattgttagcaacagcaaagaaaataactcaggtggatgctgaaaatgtagagatattggggaaaactatggaatcagcaattagagtgattgaaagacagaagacataccacagaatgcacttgcttgaggcagtattcctaaataagcactgtgattattataaaatgtttgaacataacagtggatattcccaagtaaagtggaggatgatgataaaaacacaacactttgatatctgtgccttacaagcgagtagcccattttgtgctcagtgtattgctgacaattcttgtgcacaaggctcttgggaatttgacacacatatgaattccacatattcaagtaaagttgacaattttaaacatgacttctctctattcctcagaatttttgaagcagcatttccaggcactgcttatgttcacttgctaacaaatataaaagaaaagaagccctatcaggcagtcagtatgattgagaaaataaagaagaagtttccgaataataaattgcttattggatatttagattttggcaagtacttgctaggcttaagtcatgcaagcacatacgagttgcaacagagccaactagataaattatatcagccaacagaactaacccgatctggtggtcaacaaacatcattagcaagttctgtggtaggtcaagcaacgaaagaatgtaaaaaatacaaagatgttagttgcttaagcccaagatttggaattccgctggaagatttgataagctgcggtgaccaaccaaattacaatatttataaaaagccaaaaaaagtctacaaagctcataacaaagaagaaacatggtgcattaatgatcagcattgcctagttgactttgtcccagctgaagctgatactgtggaaaaattaaaacctatgaaatgttggttagttgaccctggcaagaatgatgatgtttactccattgcaataaaaacatgtagagtgattgacaaaggggtttgtactgttaattcacaaaaatggaatataatcaagtgtgattctgatctgctctactacagtgaccatgtaccaggggaagatacaggaaatgatataggacattattgtgtatcagctggatgcaaaactgacagatacccaattaatcctgatgttgtcactgactgtgtatgggaatttacttctaggagatcacaatatataggcaagatctccatgcagtctcttgaagattacaaaaaagctttaactgacagattgacccataccttggaaacctatagttttgcaccattagaaaacctcccgcatataaaaccagtttacaaatatatcactgcacaaggagtcgaaaactcagacggtatagaaggggcattcataacagccagtattccagctgctgggggtactagcataggctacaatgttaggtcaaaggatggctttccactccttgatctaatagtgtttgtaaagagtgctgtgatcaaaagcacatacaaccatatatacgatactgggccaacaattagcataaatacaaaacatgacgaacactgcactggtcaatgtcccagcaatatagaacatgaggctaattggttgacattttcacaagaaagaactagcagatggggatgtgaagagtttgggtgcttggctgtcaatacaggttgtgtttttgggtcctgtcaagatgtaattagaccagaaacaaaagtttacaggaaagctgtagatgaaattgttattttaacagtttgcatcacatatccagggcataccttttgtacagaaattaatgcaatagagccaaaaataacagaagaaattgagctccagtttaaaacagttgacacgaaaacactaccgtatatagtagctgtaaataaccataaactctatagtggtcagataaatgacttagggacatttgggcaaatgtgcggaaatgtccaaaaaacaaacagcagcattttaggaactgggacaccaaagtttgattatacttgtcatggtgccagtcggaaggatatcattgttaggagatgctataacaataattttgactcctgcaaacttctaaaggaagaaacacagcttatatttaatgatgatcatgatacaataactgtttacaatacaaatcacttaattggtgagttagctataaaattgatattaggggatatccaatataaattgttcacagaaacattggaccttcagatcgatgcgaaatgtgttggctgccctgattgctttgagagctattcctgcaatttccagatagtatcaaatatagacacaatctgcaaccttgaaggaccttgtgacacattccataatagaatatcaatcaaggcaatgcagcaaaattatgctgtaaaactctcctgccagaaagatccagggccatcagggacttttaaaatttgtaacagggaatatactgttgtattccatacagtagcaaaagatgataaaatagaaataaatgttggagaccagacttcattcattaaagagaaagatgacaggtgcaaaacatggctgtgtagggtcagagatgaaggtattagtgtaatttttgaaccaattaaagccttctttgggagttatttcagcatctttttctacataattattattgtagtagtgggatttttaataatatatatttttatgccgatgtttatgaagttgaaggaagtgttgaaagcaaatgagaagctttacttgcaggaaattaagcaaaagtaa

SEQ ID NO: 4113 - RNA, 4302 nt, synthetic construct
  misc_feature 1..4302: note = derived and/or modified CDS sequence (wt) from BUNV(MGD/S1/12060/WT)__KM507340.1__GP
  source 1..4302: mol_type = other RNA
atgaggattctaatactgcttttagcagttactaaactggctgtgggtagcccagttgtcactagatgctttcatggtgggcaactgattgcagaaaggaaatcccaaacatcaatctcagaattctgcattaaagatgacgtttctatgttaaaatcagagattgtctacacaaaaaatgatactgggatttttggccacagtaaagtttttcgtcactggacaatcacagactggaaagcatgcaaccctgttgttacagccggtggtagtataaatgttatagaggttgataaaaatctaaaccttgtaactagaaattatgtgtgcacaggggattgcactataacagttgataaggaaaatgcccagattatatttcagacagacagactgaaccattttgaagtgacaggaaccaccattagcactggctggtttaagtccaaagcatctgttactctcgatagaacatgcgaacatataaaagtaagctgtggaaagaaaacattacaattccatgcttgctttaagcaacatatgtcttgtgttcgattcttacacaggagcatactaccagggtcaatggcaatttcgatctgccaaaatattgagttgattataataacaatattagcattatgcatatttataattatgataatattaacaaaaacgtatatttgctacgtgctgatcccagtatttatgcccatagcttttgcttatggatgggcgtacaacaggagttgtaagaaatgcacttgttgcggattggcataccacccctttacaaactgtggctcatattgtgtctgtggctccaaatttgaaacatcagacagaatgagaatgcaccgagaatcagggttgtgccagggttttaaaagcctgagagtagcaagaaggctttgcaaatcaaaaggctcatcattgatcatatctatcttactctcagtgttgattctatcctttgtaacacccatagaggggactcttacaaattaccctactgatcagaaatatactttagatgaaatagcagatgtcctccaggctaaaacacatgaagattctacaaaatactatataatattatatacatcactttttggtgcaggtttgactatcatttttgcaggagtagcattgggattaacaattatactggaagtattaaccaaaattaatgttattttctgcaacgagtgcaatatgtaccatagcaaaaaatcaatcaaatatgttggtgatttcactaacaaatgtgggttttgtacatgcgggctactagaggatccagagggtgttgttgtacataaagccaagaaatcctgtacatattcatatcagattagctgggtcaaaggtatcatgatatttgttgcctttttatttgtaatacagaatacaattataatggtcgcagcagaagaagactgctgggaaaatgaagaattaaaagaggattgtgtagggcctttaattgcacctaaggattgtactgataaagatcgtaaaacctacttgagtgaggcttcattgttagcaacagcaaagaaaataactcaggtggatgctgaaaatgtagagatattggggaaaactatggaatcagcaattagagtgattgaaagacagaagacataccacagaatgcacttgcttgaggcagtattcctaaataagcactgtgattattataaaatgtttgaacataacagtggatattcccaagtaaagtggaggatgatgataaaaacacaacactttgatatctgtgccttacaagcgagtagcccattttgtgctcagtgtattgctgacaattcttgtgcacaaggctcttgggaatttgacacacatatgaattccacatattcaagtaaagttgacaattttaaacatgacttctctctattcctcagaatttttgaagcagcatttccaggcactgcttatgttcacttgctaacaaatataaaagaaaagaagccctatcaggcagtcagtatgattgagaaaataaagaagaagtttccgaataataaattgcttattggatatttagattttggcaagtacttgctaggcttaagtcatgcaagcacatacgagttgcaacagagccaactagataaattatatcagccaacagaactaacccgatctggtggtcaacaaacatcattagcaagttctgtggtaggtcaagcaacgaaagaatgtaaaaaatacaaagatgttagttgcttaagcccaagatttggaattccgctggaagatttgataagctgcggtgaccaaccaaattacaatatttataaaaagccaaaaaaagtctacaaagctcataacaaagaagaaacatggtgcattaatgatcagcattgcctagttgactttgtcccagctgaagctgatactgtggaaaaattaaaacctatgaaatgttggttagttgaccctggcaagaatgatgatgtttactccattgcaataaaaacatgtagagtgattgacaaaggggtttgtactgttaattcacaaaaatggaatataatcaagtgtgattctgatctgctctactacagtgaccatgtaccaggggaagatacaggaaatgatataggacattattgtgtatcagctggatgcaaaactgacagatacccaattaatcctgatgttgtcactgactgtgtatgggaatttacttctaggagatcacaatatataggcaagatctccatgcagtctcttgaagattacaaaaaagctttaactgacagattgacccataccttggaaacctatagttttgcaccattagaaaacctcccgcatataaaaccagtttacaaatatatcactgcacaaggagtcgaaaactcagacggtatagaaggggcattcataacagccagtattccagctgctgggggtactagcataggctacaatgttaggtcaaaggatggctttccactccttgatctaatagtgtttgtaaagagtgctgtgatcaaaagcacatacaaccatatatacgatactgggccaacaattagcataaatacaaaacatgacgaacactgcactggtcaatgtcccagcaatatagaacatgaggctaattggttgacattttcacaagaaagaactagcagatggggatgtgaagagtttgggtgcttggctgtcaatacaggttgtgtttttgggtcctgtcaagatgtaattagaccagaaacaaaagtttacaggaaagctgtagatgaaattgttattttaacagtttgcatcacatatccagggcataccttttgtacagaaattaatgcaatagagccaaaaataacagaagaaattgagctccagtttaaaacagttgacacgaaaacactaccgtatatagtagctgtaaataaccataaactctatagtggtcagataaatgacttagggacatttgggcaaatgtgcggaaatgtccaaaaaacaaacagcagcattttaggaactgggacaccaaaatttgattatacttgtcatggtgccagtcggaaggatatcattgttaggagatgctataacaataattttgactcctgcaaacttctaaaggaagaaacacagcttatatttaatgatgatcatgatacaataactgtttacaatacaaatcacttaattggtgagttagctataaaattgatattaggggatatccaatataaattgttcacagaaacattggaccttcagatcgatgcgaaatgtgttggctgccctgattgctttgagagctattcctgcaatttccagatagtatcaaatatagacacaatctgcaaccttgaaggaccttgtgacacattccataatagaatatcaatcaaggcaatgcagcaaaattatgctgtaaaactctcctgccagaaagatccagggccatcagggacttttaaaatttgtaacagggaatatactgttgtattccatacagtagcaaaagatgataaaatagaaataaatgttggagaccagacttcattcattaaagagaaagatgacaggtgcaaaacatggctgtgtagggtcagagatgaaggtattagtgtaatttttgaaccaattaaagccttctttgggagttatttcagcatctttttctacataattattattgtagtagtgggatttttaataatatatatttttatgccgatgtttatgaagttgaaggaagtgttgaaagcaaatgagaagctttacttgcaggaaattaagcaaaagtaa

SEQ ID NO: 4114 - RNA, 4308 nt, synthetic construct
  misc_feature 1..4308: note = derived and/or modified CDS sequence (wt) from Ab-BUNV(Cu20-XJ)__KJ710423.1__GP
  source 1..4308: mol_type = other RNA
atggcgatttctattgtcttgatgatcatcttctcaaccacctcttgcctagcaagagcagcaccatcaatatcaaaatgtttccaagatggagtgctgatagcagagaagaagagctcatcaggaatatcagagttctgcattaaagatgatatttccatactaaagtcagagataaattattcaaaaaatgacacagggatattcatgcatagcaaagttttcaggcattggacagtagcagattggaagcaatgtcaacccattccatctgcaggtggcagcataaatgtcttggaagttgacaaaaatctaaaccttgttgctaaaaattatatgtgtactagaccttgtgtcataaccattgacaaggagaatgcgcaattactgtttcagacagaacaactgaaccagtttgaggttacgggaacaacaatcagcacaggttggtttaaatcaaaaacttctgtgtcccttgacaacacatgtgaacatattaaagtgacttgtggcaaaaaaagcttgcaattccatgcttgctttaagcaacatatgtcatgcgttaggttcttgcacagaagtgttctgccaggttacatggcaaattcaatatgccaaaacatagaactcattataatcatcacattaaccttagctattttcatattcatgtgtataataacaaggacatacatttgttacatcatgctgcccctgtttgccccaatagcttatatatatggatggttatataaccgcagttgtaagaaatgtatatgttgcggattagcatatcatcctttcacaaattgtgggtcctactgtgtttgtggttcccgctttgaaacatcagatcgcatgcgccttcatagagaatctggcttgtgtcagggcttcaaatcacttagagtagcaaggacactatgcaagtcaaagggatcatctttagttatatcagtgctaactgcaatgcttatactttcatttgtcacaccccttgaagctatctcaacaaattaccccacagataggaagtatacactaaatgaggtgaatgatatagtccttgggaaagggacggaaaatgagctgaagacatcaatattggcattagtgtccatttgcggtatagggatcattatcatatttatagcattgacaatgcttttagacattgtgttggaagctatagctaaaaggagcacaatattttgcacagaatgcaacttaatacatgacaaaaaggcaatgaaatttgtcggagatttcacaaacaaatgtgggttttgcccatgtggtgaattagaagacccagaggggctagttatacatacaacaagaaagtcttgtacatattatattaaaattagaaacctcaagctaattatgcttgtgttttcaattgccattttaatgcaaaatacagcaatgcttgtcgttgctgatgagaattgctggacgaacacagaaatcaaggcagactgtgttgggccattgattgggcccacaacgtgcactaataaagggtcaaaaacatacaaggcagtggcacaagagctggttacatcaaacaagataacacaattggatgctgacaagtacacattattaggtgacacaatagagagtgcactgagtgctataacagagcaaaaacattattctgcaatacatctactagagacaattttcctgatgaaacactgtgattattataaagtttatgaacataatagtgggtattcccaaacaaagtggaggctaattgccaagacaaatagttttgacatctgctctataccatctacaccaaatttttgcaaatgcttgtcagattccagctgctccacaagtactttgaactttgcaacgtcaatgaactctacttacactagcaaagcagaatactttaatcatgactttactttgtttttaaatatatttgaggctgcattcccagggagtgccacagcattcttattcaagaaaataaaagaaaaagctccttatcaggcttttgaaatgatgggtaaaattgctaataagtacccaaataataagttattggtagtgttgctaaaatatggtcagtatatggttggtctaagtcatgcttcaacttatcagctcaagcaagaatggattgctaaatcgctaagcttagtgaggtcaacaaaaacaggccttaagatggcaatgacaaatgcagagcctggccctgccactaaggaatgttcagatgcaaaaactattgcatgcctgactcccaaattccaggtagaggttaacaacctcatgagttgtggtgcttcccctaattttaaaatatatatgaagagcggagagctctacaaggctcatgataggaactcagtgtggtgcctaaatgatatgcattgcctaacaccatataccccagcaaatgctgagcttgttgcaacaatgaagaagatggaatgctggcaagacaatcctaaacaacctacaaatgattatgcaacaccaagaagaagctgtcaaatgaaggacaggggtttatgcaacgtaggagccgataagtggaaagttataaaatgtgatgatgatttgatgttttacacagatgcactagagagtccagatccagctgcagacatagggcaatattgcttctcagaaaaatgccaaatagaaagatacccaataaatccaactagcttaacaaattgtgaatggttgtatagagctgtgaagcctcaatatataaaaaggctgtcattacagacaatagaagaatataagaaagcaattactgacaaattgacacacactctgcagttgtatcattttgcaccactagaaaacttgccacatattaggcctacatatgagtacattacagcacagggcacttacacagcagatggcatagaaggtgcaagtataataacatcaataccagcattgagtggaacaagtgtgggatttaaaataaatgcaaaagatgggacagcactccttgatatagttgtgtacattaagtcatctgtggtgaaaagtgtttataatcacatttatgatacagggcctactattaacataaactcaaaacatgatgaattgtgcactggacaatgtccaaaaagaatacctgcagacccaaactggctcacattttcccaggaaagaactagtaggtggggctgcgaagaatttgggtgtttagcaataaacacaggttgtgtatatggttcctgtcaagatgtaatcagaacagaaacaaaggtttataggaaagcaaatgaggaaacagtgatgttgactgtttgtataacatacccagggcatacgttctgcacagatgtgaatgcactagagcccaagataaccgatgaattggaactccaatttaaaacaatagacataaaaagtttaccaaatttagtggctataactaatcataaattgtatacagggcaaataaatgatcttggaacctttggccaaatgtgtgggaatgtccaaaagacaaacacaagtatactgggtgcaggcaccccaaaattcgattacacctgttatagcgccagtagaaaagatataataattcgcagatgctacaataacaattatgactcttgtaggcttctaaaacaggaaggggatctcctgtttgatgacaaccatgagacattgatagtgtataacaacaaaaggctgaatggagaactgacaatgaagttgctccttggagatatacaatacaagctctacacagaaaacatggagcttgagctggaagcaaaatgtgttggatgtgtaggctgctttgagagctaccagtgtaacttacaaatcacatccagcttagatgggaattgtgccatatcaggaccctgtgagaccttccatgacaggatccagataaaaacgacaaaaaaagactatgcattaaagctagcttgtacaaaggatcctggcgataaggccacatttagagtatgtggtaaagactatgatttcaacttccacacagttgtaaaaaatgacaaaattgaagtcaatgttggggatgaaacttcatatatcaaagaaaaggatgctagatgtggaacatggctatgtagggtgagagatgaaggtctaagtgtaatctttgagcctctgaaaaacttctttggcaattatttgaatatgttcctctacatacttggaggagttcttttactgtttttatcactttatattataatgccagtatgtgcgagactaagagatgaattaaagaagaatgaaaaattacaccagatggagatgaagaaaagataa

SEQ ID NO: 4115 - RNA, 4305 nt, synthetic construct
  misc_feature 1..4305: note = derived and/or modified CDS sequence (wt) from ANADV(EIV-13128Kam)__KT313718.1__GP
  source 1..4305: mol_type = other RNA
atgtttttaattcttgtcttattgataccattctatatcacagctactccagtgacaacaaggtgcttccatgggggccagctgatagcagaaagcaaatctttgacagcaatctcagagttttgcctaaaagatgatgtctcaactgtcaaatctgaaataacatacctgaaaaatgacacaggaatatttgctcacagcaaggtattaaggaattggataataaaagactggaaaaattgcaatcctgtaccaacagcaggaggcagtataaatgtcatagaggtaaatacagatttgagcctatccacaaaaacatatgtatgcagccgagattgtacaatcacagttgataaagaggatgcccaaataatttttcaaacagacaaattaaatcactttgaagtttcaggcaccacactaagttcaggctggttcaagactaaggcatcagtaacattagatagaacatgtgagcatataaaagtgacttgtgggaaaaagacactacaattccatgcttgctttaagcatcacatgtcatgcataagattcttccacaatacaatactcccagggacaatggctgtatctatatgccagaatatagagctcattataataacaagcttaaccttgattatcttcatattgatggtgatactgacaaaaacatatatatgctatgttttaatgcctttattcatgccagtagcatatttgtatggctgggcttacaataggagttgcaaaaagtgttcatgttgtgggcttgcatatcatccattcaccaattgtggttcccattgtgtatgtgggctgaaatttgaagcatcagacagaatgaggatacatcgggaatcaggattgtgtcagggatataagagcttaagggtggcaaggctgctatgcaaatcaaaaggctcttctttaattatctctatattactgtcagtgctaattttaagctttgttacacctatagagggaacactaacaaattacccagaatcaaagaaatacagtttggaagagatagctgatgttatagaaggattcattgctgagaaagggataaaagaatatattgtgctatatacttcaatatttggtgctttattattgttaatagcattaatcatcacagtctctttaaacagaattacagaatatctaactaatctaaatgtcatttattgccatgaatgttccatgtatcattccaaaaagaatataaaatacattggtgactttactaataaatgtgggttctgcacatgtggcgaattagaagatcaggaaggtctcaatatgcataaagtaagcaaaaagtgcatataccgatatcagttaacttggtctaaagtgattatgacaatcttagtctgtctattaatcgctcagaacactgtgctgattgtagcagcaaatgatgactgctgggctaaacaatcattagaaatagaatgcgtcggacccttacagcaggtagatgcttgtgaggataagtcaagtagatcttacaatggagaggcaaaaaaactagttgggacatcaaaggtaacagaattagatgctggacaagtgaatcttcttggtcaaactatagaatcagcaatcattgcaataaggaaacaaagaacatatgcaactatgcatttccttgaatcagtatttttaggaaggcattgtgattattacaaagtatttgaacataatagtggttactctcaagcaaaatggaggttgctagccaaaacaaatcactttgatatctgctcaaggcatagcacacatcatttttgcagatgcatgtcagatggaacaaaatgcgaaaatgggaattgggattttgcaggtgaaatgaatactacttaccattcaaaaagagacttctttaaacatgattttaatttattttgcactttgcttgaaaatgcattccctggcacaacagagtccctttattaccaacttttgtcaaagagaaacacaacaggggcatcaaaattattagggaagttgattacaaaatttgggaacaacaatctctttgtagggatctggaaatttggccaatttttgttgtccttaccctatgtcaacaatacagagttgagcgcactacaatcctcaaagatattggaaagtccagaacctctccttaggtcagctagtgggagacaagaatcattatctagtaccactcctggggaggcatctaaagaatgtagaaatgcaaagaaaatttcatgcataagccctagatttggagttcctatggaaaacttgactgcatgtggagaatccccaaattataagatatataaaacaccaaccaggatttacaaatcaaacaataagggagaaatatggtgtgcaggtgatgtccattgttttcaggaatttacgccagtactacaagaagtggttgacaagttaaagaaaatgacatgctttttaacagagcctgaggcagaggaggatgcattctcaattgctatagctatgtgcaaaattctagacaaaggagtttgcactataaacagcgaaaggtggaacatcataaaatgtgatagtggtcttatgtattatacagaccagagagatggacaagatacagggaatgattttggggagtactgtatatcacacaattgtaagacagaaaggttccctatcaatccgtctataataagtgattgtatatgggaataccattctaggaaatccaggtatattagcaccttgaatttagaaagtttagaagaattcaaaagggctatttcagaaaagctctcacatacactcgtagtgtatcagtttaagccaacatctaaccttccccatatgaagccagtgtataaatatattacagcacaaggggttgaaaattctgatggaatagactcagcatttatcacagccagtatgccagctctcagtggaactagtataggatataatgtaatgtctaaagataatttccccttatttgatataattatatttataaagagtgcagttattaagaccacatacaatcatatttatgacacaggccccactattggtattaatgtaatgcatgatgaacattgcacaggacagtgtccgatagaaataccccacaaagaaaactggttgacattctctcaagagagaacaagccgatggggttgtgaggaatttgggtgcttagctataaatacaggttgtgtgtttggatcttgccaagatataatcaggcctgagactaaggtatataggaaggcaatagaagaaagtgttttgttgacagtctgtgtgacatacccaggcaataccttttgtacagaaataaatgctatagaacctaaaataacagatgaattagagctccaattcaaaacagtagatacaaagacactacccaatctgctagcagttcaaaaccataagctgtacagtggtcagataaatgacctagggtcctttgcacaaggttgcggaaatatccagaaaactaacttatctgtgataggaactggtacagcaaaatttgactacatatgtcatggtgcctcaagaaaagacatagtagttagaagatgttataataacaattatgaatcatgcaaattgttgaaggaggagccaagcctgatcttttctgataatcatgaaacaatagaagtagcaaatattcggcaccttcttggagaattgcagtttaaattaatgctgggtgatttaagatataaatcatttgcagaaaacccagagctagagatagaggcaaagtgtgttggatgcccatcatgcttttctagttattcctgcaacttccgaataagttcaagtattgatacagtatgtgcaatagatggaccatgcacaatatttcacaatagattaattattagttcaactaagcaagattatggcatcaagatgagctgtaaagaaaagccaaacccagttgaaaaattcaacatatgtaagagaatatattcagttttgttcacaactattgataaaagtgataagattgaaataaatacaggagaccaaacttcatttatacaagaaaaggatgacagatgcaaaacatggctctgtagagttagagatgaagggataagtgttatttttgagccgataaaagcattctttgggagttatttcagcattgcattctatgtagtaattgggataatagcactttttatcacaatatatatctttttgccaatggtttttaaattaaaagacatacttaaaaagaatgaactcttatatttacaagagatgaaatataagtag

SEQ ID NO: 4116 - RNA, 4305 nt, synthetic construct
  misc_feature 1..4305: note = derived and/or modified CDS sequence (wt) from ANADV(EIV-13130Kam)__KT313721.1__GP
  source 1..4305: mol_type = other RNA
atgtttttaattcttgtcttattgataccattctatatcacagctactccagtgacaacaaggtgcttccatgggggccagctgatagcagaaagcaaatctttgacagcaatctcagagttttgcctaaaagatgatgtctcaactgtcaaatctgaaataacatacctgaaaaatgacacaggaatatttgctcacagcaaggtattaaggaattggataataaaagactggaaaaattgcaatcctgtaccaacagcaggaggcagtataaatgtcatagaggtaaatgcagatttgagcctatccacaaaaacatatgtatgcagccgagattgtacaatcacagttgataaagaagatgcccaaataatttttcaaacagacaaattaaatcactttgaagtttcaggcaccacattaagttcaggctggttcaagactaaggcatcagtaacattagatagaacatgtgagcatataaaagtgacttgtgggaaaaagacactacagttccatgcttgctttaagcatcacatgtcatgcataagattcttccacaatacaatactcccagggacaatggctgtatctatatgccagaatatagagctcattataataacaagcttaaccttgattatcttcatattgatggtgatactgacaaaaacgtatatatgctatgttttaatgcctttattcatgccagtagcatatttgtatggctgggcttacaataggagttgcaaaaagtgttcatgttgtgggcttgcatatcatccattcaccaattgtggttcccattgtgtatgtgggctgaaatttgaagcatcagacagaatgaggatacatcgggaatcaggattgtgtcagggatataagagcttaagggtggcaaggctgctatgcaaatcaaaaggctcttctttaattatctctatattactgtcagtgctaattttaagctttgttacacctatagagggaacactaacaaattacccagaatcaaagaaatacagtttggaagagatagctgatgttatagaaggattcattgctgagaaagggataaaagaatatattgtgctatatacttcaatatttggtgctttattattattaatagcattaatcatcacagtctctttaaacagaattacagaatatctaactaacctaaatgtcatttattgccatgaatgttccatgtatcattccaaaaagaatataaaatacattggtgactttactaataaatgtgggttctgcacatgtggcgaattagaagatcaggaaggtctcaatatgcataaagtaagcaaaaagtgcatataccgatatcagttaacttggtctaaagtgattatgacaatcttagtctgtctattaatcgctcagaatactgtgctgattgtagcagcaaatgatgactgctgggctaaacaatcattagaaatagaatgcgttggacctttacagcaggtagatgcttgtgaggataagtcaagtagatcttacaatggagaggcaaaaaaactagttgggacatcaaaggtaacagaattagatgctggacaagtgaatcttcttggtcaaactatagagtcagcaatcattgcaataaggaaacaaagaacatatgcaactatgcatttccttgaatcagtatttttaggaaggcattgtgattattacaaagtatttgaacataatagtggttactctcaagcaaaatggaggctgctagccaaaacaaatcactttgatatctgctcaaggcatagcacacatcatttttgcagatgcatgtcagatggaacaaaatgcgaaaatgggaattgggattttgcaggcgaaatgaatactacttaccattcaaaaagggacttctttaaacatgattttaatttattttgcactttacttgaaaatgcattccctggcacaacagagtccctttattaccaacttttgtcaaagagaaacacaacaggggcatcaaaattattagggaagttgattacaaaatttgggaataacaatctctttgtagggatctggaaatttggccaatttttgttgtccttaccctatgtcaacaatacagagttgagcgcactacaatcctcaaagatattggaaagtccagaacctctccttaggtcagctagtgggagacaagaatcattatctagtgccactcctggggaggcatctaaagaatgtagaaatgcaaagaaaatttcatgcataagccctagatttggagttcctatggaaaacttgaccgcatgtggagaatccccaaattataagatatataaaacaccaaccaggatttacaaatcaaacaataagggagaaatatggtgtgcaggtgatgtccattgttttcaggaatttacgccagtactacaagaagtggttgacaagttaaagaaaatgacatgctttttaacagagcctgaggcagaggaggatgcattctcaattgctatagctatgtgcaaaattctagacaaaggagtttgcactataaacagcgaaaggtggaacatcataaaatgtgatagtggtcttatgtattatacagaccagagggatggacaagatacagggaatgattttggggagtactgtatatcacacaattgtaagacagaaaggttccctatcaatccgtctataataagtgattgtatatgggaataccattctaggaaatccaggtatattagcaccttgaatttagaaagtttagaagaattcaaaagggctatttcagaaaagctctcacatacactcatagtgtatcagtttaagccaacatctaaccttccccatatgaagccagtgtataaatatattacagcacaaggggttgaaaattctgatggaatagactcagcatttatcacagccagtatgccagctctcagtggaactagtataggatataatgtaatgtctaaagataatttccccttatttgatataattatatttataaagagtgcagttattaagaccacatacaatcatatttatgacacaggccccactattggtattaatgtaatgcatgatgaacattgcacaggacagtgtccgatagaaataccccacaaagaaaactggttgacattctctcaagagagaacaagccgatggggttgtgaggaatttgggtgcttagctataaatacaggttgtgtgtttggatcttgccaagatataatcaggcctgagactaaggtatataggaaggcaatagaagaaagtgttttgttgacagtctgtgtgacatacccaggcaataccttttgcacagaaataaatgctatagaacctaaaataacagatgaattagagctccaattcaaaacagtagatacaaagacactacccaatctgctagcagttcaaaaccataagctgtacagtggtcagataaatgacctagggtcctttgcacaaggttgcggaaatatccagaaaactaacttatctgtgataggaactggtacagcaaaatttgactacatatgtcatggtgcctcaagaaaagacatagtagttagaagatgttataataacaattatgaatcatgcaaattgttgaaggaggagccaagcctaatcttttctgataatcatgaaacaatagaagtagcaaatattcggcaccttcttggagaattgcagtttaaattaatgctgggtgatttaagatataaatcatttgcagaaaacccagagctagagatagaggcaaagtgtgttggatgcccatcatgcttttctagttattcctgcaacttccgaataagttcaagtattgatacagtatgtgcaatagatggaccatgcacaatatttcacaatagattaattattagttcaactaagcaagattatggcatcaagatgagctgtaaagaaaagccaaacccagttgaaaaattcaacatatgtaagagagtatattcagtgttgttcacaactattgataaaaatgataagattgaaataaatacaggagaccaaacttcatttatacaagaaaaggatgacagatgcaaaacatggctctgtagagttagagatgaagggataagtgttatttttgagccgataaaagcattctttgggagttatttcagcattgcattctatgtagtaattgggataatagcactttttatcacaatatatatctttttgccaatggtttttaaattaaaagacatacttaaaaagaatgaactcttatatttacaagagatgaaatataagtag

SEQ ID NO: 4117 - RNA, 4305 nt, synthetic construct
  misc_feature 1..4305: note = derived and/or modified CDS sequence (wt) from ANADV(EIV-13395Mg)__KU159765.1__GP
  source 1..4305: mol_type = other RNA
atgtttttaattcttgtcttattgataccattctatatcacagctactccagtgacaacaaggtgcttccatgggggccagctgatagcagaaagcaaatctttgacagcaatctcagagttttgcctaaaagatgatgtctcaactgtcaaatctgaaataacatacctgaaaaatgacacaggaatatttgctcacagcaaggtattaaggaattggataataaaagactggaaaaattgcaatcctgtaccaacagcaggaggcagtataaatgtcatagaggtaaatgcagatttgagcctatccacaaaaacatatgtatgcagccgagattgtacaatcacagttgataaagaggatgcccaaataatttttcaaacagacaaattaaatcactttgaagtttcaggcaccacattaagttcaggctggttcaagactaaggcatcagtaacattagatagaacatgtgagcatataaaagtgacttgtgggaaaaagacactacagttccatgcttgctttaagcatcacatgtcatgcataagattcttccacaatacaatactcccagggacaatggctgtatctatatgccagaatatagagctcattataataacaagcttaaccttgattatcttcatattgatggtgatactgacaaaaacgtatatatgctatgttttaatgcctttattcatgccagtagcatatttgtatggctgggcttacaataggagttgcaaaaagtgttcatgttgtgggcttgcatatcatccattcaccaattgtggttcccattgtgtatgtgggctgaaatttgaagcatcagacagaatgaggatacatcgggaatcaggattgtgtcagggatataagagcttaagggtggcaaggctgctatgcaaatcaaaaggctcttctttaattatctctatattactgtcagtgctaattctaagctttgttacacctatagagggaacactaacaaattacccagaatcaaagaaatacagtttggaagagatagctgatgttatagaaggattcattgctgagaaagggataaaagaatatattgtgctatatacttcaatatttggtgctttattattattaatagcattaatcatcacagtctctttaaacagaattacagaatatctaactaacctaaatgtcatttattgccatgaatgttccatgtatcattccaaaaagaatataaaatacattggtgactttactaataaatgtgggttctgcacatgtggcgaattagaagatcaggaaggtctcaatatgcataaagtaagcaaaaagtgcatataccgatatcagttaacttggtctaaagtgattatgacaatcttagtctgtctattaatcgctcagaacactgtgctgattgtagcagcaaatgatgactgctgggctaaacaatcattagaaatagaatgcgttggacctttacagcaggtagatgcttgtgaggataagtcaagtagatcttacaatggagaggcaaaaaaactagttgggacatcaaaggtaacagaattagatgctggacaagtgaatcttcttggtcaaactatagagtcagcaatcattgcaataaggaaacaaagaacatatgcaactatgcatttccttgaatcagtatttttaggaaggcattgtgattattacaaagtatttgaacataatagtggttactctcaagcaaaatggaggctgctagccaaaacaaatcactttgatatctgctcaaggcatagcacacatcatttttgcagatgcatgtcagatggaacaaaatgcgaaaatgggaatagggattttgcaggcgaaatgaatactacttaccattcaaaaagggacttctttaaacatgattttaatttattttgcactttacttgaaaatgcattccctggcacaacagagtccctttattaccaacttttgtcaaagagaaacacaacaggggcatcaaaattattagggaagttgattacaaaatttgggaataacaatctctttgtagggatctggaaatttggccaatttttgttgtccttaccctatgtcaacaatacagagttgagcgcactacaatcctcaaagatattggaaagtccagaacctctccttaggtcagctagtgggagacaagaatcattatctagtgccactcctggggaggcatctaaagaatgtagaaatgcaaagaaaatttcatgcataagccctagatttggagttcctatggaaaacttgaccgcatgtggagaatccccaaattataagatatataaaacaccaaccaggatttacaaatcaaacaataagggagaaatatggtgtgcaggtgatgtccattgttttcaggaatttacgccagtactacaagaagtggttgacaagttaaagaaaatgacatgctttttaacagagcctgaggcagaggaggatgcattctcaattgctatagctatgtgcaaaattctagacaaaggagtttgcactataaacagcgaaaggtggaacatcataaaatgtgatagtggtcttatgtattatacagaccagagagatggacaagatacagggaatgattttggggagtactgtatatcacacaattgtaagacagaaaggttccctatcaatccgtctataataagtgattgtatatgggaataccattctaggaaatccaggtatattagcaccttgaatttagaaagtttagaagaattcaaaagggctatttcagaaaagctctcacatacactcgtagtgtatcagtttaagccaacatctaaccttccccatatgaagccagtgtataaatatattacagcacaaggggttgaaaattctgatggaatagactcagcatttatcacagccagtatgccagctctcagtggaactagtataggatataatgtaatgtctaaagataatttccccttatttgatataattatatttataaagagtgcagttattaagaccacatacaatcatatttatgacacaggccccactattggtattaatgtaatgcatgatgaacattgcacaggacagtgtccgatagaaataccccacaaagaaaactggttgacattctctcaagagagaacaagccgatggggttgtgaggaatttgggtgcttagctataaatacaggttgtgtgtttggatcttgccaagatataatcaggcctgagactaaggtatataggaaggcaatagaagaaagtgttttgttgacagtctgtgtgacatacccaggcaataccttttgcacagaaataaatgctatagaacctaaaataacagatgaattagagctccaattcaaaacagtagatacaaagacactacccaatctgctagcagttcaaaaccataagctgtacagtggtcagataaatgacctagggtcctttgcacaaggttgcggaaatatccagaaaactaacttatctgtgataggaactggtacagcaaaatttgactacatatgtcatggtgcctcaagaaaagacatagtagttagaagatgttataataacaattatgaatcatgcaaattgttgaaggaggagccaagcctaatcttttctgataatcatgaaacaatagaagtagcaaatattcggcaccttcttggagaattgcagtttaaattaatgctgggtgatttaagatataaatcatttgcagaaaacccagagctagagatagaggcaaagtgtgttggatgcccatcatgcttttctagttattcctgcaacttccgaataagttcaagtattgatacagtatgtgcaatagatggaccatgcacaatatttcacaatagattaattattagttcaactaagcaagattatggcatcaagatgagctgtaaagaaaagccaaacccagttgaaaaattcaacatatgtaagagagtatattcagtgttgttcacaactattgataaaaatgataagattgaaataaatacaggagaccaaacttcatttatacaagaaaaggatgacagatgcaaaacatggctctgtagagttagagatgaagggataagtgttatttttgagccgataaaagcattctttgggagttatttcagcattgcattctatgtagtaattgggataatagcactttttatcacaatatatatctttttgccaatggtttttaaattaaaagacatacttaaaaagaatgaactcttatatttacaagagatgaaatataagtag

SEQ ID NO: 4118 - RNA, 4305 nt, synthetic construct
  misc_feature 1..4305: note = derived and/or modified CDS sequence (wt) from ANADV(EIV-16002Mg)__KT313724.1__GP
  source 1..4305: mol_type = other RNA
atgtttttaattcttgtcttattgataccattctatatcacagctactccagtgacaacaaggtgcttccatgggggccagctgatagcagaaagcaaatctttgacagcaatctcagagttttgcctaaaagatgatgtctcaactgtcaaatctgaaataacatacctgaaaaatgacacaggaatatttgctcacagcaaggtattaaggaattggataataaaagactggaaaaattgcaatcctgtaccaacagcaggaggcagtataaatgtcatagaggtaaatgcagatttgagcctatccacaaaaacatatgtatgcagccgagattgtacaatcacagttgataaagaggatgcccaaataattttccaaacagacaaattaaatcactttgaagtttcaggcaccacactaagttcaggctggttcaagactaaggcatcagtaacattagatagaacatgtgagcatataaaagtgacttgtgggaaaaagacactacagttccatgcttgctttaagcatcacatgtcatgcataagattcttccacaatacaatactcccagggacaatggctgtatctatatgccagaatatagagctcattataataacaagcttaaccttgattatcttcatattgatggtgatactgacaaaaacatatatatgctatgttttaatgcctttattcatgccagtagcatatttgtatggctgggcttacaataggagttgcaaaaagtgttcatgttgtgggcttgcatatcatccattcaccaattgtggttcacattgtgtatgtgggctgaaatttgaagcatcagacagaatgaggatacatcgggaatcaggattgtgtcagggatataagagcttaagggtggcaaggctgctatgcaaatcaaaaggctcttctttaattatctctatattactgtcagtgctaattttaagctttgttacacctatagagggaacactaacaaattacccagaatcaaagaaatatagtttggaagagatagctgatgttatagaaggattcattgctgagaaagggataaaagaatatattgtgctatatacttcaatatttggtgctttattattattaatagcattaatcatcacagtctctttaaacagaattacagaatatctaactaatctaaatgtcatttattgccatgaatgttccatgtatcattccaaaaagaatataaaatacgttggtgactttactaataaatgtgggttctgcacatgtggcgaattagaagatcaggaaggtctcaatatgcataaagtaagcaaaaagtgcatataccgatatcagttaacttggtctaaagtgattatgacaatcttagtctgtctattaatcgctcagaacactgtgctgattgtagcagcaaatgatgactgctgggctaaacaatcattagaaatagaatgcgttggacccttacagcaggtagatgcttgtgaggataagtcaagtagatcttacaatggagaggcaaaaaaactagttgggacatcaaaggtaacagaattagatgctggacaagtgaatcttcttggtcaaactatagagtcagcaatcattgcaataaggaaacaaagaacatatgcaactatgcatttccttgaatcagtatttttaggaaggcattgtgattattacaaagtatttgaacataatagtggttactctcaagcaaaatggaggttgctagccaaaacaaatcactttgatatctgctcaaggcatagcacacatcatttttgcagatgcatgtcagatggaacaaaatgcgaaaatgggaattgggattttgcaggcgaaatgaatactacttaccattcaaaaagagacttctttaaacatgattttaaattattttgcactttacttgaaaatgcattccctggcacaacagagtccctttattaccaactcttgtcaaagagaaacacaacaggggcatcaaaattattagggaagttgattacaaaatttgggaataacaatctctttgtagggatctggaaatttggccaatttttgttgtccttaccctatgtcaacaatacagagttgagtgcactacaatcctcaaaaatattggaaagtccagaacctctccttaggtcagctagtgggagacaagaatcattatctagtgccactcctggagaggcatctagagaatgtagaaatgcaaagaaaatttcatgcataagccctagatttggagttcctatggaaaacttgaccgcatgtggagaatccccaaattataagatatataaaacaccagccaggatttacaaatcaaacaataagggagaaatatggtgtgcaggtgatgtccattgttttcaggaatttacgccagtactacaagaagtggttgataagttaaagaaaatgacatgctttttaacagagcctgaggcagaggaggatgcattctcaattgctatagctatgtgcaaaattctagacaaaggagtttgcactataaacagcgaaaggtggaacatcataaaatgtgatagtggtcttatgtattatacagaccagagagatggacaagatacagggaatgattttggggagtactgtatatcacacaattgtaagacagaaagattccctatcaatccgtctataataagtgattgtatatgggaataccattctaggaaatccaggtatattagcaccttgaatttagaaagtttagaagaattcaaaagggctatttcagaaaagctctcacatacactcgtagtgtatcagtttaagccaacatctaaccttccccatatgaagccagtgtataaatatattacagcacaaggggttgaaaattctgatggaatagactcagcatttatcacagccagtatgccagctctcagtggaactagtataggatataatgtaatgtctaaagataatttccccttatttgatatcattatatttataaagagtgcagttattaagaccacatacaatcatatttatgacacaggccccactattggtattaatgtaatgcatgatgaacattgcacaggacagtgtccgatagaaataccccacaaagaaaactggttgacattctctcaagagagaacaagccgatggggttgtgaggaatttgggtgcttagctataaatacaggttgtgtgtttggatcttgccaagatataatcaggcctgagactaaggtatataggaaggcaatagaagaaagtgttttgttaacagtctgtgtgacatacccaggcaataccttttgcacagaaataaatgctatagaacctaaaataacagatgaattagagctccaattcaaaacagtagatacaaagacactacccaatctgctagcagttcaaaaccataagctgtacagtggtcagataaatgacctagggtcctttgcacaaggttgcggaaatatccagaaaactaacttatctgtgataggaactggtacagcaaaatttgactacatatgtcatggtgcctcaagaaaagacatagtagttagaagatgttataataacaattatgaatcatgcaaattgttgaaggaggagccaagcctaatcttttctgataatcatgaaacaatagaagtagcaaacattcgacaccttcttggagaattgcagtttaaattaatgctgggtgatttaagatataaatcatttgcagaaaacccagagctagagatagaggcaaagtgtgttggatgcccatcatgcttttctagttattcctgcaacttccgaataagttcaagtattgatacagtatgtgcaatagatggaccatgcacagtatttcacaatagattaattattagttcaactaagcaagattatggcatcaagatgagctgtaaagaaaagccaaacccagttgaaaaattcaacatatgtaagagagtatattcagtgttgttcacaactattgataaaaatgataagattgaaataaatacaggagaccaaacttcatttatacaagaaaaggatgacagatgcaaaacatggctctgtagagttagagatgaagggataagtgttatttttgagccgataaaagcattctttgggagttatttcagcattgcattctatgtagtaattgggataatagcactttttatcacaatatatatctttttgccaatggtttttaaattaaaagacatacttaaaaagaatgaactcttatatttacaggagatgaaatataagtag

SEQ ID NO: 4119 - RNA, 4305 nt, synthetic construct
  misc_feature 1..4305: note = derived and/or modified CDS sequence (wt) from ANADV(EIV-16199Mg)__KT313730.1__GP
  source 1..4305: mol_type = other RNA
atgtttttaattcttgtcttattgataccattctatatcacagctactccagtgacaacaaggtgcttccatgggggccagctgatagcagaaagcaaatctttgacagcaatctcagagttttgcctaaaagatgatgtctcaactgtcaaatctgaaataacatacctgaaaaatgacacaggaatatttgctcacagcaaagtattaaggaattggataataaaagactggaaaaattgcaatcctgtaccaacagcaggaggcagtataaatgtcatagaggtaaatgcagatttgagcctatccacaaaaacatatgtatgcagccgagattgtacaatcacagttgataaagaggatgcccaaataatttttcaaacagacaaattaaatcactttgaagtttcaggcaccacactaagttcaggctggttcaagactaaggcatcagtaacattagatagaacatgtgagcatataaaagtgacttgtgggaaaaagacactacagttccatgcttgctttaagcatcacatgtcatgcataagattcttccacaatacaatactcccagggacaatggctgtatctatatgccagaatatagagctcattataataacaagcttaaccttgattatcttcatattgatggtgatattgacaaaaacatatatatgctatgtcttaatgcctttattcatgccagtagcatatttatatggctgggcttacaataggagttgcaaaaagtgttcatgttgtgggcttgcatatcatccattcaccaattgtggttcccattgtgtatgtgggctgaaatttgaagcatcagacagaatgaggatacatcgggaatcaggattgtgtcagggatataaaagcttaagggtggcgaggctgctatgcaaatcaaaaggctcttctttaattatctctatattactgtcagtgctaattttaagctttgttacacctatagagggaacactaacaaattacccagaatcaaagaaatacagtttggaagagatagctgatgttatagaaggattcattgctgagaaagggataaaagaatatattgtgctatatacttcaatatttggtgctttattattattaatagcattaatcatcacagtctctttaaacagaattacagaatatttaactaatctaaatgtcatttattgccatgaatgttccatgtatcattccaaaaagaatataaaatacattggtgactttactaataaatgtgggttctgtacatgtggcgaattagaagatcaggaaggtctcaatatgcataaagtaagcaaaaagtgcatataccgatatcagttaacttggtctaaagtgattatgacaatcttagtctgtctattaatcgctcagaacactgtgctgattgtagcagcaaatgatgactgctgggctaaacaatcattagaaatagaatgcgttggacccttacagcaggtagatgcttgtgaggataagtcaagtagatcttacaatgaagaggcaaaaaaactagttgggacatcaaaggtaacagaattagatgctggacaagtgaatcttcttggtcaaactatagagtcagcaatcattgcaataaggaaacaaagaacatatgcaactatgcatttccttgaatcagtatttttaggaaggcattgtgactattacaaagtatttgaacataatagtggttactctcaagcaaaatggaggttgctagccaaaacaaatcactttgatatctgctcaaggcatagcacacatcatttttgcagatgcatgtcagatggaacaaaatgcgaaaatggaaattgggattttgcaggcgaaatgaatactacttaccattcaaaaagagatttctttaaacatgattttaatttattttgcactttacttgaaaatgcattccccggcacaacagagtccctttattaccagcttttgtcaaagagaaatacaacaggggcatcaaaattattagggaagttgattacaaaattcgggaataacaatctctttgtagggatctggaaatttggccaatttttgttgtccttaccctatgtcaacaatacagagttgagcgcactgcaatcctcaaagatattggaaagtccagaacctctccttaggtcagctagtgggagacaagaatcattgtctagtgccactcctggggaggcatctaaagaatgtagaaatgcaaagaaaatttcatgcataagccctagatttggagttcctatggaaaacttgactgcatgtggagaatccccaaattataagatatataaaacaccaaccaggatttacaaatcaaacaataagggagaaatatggtgtgcaggtgatgttcattgctttcaggaatttacgccagtactacaagaagtggtcgacaaattaaagaaaatgacatgttttttaacagagcctgaggcagaggaggatgcattctcaattgctatagctatgtgcaaaattctagacaaaggagtttgcaccataaacagcgaaaggtggaacatcataaaatgtgatagtggtcttatgtattatacagatcagagagatgggcaagatacagggaatgattttggggagtactgtatatcacacaattgtaagacagaaagattccctatcaatccgtctataataagtgattgtatatgggaataccattctagaaaatccaggtatattagcaccttgaatttagaaagtttagaagagttcaaaagggctatttcagaaaagctctcacatacactcatagtgtatcagtttaagccaacatctaaccttccccatatgaagccagtgtataaatatattacagcacaaggggttgaaaattctgatggaatagactcagcatttatcacagccagtatgccagctctcagtggaactagtataggatataatgtaatgtctaaagataatttccccttatttgatataattatatttataaagagtgcagttattaagaccacatacaatcatatttatgacacagggcccactattggtattaatgtaatgcatgatgaacattgcacaggacagtgtccgatagaaatacctcacaaagaaaactggttgacattctctcaagagagaacaagccgatggggttgtgaggaatttgggtgcttagctataaatacaggttgtgtgtttggatcttgtcaagatataatcaggcctgagactaaggtatataggaaggcaatagaagaaagtgtcttgttgacagtctgtgtgacatacccaggcaataccttttgcacagaaataaatgctatagaacctaaaataacagatgaattagagctccaattcaaaacagtagatacaaagacactacccaatttgctagcagttcaaaaccataagctgtacagtggtcagataaatgacctagggtcctttgcacaaggttgcggaaatatccagaaaactaacttatctgtgataggaactggaacagcaaaatttgactacatatgtcatggtgcctcaagaaaagacatagtggttagaagatgttataataacaattatgaatcatgcaaattgttgaaggaggagccaagcctaatcttttctgataatcatgaaacgatagaagtagcaaatattcggcaccttcttggagaattgcagtttaaattaatgctgggtgatttgagatataaatcatttgcagaaaacccagagctagagatagaggcaaggtgtgttggatgcccatcatgcttttctagttattcctgcaatttccgaataagttcaagtattgatacagtatgtgcaatagacggaccatgcacaatatttcacaatagattaattattagttcaactaagcaagattatggcatcaagatgagctgtaaagaaaagccaaacccagttgaaaaattcaacatatgtaagagagtatattcagtgttgttcacaactattgataaaaatgataagattgaaataaatacaggagaccaaacttcatttatacaagaaaaggatgacagatgcaaaacatggctctgtagagttagagatgaagggataagtgttatttttgagccgataaaagcattctttgggagttatttcagcattgcattctatgtggtaattgggataatagcactttttatcataatatatatctttttgccaatggtttttaaattaaaagacatacttaaaaagaatgaactcttatatttacaagagatgaaatataagtag

SEQ ID NO: 4120 - RNA, 4305 nt, synthetic construct
  misc_feature 1..4305: note = derived and/or modified CDS sequence (wt) from ANADV(EIV-16208Mg)__KT313733.1__GP
  source 1..4305: mol_type = other RNA
atgtttttaattcttgtcttattgataccattctatatcacagctactccagtgacaacaaggtgcttccatgggggccagctgatagcagaaagcaaatctttgacagcaatctcagagttttgcctaaaagatgatgtctcaactgtcaaatctgaaataacatacctaaaaaatgacacaggaatatttgctcacagcaaagtattaaggaattggataataaaagactggaaaaattgcaatcctgtaccaacagcaggaggcagtataaatgtcatagaggtaaatgcagatttgagcctatccacaaaaacatatgtatgcagccgagattgtacaatcacagttgataaagaagatgcccaaataattttccaaacagataaattaaatcactttgaagtttcgggcaccacactaagttcaggctggttcaagactaaggcatcagtaacattagatagaacatgtgagcatataaaagtgacttgtgggaaaaagacactacagttccatgcttgctttaagcaccacatgtcatgcataagattcttccacaatacaatactcccagggacaatggctgtatctatatgccagaatatagagctcattataataacaagcttaaccttgattatcttcatattgatggtgatattgacaaaaacatatatatgctatgtcttaatgcctttattcatgccagtagcatatttgtatggctgggcttacaataggagttgcagaaagtgttcatgttgtgggcttgcatatcatccattcaccaattgtggttcccattgtgtatgtgggctgaaatttgaagcatcagacagaatgaggatacatcgggaatcaggattgtgtcagggatataaaagcttaagggtggcgaggctgctatgcaaatcaaaaggctcttctttaattatctctatattattgtcagtgctaattttaagctttgttacacctatagagggaacactaacaaactacccagaatcaaagaaatacagtttggaagagatagctgatgttatagaaggatttattgctgagaaagggataaaagaatatattgtgctatatacttcaatatttggtgccttattattattaatagcattaatcatcacagtctctttaaacagaattacagaatatctaactaatctaaatgtcatttattgccatgaatgttccatgtatcattccaaaaagaatataaaatacattggtgactttactaacaaatgtgggttctgcacatgtggcgaattagaagatcaggaaggtctcaatatgcataaagtaagcaaaaagtgcatataccgatatcagttaacttggtctaaagtgattatgacaatcttaatctgtctattaatcgctcagaatgctgtgctgattgtagcagcaaatgacgactgctgggctaaacaatcattagaaatagaatgcgttggacccttacagcaggtagatgcttgtgaggataagtcaagtagatcttacaatggagaggcaaaaaaactagttgggacatcaaaggtaacagaattagatgctggacaagtgaatcttcttggtcaaactatagagtcagcaatcattgcaataaggaaacaaagaacatatgcaactatgcatttccttgaatcagtatttttaggaaggcattgtgattattacaaagtatttgaacataatagtggttactctcaagcaaaatggaggttgctagccaaaacaaatcactttgatatctgctcaaggcatagcacacatcatttttgcagatgcatgtcagatggaacaaaatgcgaaaatgggaattgggattttgcaggcgaaatgaatactacttaccattcaaaaagagatttctttaaacatgattttaagttattttgcactttacttgaaaatgcattccctggcacaacagagtccctttattaccaacttttgtcaaagagaaacacaacaggggcatcaaaattattagggaagttgattacaaaattcgggaataacaatctctttgtagggatctggaaatttggccaattcttgttgtccttaccctatgtcaacaatacagagttgagtgcactgcaatcctcaaagatattggaaagtccagaacctctccttaggtcagctagtgggagacaagaatcattatctagtgccactcctggggaggcatctaaagaatgtagaaatgcaaagaagatttcatgcataagccctagatttggagttcctatggaaaacttgactgcatgtggagaatccccaaattataagatatataaaacaccaaccaggatttacaaatcaaacaataagggagaaatatggtgtgcaggtgatgtccattgtttccaggaatttacgccagtactacaagaagtggttgacaaattaaagaaaatgacatgttttttaacagagcctgaggcagaggaggatgcattctcaattgctatagctatgtgcaaaattctagacaaaggggtttgcactataaacagcgaaaggtggaacatcataaaatgtgatagtggtcttatgtattatacagatcagagagatgggcaagatacagggaatgattttggggagtactgtatatcacacaattgtaagacagaaaggttccctatcaatccgtctataataagtgattgtatatgggaataccattctaggaaatccaagtatattagcaccttgaatttagaaagtttagaagaattcaaaagggctatttcagaaaagctctcacatacactcgtagtatatcagtttaaaccaacatctaaccttccccatatgaagccagtgtataaatatattacagcacaaggggttgaaaattctgatggaatagactcagcatttatcacagccagtatgccagctctcagtggaactagtataggatataatgtaatgtctaaagataatttccccttatttgatataattatatttataaagagtgcagttattaagaccacatacaatcatatttatgacacaggccccactattggtattaatgtaatgcatgatgaacattgcacaggacagtgtccgatagaaatacctcacaaagaaaactggttgacattctcccaagaaagaacaagccgatggggctgtgaggaattcgggtgcttagctataaatacaggttgtgtgtttggatcttgccaagatataatcaggcctgagactaaggtatataggaaggcaatagaagaaagtgttttgttgacagtctgtgtgacatacccaggcaataccttttgcacagaaataaatgctatagaacctaaaataacagatgaattagagctccaattcaaaacagtagatacaaagacactacccaatctgctagcagttcaaaaccataagctgtacagtggtcagataaatgacctagggtcctttgcacaaggttgcggaaatatccagaaaactaacttatctgtaataggaactggtacagcaaaatttgactacatatgtcatggtgcctcaagaaaagacataatagttagaagatgttataataacaattatgaatcatgcaaattgttgaaggaagagccaagcctaatcttttctgataatcatgaaacaatagaagtagcaaatattcggcaccttcttggagaattgcaatttaagttaatgctgggtgatttgagatataaatcatttgcagaaaacccagagctagagatagaggcaaagtgtgttggatgcccatcatgcttttctagttattcctgcaatttccgaataagttcaagtattgatacagtatgtgcaatagatggaccatgcacaatatttcacaatagattaattattagttcaactaagcaagattatggcatcaagatgagctgtaaagaaaagccaaactcagttgaaaaattcaacatatgtaagagagtatattcagtgttgttcacaactattgataaaaatgataagattgaaataaatacaggagaccaaacttcatttatacaagaaaaggatgacagatgcaaaacatggctctgtagagttagagatgaagggataagtgttatttttgagccgataaaagcattctttgggagttatttcagcattgcattctatgtggtaattgggataatagcactttttatcataatatatatctttttgccaatggtttttaaattaaaagacatacttaagaagaatgaactcttatatttacaagagatgaaatataagtag

SEQ ID NO: 4121 - RNA, 4305 nt, synthetic construct
  misc_feature 1..4305: note = derived and/or modified CDS sequence (wt) from ANADV(EIV-16356Mg)__KT313736.1__GP
  source 1..4305: mol_type = other RNA
atgtttttaattcttgtcttattgataccattctatatcacagctactccagtgacaacaaggtgcttccatggaggccagctgatagcagaaagcaaatctttgacagcaatctcagagttttgcctaaaagatgatgtctcaactgtcaaatctgaaataacatacctgaaaaatgacacaggaatatttgctcacagcaaggtattaaggaattggataataaaagactggaaaaattgcaatcctgtaccaacagcaggaggcagtataaatgtcatagaggtaaatgcagatttgagcctatccacaaaaacatatgtatgcagccgagattgtacaatcacagttgataaagaggatgcccaaataattttccaaacagacaaattaaatcactttgaagtttcaggcaccacactaagttcaggctggttcaagactaaggcatcagtaacattagatagaacatgcgagcatataaaagtgacttgtgggaaaaagacactacagttccatgcttgctttaagcatcacatgtcatgcataagattcttccacaatacaatactcccagggacaatggctgtatctatatgccagaatatagagctcattataataacaagcttaaccttgattatcttcatattgatggtgatactgacaaaaacatatatatgctatgttttaatgcctttattcatgccagtagcatatttgtatggctgggcttacaataggagttgcaaaaagtgttcatgttgtgggcttgcatatcatccattcaccaattgtggttcacattgtgtatgtgggctgaaatttgaagcatcagacagaatgaggatacatcgggaatcaggattgtgtcagggatataagagcttaagggtggcaaggctgctatgcaaatcaaaaggctcttctttaattatctctatattactgtcagtgctaattttaagctttgttacacctatagagggaacactaacaaattacccagaatcaaagaaatacagtttggaagagatagctgatgttatagaaggattcattgctgagaaagggataaaagaatatattgtgctatatacttcaatatttggtgctttattattattaatagcattaatcatcacagtttctttaaacagaattacagaatatctaactaatctaaatgtcatttattgccatgaatgttccatgtatcattccaaaaagaatataaaatacattggtgactttactaataaatgtgggttctgcacatgtggcgaattagaagatcaggaaggtctcaatatgcataaagtaagcaaaaagtgcatataccgatatcagttaacttggtctaaagtgattatgacaatcttagtctgtctattaatcgctcagaacactgtgctgattgtagcagcaaatgatgactgctgggctaaacaatcattagaaatagaatgcgttggacccttacagcaggtagatgcttgtgaggataagtcaagtagatcttacaatggagaggcaaaaaaactagttgggacatcaaaggtaacagaattagatgctggacaagtgaatcttcttggtcaaactatagagtcagcaatcattgcaataaggaaacaaagaacatatgcaactatgcatttccttgaatcagtatttttaggaaggcattgtgattattacaaagtatttgaacataatagtggttactctcaagcaaaatggaggttgctagccaaaacaaatcactttgatatctgctcaaggcatagcacacatcatttttgcagatgcatgtcagatggaacaaaatgcgaaaatgggaattgggattttgcaggcgaaatgaatactacttaccattcaaaaagagacttctttaaacatgattttaagttattttgcactttacttgaaaatgcattccctggcacaacagagtccctttattaccaactcttgtcaaagagaaacacaacaggggcatcaaaattattagggaagttgattacaaaatttgggaataacaatctctttgtagggatctggaaatttggccaatttttgttgtccttaccctatgtcaacaatacagagttgagtgcactacaatcctcaaaaatattggaaagtccagaacctctccttaggtcagctagtgggagacaagaatcattatctagtgccactcctggagaggcatctaaagaatgtagaaatgcaaagaaaatttcatgcataagccctagatttggagttcctatggaaaacttgaccgcatgtggagaatccccaaattataagatatataaaacaccaaccaggatttacaaatcaaacaataagggagaaatatggtgtgcaggtgatgtccattgttttcaggaatttacgccattactacaagaagtggttgataagttaaagaaaatgacatgctttttaacagagcctgaggcagaggaggatgcattctcaattgctatagctatgtgcaaaattctagacaaaggagtttgcactataaacagcgaaaggtggaacatcataaaatgtgatagtggtcttatgtattatacagaccagagagatgggcaagatacagggaatgattttggggagtactgtatatcacacaattgtaagacagaaagattccctatcaatccgtctataataagtgattgtatatgggaataccattctaggaaatccaggtatattagcaccttgaatttagaaagtttagaagaattcaaaagggctatttcagaaaagctctcacatacactcgtagtgtatcagtttaagccaacatctaaccttccccatatgaagccagtgtataaatatattacagcacaaggggttgaaaattctgatggaatagactcagcatttatcacagccagtatgccagctctcagtggaactagtataggatataatgtaatgtctaaagataatttccccttatttgatatcattatatttataaagagtgcagttattaagaccacatacaatcatatttatgacacaggccccactattggtattaatgtaatgcatgatgaacattgcacaggacagtgtccgatagaaataccccacaaagaaaactggttgacattctctcaagagagaacaagccgatggggttgtgaggaatttgggtgcttagctataaatacaggttgtgtgtttggatcttgccaagatataatcaggcctgagactaaggtatataggaaggcaatagaagaaagtgttttgttaacagtctgtgtgacatacccaggcaataccttttgcacagaaataaatgctatagaacctaaaataacagatgaattagagctccaattcaaaacagtagatacaaagacactacccaatctgctagcagttcaaaaccataagctgtacagtggtcagataaatgacctagggtcctttgcacaaggttgcggaaatatccagaaaactaacttatctgtgataggaactggtacagcaaaatttgactacatatgtcatggtgcctcaagaaaagacatagtagttagaagatgttataataacaattatgaatcatgcaaattgttgaaggaggagccaagcctaatcttttctgataatcatgaaacaatagaagtagcaaatattcgacaccttcttggagaattgcagtttaaattaatgctgggtgatttaagatataaatcatttgcagaaaacccagagctagagatagaggcaaagtgtgttggatgcccatcatgcttttctagttattcctgcaacttccgaataagttcaagtattgatacagtatgtgcaatagatggaccatgcacaatatttcacaatagattaattattagttcaactaagcaagattatggcatcaagatgagctgtaaagaaaagccaaacccagttgaaaaattcaacatatgtaagagagtatattcagtgttgttcacaactattgataaaaatgataagattgaaataaatacaggagaccaaacttcatttatacaagaaaaggatgacagatgcaaaacatggctctgtagagttagagatgaagggataagtgttatttttgagccgataaaagcattctttgggagttatttcagcattgcattctatgtagtaattgggataatagcactttttatcacaatatatatctttttgccaatggtttttaaattaaaagacatacttaaaaagaatgaactcttatatttacaagagatgaaatataagtag

SEQ ID NO: 4122 - RNA, 4305 nt, synthetic construct
  misc_feature 1..4305: note = derived and/or modified CDS sequence (wt) from ANADV(EIV-17769Yak)__KT313739.1__GP
  source 1..4305: mol_type = other RNA
atgtttttaattcttgtcttattgataccattctatatcacagctactccagtggcaacaaggtgcttccatgggggccagctgatagcagaaagcaaatctttgacagcaatctcagagttttgcctaaaagatgatgtctcaactgtcaaatctgaaataacatacctgaaaaatgacacaggaatatttgctcacagcaaggtattaaggaattggataataaaagactggaaaaattgcaatcctgtaccaacagcaggaggcagtataaatgtcatagaggtaaatgcagatttgagcctatccacaaaaacatatgtatgcagccgagattgtacaatcacagttgataaagaggatgcccaaataattttccaaacagacaacttaaatcactttgaagtttcaggcaccacactaagttcaggctggttcaagactaaggcatcagtaacattagatagaacatgtgagcatataaaagtgacttgtgggaaaaagacactacagttccatgcttgctttaagcatcacatgtcatgcataagattcttccacaatacaatactcccagggacaatggctgtatctatatgccagaatatagagctcattataataacaagcttaaccttgattatcttcatattgatggtgatactgacaaaaacatatatatgctatgttttaatgcctttattcatgccagtagcatatttgtatggctgggcttacaataggagttgcaaaaagtgttcatgttgtgggcttgcatatcatccattcaccaattgtggttcacattgtgtatgtgggctgaaatttgaagcatcagacagaatgaggatacatcgggaatcaggattgtgtcagggatataagagcttaagggtggcaaggctgctatgcaaatcaaaaggctcttctttaattatctccatattactgtcagtgctaattttaagctttgttacacctatagagggaacactaacaaattacccagaatcaaagaaatacagtttggaagagatagctgatgttatagaaggattcattgctgagaaagggataaaagaatatattgtgctatatacttcaatatttggtgctttattattattaatagcattaatcatcacagtctctttaaacagaattacagaatatctaactaatctaaatgtcatttattgccatgaatgttccatgtatcattccaaaaagaatataaaatacgttggtgactttactaataaatgtgggttctgcacatgtggcgaattagaagatcaggaaggtctcaatatgcataaagtaagcaaaaagtgcatataccgatatcagttaacttggtctaaagtgattatgacaatcttagtctgtctattaatcgctcagaacactgtgctgattgtagcagcaaatgacgactgctgggctaaacaatcattagaaatagaatgcgttggacccttacagcaggtagatgcttgtgaggataagtcaagtagatcttacaatggagaggcaaaaaaactagttgggacatcaaaggtaacagaattagatgctggacaagtgaatcttcttggtcaaactatagagtcagcaatcattgcaataaggaaacaaagaacatatgcaactatgcatttccttgaatcagtatttttaggaaggcattgtgattattacaaagtatttgaacataatagtggttactctcaagcaaaatggaggttgctagccaaaacaaatcactttgatatctgctcaaggcatagcacacatcatttttgcagatgcatgtcagatggaacaaaatgcgaaaatgggaatcgggattttgcaggcgaaatgaatactacttaccattcaaaaagagacttctttaaacatgattttaatttattttgcactttacttgaaaatgcattccctggcacaacagagtccctttattaccaactcttgtcaaagagaaacacaacaggggcatcaaaattattagggaagttgattacaaaatttgggaataacaatctctttgtagggatctggaaatttggccaatttttgttgtccttaccctatgtcaacaatacagagttgagtgcactacaatcctcaaaaatattggaaagtccagaacctctccttaggtcagctagtgggagacaagaatcattatctagtgccactcctggagaggcatctagagaatgtagaaatgcaaagaaaatttcatgcataagccctagatttggagttcctatggaaaacttgaccgcatgtggagaatccccaaattataagatatataaaacaccaaccaggatttacaaatcaaacaataagggagaaatatggtgtgcaggtgatgtccattgttttcaggaatttacgccagtactacaagaagtggttgataagttaaagaaaatgacatgctttttaacagagcctgaggcagaggaggatgcattctcaattgctatagctatgtgcaaaattctagataaaggagtttgcactataaacagcgaaaggtggaacatcataaaatgtgatagtggtcttatgtattatacagaccagagagatggacaagatacagggaatgattttggggagtactgtatatcacacaattgtaagacagaaagattccctatcaatccgtctataataagtgattgtatatgggaataccattctaggaaatccaggtatattagcaccttgaatttagaaagtttagaagaattcaaaagggctatttcagaaaagctctcacatacactcgtagtgtatcagtttaagccaacatctaaccttccccatatgaagccagtgtataaatatattacagcacaaggggttgaaaattctgatggaatagactcagcatttatcacagccagtatgccagctctcagtggaactagtataggatataatgtaatgtctaaagataatttccccttatttgatatcattatatttataaagagtgcagttattaagaccacatacaatcatatttatgacacaggccccactattggtattaatgtaatgcatgatgaacattgcacaggacagtgtccgatagaaataccccacaaagaaaactggttgacattctctcaagagagaacaagccgatggggttgtgaggaatttgggtgcttagctataaatacaggttgtgtgtttggatcttgccaagatataatcaggcctgagactaaggtatataggaaggcaatagaagaaagtgttttgttaacagtctgtgtgacatacccaggcaataccttttgcacagaaataaatgctatagaacctaaaataacagatgaattagagctccaattcaaaacagtagatacaaagacactacccaatctgctagcagttcaaaaccataagctgtacagtggtcagataaatgacctagggtcctttgcacaaggttgcggaaatatccagaaaactaacttatctgtgataggaactggtacagcaaaatttgactacatatgtcatggtgcctcaagaaaagacatagtagttagaagatgttataataacaattatgaatcatgcaaattgttgaaggaggagccaagcctaatcttttctgataatcatgaaacaatagaagtagcaaatattcgacaccttcttggagaattgcagtttaaattaatgctgggtgatttaagatataaatcatttgcagaaaacccagagctagagatagaggcaaagtgtgttggatgcccatcatgcttttctagttattcctgcaacttccgaataagttcaagtattgatacagtatgtgcaatagatggaccatgcacaatatttcacaatagattaattattagttcaactaagcaagattatggcatcaagatgagctgtaaagaaaagccaaacccagttgaaaaattcaacatatgtaagagagtatattcagtgttgttcacaactattgataaaaatgataagattgaaatagatacaggagaccaaacttcatttatacaagaaaaggatgacagatgcaaaacatggctctgtagagttagagatgaagggataagtgttatttttgagccgataaaagcattctttgggagttatttcagcattgcattctatgtagtaattgggataatagcactttttatcacaatatatatctttttgccaatggtttttaaattaaaagacatacttaaaaagaatgaactcttatatttacaggagatgaaatataagtag

SEQ ID NO: 4123 - RNA, 4305 nt, synthetic construct
  misc_feature 1..4305: note = derived and/or modified CDS sequence (wt) from ANADV(EIV-18098Yak)__KT313742.1__GP
  source 1..4305: mol_type = other RNA
atgtttttaattcttgtcttattgataccattctatatcacagctactccagtgacaacaaggtgcttccatgggggccagctgatagcagaaagcaaatctttgacagcaatctcagagttttgcctaaaagatgatgtctcaactgtcaaatctgaaataacatacctgaaaaatgacacaggaatatttgctcacagcaaggtattaaggaattggataataaaagactggaaaaattgcaatcctgtaccaacagcaggaggcagtataaatgtcatagaggtaaatgcagatttgagcctatccacaaaaacatatgtatgcagccgagattgtacaatcacagttgataaagaggatgcccaaataattttccaaacagacaaattaaatcactttgaagtttcaggcaccacactaagttcaggctggttcaagactaaggcatcagtaacattagatagaacatgtgagcatataaaagtgacttgtgggaaaaagacactacagttccatgcttgctttaagcatcacatgtcatgcataagattcttccacaatacaatactcccagggacaatggctgtatctatatgccaaaatatagagctcattataataacaagcttaaccttgattatcttcatattgatggtgatactgacaaaaacatatatatgctatgttttaatgcctttattcatgccagtagcatatttgtatggctgggcttacaataggagttgcaaaaagtgttcatgttgtgggcttgcatatcatccattcaccaattgtggttcacattgtgtatgtgggctgaaatttgaagcatcagacagaatgaggatacatcgggaatcaggattgtgtcagggatataagagcttaagggtggcaaggctgctatgcaaatcaaaaggctcttctttaattatctctatattactgtcagtgctaattttaagctttgttacacctatagagggaacactaacaaattacccagaatcaaagaaatatagtttggaagagatagctgatgttatagaaggattcattgctgagaaagggataaaagaatatattgtgctatatacttcaatatttggtgctttattattattaatagcattaatcatcacagtctctttaaacagaattacagaatatctaactaatctaaatgtcatttattgccatgaatgttccatgtatcattccaaaaagaatataaaatacgttggtgactttactaataaatgtgggttctgcacatgtggcgaattagaagatcaggaaggtctcaatatgcataaagtaagcaaaaagtgcatataccgatatcagttaacttggtctaaagtgattatgacaatcttagtctgtctattaatcgctcagaacactgtgctgattgtagcagcaaatgatgactgctgggctaaacaatcattagaaatagaatgcgttggacccttacagcaggtagatgcttgtgaggataagtcaagtagatcttacaatggagaggcaaaaaaactagttgggacatcaaaggtaacagaattagatgctggacaagtgaatcttcttggtcaaactatagagtcagcaatcattgcaataaggaaacaaagaacatatgcaactatgcatttccttgaatcagtatttttaggaaggcattgtgattattacaaagtatttgaacataatagtggttactctcaagcaaaatggaggttgctagccaaaacaaatcactttgatatctgctcaaggcatagcacacatcatttttgcagatgcatgtcagatggaacaaaatgcgaaaatgggaattgggattttgcaggcgaaatgaatactacttaccattcaaaaagagacttctttaaacatgattttaatttattttgcactttacttgaaaatgcattccctggcacaacagagtccctttattaccaactcttgtcaaagagaaacacaacaggggcatcaaaattattagggaagttgattacaaaatttgggaataacaatctctttgtagggatctggaaatttggccaatttttgttgtccttaccctatgtcaacaatacagagttgagtgcactacaatcctcaaaaatattggaaagtccagaacctctccttaggtcagctagtgggagacaagaatcattatctagtgccactcctggagaggcatctagagaatgtagaaatgcaaagaaaatttcatgcataagccctagatttggagttcctatggaaaacttgaccgcatgtggagaatccccaaattataagatatataaaacaccagccaggatttacaaatcaaacaataagggagaaatatggtgtgcaggtgatgtccattgttttcaggaatttacgccagtactacaagaagtggttgataagttaaagaaaatgacatgctttttaacagagcctgaggcagaggaggatgcattctcaattgctatagctatgtgcaaaattctagacaaaggagtttgcactataaacagcgaaaggtggaacatcataaaatgtgatagtggtcttatgtattatacagaccagagagatggacaagatacagggaatgattttggggagtactgtatatcacacaattgtaagacagaaagattccctatcaatccgtctataataagtgattgtatatgggaataccattctaggaaatccaggtatattagcaccttgaatttagaaagtttagaagaattcaaaagggctatttcagaaaagctctcacatacactcgtagtgtatcagtttaagccaacatctaaccttccccatatgaagccagtgtataaatatattacagcacaaggggttgaaaattctgatggaatagactcagcatttatcacagccagtatgccagctctcagtggaactagtataggatataatgtaatgtctaaagataatttccccttatttgatatcattatatttataaagagtgcagttattaagaccacatacaatcatatttatgacacaggccccactattggtattaatgtaatgcatgatgaacattgcacaggacagtgtccgatagaaataccccacaaagaaaactggttgacattctctcaagagagaacaagccgatggggttgtgaggaatttgggtgcttagctataaatacaggttgtgtgtttggatcttgccaagatataatcaggcctgagactaaggtatataggaaggcaatagaagaaagtgttttgttaacagtctgtgtgacatacccaggcaataccttttgcacagaaataaatgctatagaacctaaaataacagatgaattagagctccaattcaaaacagtagatacaaagacactacccaatctgctagcagttcaaaaccataagctgtacagtggtcagataaatgacctagggtcctttgcacaaggttgcggaaatatccagaaaactaacttatctgtgataggaactggtacagcaaaatttgactacatatgtcatggtgcctcaagaaaagacatagtagttagaagatgttataataacaattatgaatcatgcaaattgttgaaggaggagccaagcctaatcttttctgataatcatgaaacaatagaagtagcaaatattcgacaccttcttggagaattgcagtttaaattaatgctgggtgatttaagatataaatcatttgcagaaaacccagagctagagatagaggcaaagtgtgttggatgcccatcatgcttttctagttattcctgcaacttccgaataagttcaagtattgatacagtatgtgcaatagatggaccatgcacagtatttcacaatagattaattattagttcaactaagcaagattatggcatcaagatgagctgtaaagaaaagccaaacccagttgaaaaattcaacatatgtaagagagtatattcagtgttgttcacaactattgataaaaatgataagattgaaataaatacaggagaccaaacttcatttatacaagaaaaggatgacagatgcaaaacatggctctgtagagttagagatgaagggataagtgttatttttgagccaataaaagcattctttgggagttatttcagcattgcattctatgtagtaattgggataatagcactttttatcacaatatatatctttttgccaatggtttttaaattaaaagacatacttaaaaagaatgaactcttatatttacaggagatgaaatataagtag

SEQ ID NO: 4124 - RNA, 4305 nt, synthetic construct
  misc_feature 1..4305: note = derived and/or modified CDS sequence (wt) from ANADV(EIV-18136Yak)__KT313745.1__GP
  source 1..4305: mol_type = other RNA
atgttcttaattcttgtcttattgataccattctatatcacagctactccagtgacaacaaggtgcttccatgggggccagctgatagcagaaagcaaatctttgacagcaatctcagagttttgcctaaaagatgatgtctcaactgtcaaatctgaaataacatacctgaaaaatgacacaggaatatttgctcacagcaaagtattaaggaattggataataaaagactggaaaaattgcaatcctgtaccaacagcaggaggcagtataaatgtcatagaggtaaatgcagatttgagcctatccacaaaaacatatgtatgcagccgagattgtacaatcacagttgataaagaggatgcccaaataatttttcaaacagacaaattaaatcactttgaagtttcaggcaccacactaagttcaggctggttcaagactaaggcatcagtaacattagatagaacatgtgagcatataaaagtgacttgtgggaaaaagacactacagttccatgcttgctttaagcatcacatgtcatgcataagattcttccacaatacaatactcccagggacaatggctgtatctatatgccagaatatagagctcattataataacaagcttaaccttgattatcttcatattgatggtgatattgacaaaaacatatatatgctatgtcttaatgcctttattcatgccagtagcatatttatatggctgggcttacaataggagttgcaaaaagtgttcatgttgtgggcttgcatatcatccattcaccaattgtggttcccattgtgtatgtgggctgaaatttgaagcatcagacagaatgaggatacatcgggaatcaggattgtgtcagggatataaaagcttaagggtggcgaggctgctatgcaaatcaaaaggctcttctttaattatctctatattactgtcagtgctaattttaagctttgttacacctatagagggaacactaacaaattacccagaatcaaagaaatacagtttggaagagatagctgatgttatagaaggattcattgctgagaaagggataaaagaatatattgtgctatatacttcaatatttggtgctttattattattaatagcattaatcatcacagtctctttaaacagaattacagaatatctaactaatctaaatgtcatttattgccatgaatgttccatgtatcattccaaaaagaatataaaatacattggtgactttactaataaatgtgggttctgtacatgtggcgaattagaagatcaggaaggtctcaatatgcataaagtaagcaaaaagtgcatataccgatatcagttaacttggtctaaagtgattatgacaatcttagtctgtctattaatcgctcagaacactgtgctgattgtagcagcaaatgatgactgctgggctaaacaatcattagaaatagaatgcgttggacccttacagcaggtagatgcttgtgaggataagtcaagtagatcttacaatggagaggcaaaaaaactagttgggacatcaaaggtaacagaattagatgctggacaagtgaatcttcttggtcaaactatagagtcagcaatcattgcaataaggaaacaaagaacatatgcaactatgcatttccttgaatcagtatttttaggaaggcattgtgactattacaaagtatttgaacataatagtggttactctcaagcaaaatggaggttgctagccaaaacaaatcactttgatatctgctcaaggcatagcacacatcatttttgcagatgcatgtcagatggaacaaaatgcgaaaatggaaattgggattttgcaggcgaaatgaatactacttaccattcaaaaagagatttctttaaacatgattttaaattattttgcactttacttgaaaatgcattccccggcacaacagagtccctttattaccaacttttgtcaaagagaaatacaacaggggcatcaaaattattagggaagttgattacaaaattcgggaataacaatctctttgtagggatctggaaatttggccaatttttgttgtccttaccctatgtcaacaatacagagttgagcgcactgcaatcctcaaagatattggaaagcccagaacctctccttaggtcagctagtgggagacaagaatcattgtctagtgccactcctggggaggcatctaaagaatgtagaaatgcaaagaaaatttcatgcataagccctagatttggagttcctatggaaaacttgactgcatgtggagaatccccaaattataagatatataaaacaccaaccaggatttacaaatcaaacaataagggagaaatatggtgtgtaggtgatgttcattgctttcaggaatttacgccagtactacaagaagtggtcgacaaattaaagaaaatgacatgttttttaaccgagcctgaggcagaggaggatgcattctcaatcgctatagctatgtgcaaaattctagacaaaggagtttgcaccataaacagcgaaaggtggaacatcatgaaatgtgatagtggtcttatgtattatacagatcagagagatgggcaagatacagggaatgattttggggagtactgtatatcacacaattgtaagacagaaagattccctatcaatccgtctataataagtgattgtatatgggaataccattctagaaaatccaggtatattggcaccttgaatttagaaagtttagaagagttcaaaagggctatttcagaaaagctctcacatacacttgtagtgtatcagtttaagccaacatctaaccttccccatatgaagccagtgtataaatatattacagcacaaggggttgaaaattctgatggaatagactcagcatttatcacagccagtatgccagctctcagtggaactagtataggatataatgtaatgtctaaagacaatttccccttatttgatataattatatttataaagagtgcagttattaagaccacatacaatcatatttatgacacagggcccactattggtattaatgtaatgcatgatgaacattgcacaggacagtgtccgatagaaatacctcacaaagaaaactggttgacattctctcaagagagaacaagccgatggggttgtgaggaatttgggtgcttagctataaatacaggttgtgtgtttggatcttgtcaagatataatcaggcctgagactaaggtatataggaaggcaatagaagaaagtgtcttgttgacagtctgtgtgacatacccaggcaataccttttgcacagaaataaatgctatagaacctaaaataacagatgaattagagctccaattcaaaacagtagatacaaagacactacccaatttgctagcagttcaaaaccataagctgtacagtggtcagataaatgacctagggtcctttgcacaaggttgcggaaatatccagaaaactaacttatctgtgataggaactggaacagcaaaatttgactacatatgtcatggtgcctcaagaaaagacatagtggttagaagatgttataataacaattatgaatcatgcaaattgttgaaggaggagccaagcctaatcttttctgataatcatgaaacaatagaagtagcaaatattcggcaccttcttggagaattgcagtttaaattaatgctgggtgatttgagatataaatcatttgcagaaaacccagagctagagatagaggcaaggtgtgttggatgcccatcatgcttttctagttattcctgcaatttccgaataagttcaagtattgatacagtatgtgcaatagatggaccatgcacaatatttcacaatagattaattattagttcaactaagcaagattatggcatcaagatgagctgtaaagaaaagccaaacccagttgaaaaattcaacatatgtaagagagtatattcagtgttgttcacaactattgataaaaatgataagattgaaataaatacaggagaccaaacttcatttatacaagaaaaggatgacagatgcaaaacatggctctgtagagttagagatgaagggataagtgttatttttgagccgataaaagcattctttgggagttatttcagcattgcattctatgtggtgattgggataatagcactttttatcataatatatatctttttgccaatggtttttaaattaaaagacatacttaaaaagaatgaactcttatatttacaagagatgaaatataagtag

SEQ ID NO: 4125 - RNA, 4305 nt, synthetic construct
  misc_feature 1..4305: note = derived and/or modified CDS sequence (wt) from ANADV(EIV-18146Yak)__KT313748.1__GP
  source 1..4305: mol_type = other RNA
atgtttttaattcttgtcttattgataccattctatatcacagctactccagtgacaacaaggtgcttccatgggggccagctgatagcagaaagcaaatctttgacagcaatctcagagttttgcctaaaagatgatgtctcaactgtcaaatctgaaataatatacctgaaaaatgacacaggaatatttgctcacagcaaagtattaaggaattggataataaaagactggaaaaattgcaatcctgtaccaacagcaggaggcagtataaatgtcatagaggtaaatgcagatttgagcctatccacaaaaacatatgtatgcagccgggattgtacaatcacagttgataaagaggatgcccaaataatttttcaaacagacaaattaaatcactttgaagtttcaggcaccacactaagttcaggctggttcaagactaaggcatcagtaacattagatagaacatgtgagcatataaaagtgacttgtgggaaaaagacactacagctccatgcttgctttaagcatcacatgtcatgcataagattcttccacaatacaatactcccagggacaatggctgtatctatatgccagaatatagagctcattataataacaagcttaaccttgattatcttcatattgatggtgatattgacaaaaacatatatatgctatgtcttaatgcctttattcatgccagtagcatatttatatggctgggcttacaataggagttgcaaaaagtgttcatgttgtgggcttgcatatcatccattcaccaattgtggttcccattgtgtatgtgggctgaaatttgaagcatcagacagaatgaggatacatcgggaatcaggattgtgtcagggatataaaagcttaagggtggcgaggctgctatgcaaatcaaaaggctcttctttaattgtctctatattactgtcagtgctaattttaagctttgttacacctatagagggaacactaacaaattacccagaatcaaagaaatacagtttggaagagatagctgatgttatagaaggattcattgctgagaaagggataaaagaatatattgtgctatatacttcaatatttggtgctttattattattaatagcattaatcatcacagtctctttaaacagaattacagaatatctaactaatctaaatgtcatttattgccatgaatgttccatgtatcattccaaaaagaatataaaatacattggtgactttactaataaatgtgggttctgtacatgtggcgaattagaagatcaggaaggtctcaatatgcataaagtaagcaaaaagtgcatataccgatatcagttaacttggtctaaagtgattatgacaatcttagtctgtctattaatcgctcagaacactgtgctgattgtagcagcaaatgatgactgctgggctaaacaatcattagaaatagaatgtgttggacccttacagcaggtagatgcttgtgaggataagtcaagtagatcttacaatgaagaggcaaaaaaactagttgggacatcaaaggtaacagaattagatgctggacaagtgaatcttcttggtcaaactatagagtcagcaatcattgcaataaggaaacaaagaacatatgcaactatgcatttccttgaatcagtatttttaggaaggcattgtgactattacaaagtatttgaacataatagtggttactctcaagcaaaatggaggttgctagccaaaacaaatcactttgatatctgctcaaggcatagcacacatcatttttgcagatgcatgtcagatggaacaaaatgcgaaaatggaaattgggattttgcaggcgaaatgaatactacttaccattcaaaaagagatttctttaaacatgattttaatttattttgcactttacttgaaaatgcattccccggcacaacagagtccctttattaccaacttttgtcaaagagaaatacaacaggggcatcaaaattattagggaagttgattacaaaattcgggaataacaatctctttgtagggatctggaaatttggccaatttttgttgtccttaccctatgtcaacaatacagagttgagcgcactgcaatcctcaaagatattggaaagtccagaacctctccttaggtcagctagtgggagacaagaatcattgtctagtgccactcctggggaggcatctaaagaatgtagaaatgcaaagaaaatttcatgcataagccctagatttggagttcctatggaaaacttgactgcatgtggagaatccccaaattataagatatataaaacaccaaccaggatttacaaatcaaacaataagggagaaatatggtgtgcaggtgatgttcattgctttcaggaatttacgccagtactacaagaagtggtcgacaaattaaagaaaatgacatgttttttaacagagcctgaggcagaggaggatgcattctcaattgctatagctatgtgcaaaattctagacaaaggagtttgcaccataaacagcgaaaggtggaacatcataaaatgtgatagtggtcttatgtattatacagatcagagagatgggcaagatacagggaatgattttggggagtactgtatatcacacaattgtaagacagaaagattccctatcaatccgtctataataagtgattgtatatgggaataccattctagaaaatccaggtatattagcaccttgaatttagaaagtttagaagagttcaaaagggctatttcagaaaagctctcacatacactcatagtgtatcagtttaagccaacatctaaccttccccatatgaagccagtgtataaatatattacagcacaaggggttgaaaattctgatggaatagactcagcatttatcacagccagtatgccagctctcagtggaactagtataggatataatgtaatgtctaaagataatttccccttatttgatataattatatttataaagagtgcagttattaagaccacatacaatcatatttatgacacagggcccactattggtattaatgtaatgcatgatgaacattgcacaggacagtgtccgatagaaatacctcacaaagaaaactggttgacattctctcaagagagaacaagccgatggggttgtgaggaatttgggtgcttagctataaatacaggttgtgtgtttggatcttgtcaagatataatcaggcctgagactaaggtatataggaaggcaatagaagaaagtgtcttgttgacagtctgtgtgacatacccaggcaataccttttgcacagaaataaatgctatagaacctaaaataacagatgaattagagctccaattcaaaacagtagatacaaagacactacccaatttgctagcagttcaaaaccataagctgtacagtggtcagataaatgacctagggtcctttgcacaaggttgcggaaatatccagaaaactaacttatctgtgataggaactggaacagcaaaatttgactacatatgtcatggtgcctcaagaaaagacatagtggttagaagatgttataataacaattatgaatcatgcaaattgttgaaggaggagccaagcctaatcttttctgataatcatgaaacaatagaagtagcaaatattcggcaccttcttggagaattgcagtttaaattaatgctgggtgatttgagatataaatcatttgcagaaaacccagagctagagatagaggcaaggtgtgttggatgcccatcatgcttttctagttattcctgcaatttccgaataagttcaagtattgatacagtatgtgcaatagatggaccatgcacaatatttcacaatagattaattattagttcaactaagcaagattatggcatcaagatgagctgtaaagaaaagccaaacccagttgaaaaattcaacatatgtaagagagtatattcagtgttgttcacaactattgataaaaatgataagattgaaataaatacaggagaccaaacctcatttatacaagaaaaggatgacagatgcaaaacatggctctgtagagttagagatgaagggataagtgttatttttgagccgataaaagcattctttgggagttatttcagcattgcattctatgtggtaattgggataatagcactttttatcataatatatatctttttgccaatggtttttaaattaaaagacatacttaaaaagaatgaactcttatatttacaagagatgaaatataagtag

SEQ ID NO: 4126 - RNA, 4305 nt, synthetic construct
  misc_feature 1..4305: note = derived and/or modified CDS sequence (wt) from ANADV(EIV-18353Yak)__KT313751.1__GP
  source 1..4305: mol_type = other RNA
atgtttttaattcttgtcttattgataccattctatatcacagctactccagtgacaacaaggtgcttccatggaggccagctgatagcagaaagcaaatctttgacagcaatctcagagttttgcctaaaagatgatgtctcaactgtcaaatctgaaataatatacctgaaaaatgacacaggaatatttgctcacagcaaagtattaaggaattggataataaaagactggaaaaattgcaatcctgtaccaacagcaggaggcagtataaatgtcatagaggtaaatgcagatttgagcctatccacaaaaacatatgtatgcagccgagattgtacaatcacagttgataaagaggatgcccaaataatttttcaaacagacaaattaaatcactttgaagtttcaggcaccacactaagttcaggctggttcaagactaaggcatcagtaacattagatagaacatgtgagcatataaaagtgacttgtgggaaaaagacactacagttccatgcttgctttaagcatcacatgtcatgcataagattcttccacaatacaatactcccagggacaatggctgtatctatatgccagaatatagagctcattataataacaagcttaaccctgattatcttcatattgatggtgatattgacaaaaacatatatatgctatgtcttaatgcctttattcatgccagtagcatatttatatggctgggcttacaataggagttgcaaaaagtgttcatgttgtgggcttgcatatcatccattcaccaattgtggttcccattgtgtatgtgggctgaaatttgaagcatcagacagaatgaggatacatcgggaatcaggattgtgtcagggatataaaagcttaagggtggcgaggctgctatgcaaatcaaaaggctcttctttaattatctctatattactgtcagtgctaattttaagctttgttacacctatagagggaacactaacaaattacccagaatcaaagaaatacagtttggaagagatagctgatgttatagaaggattcattgctgagaaagggataaaagaatatattgtgctatatacttcaatatttggtgctttattattattaatagcattaatcatcacagtctctttaaacagaattacagaatatctaactaatctaaatgtcatttattgccatgaatgttccatgtatcattccaaaaagaatataaaatacattggtgactttactaataaatgtgggttctgtacatgtggcgaattagaagatcaggaaggtctcaatatgcataaagtaagcaaaaagtgcatataccgatatcagttaacttggtctaaagtgattatgacaatcttagtctgtctattaatcgctcagaacactgtgctgattgtagcagcaaatgatgactgctgggctaaacaatcattagaaatagaatgcgttggacccttacagcaggtagatgcttgtgaggataagtcaagtagatcttacaatgaagaggcaaaaaaactagttgggacatcaaaggtaacagaattagatgctggacaagtgaatcttcttggtcaaactatagagtcagcaatcattgcaataaggaaacaaagaacatatgcaactatgcatttccttgaatcagtatttttaggaaggcattgtgactattacaaagtatttgaacataatagtggttactctcaagcaaaatggaggttgctagccaaaacaaatcactttgatatctgctcaaggcatagcacacatcatttttgcagatgcatgtcagatggaacaaaatgcgaaaatggaaattgggattttgcaggcgaaatgaatactacttaccattcaaaaagagatttctttaaacatgattttaatttattttgcactttacttgaaaatgcattccccggcacaacagagtccctttattaccaacttttgtcaaagagaaatacaacaggggcatcaaaattattagggaagttgattacaaaattcgggaataacaatctctttgtagggatctggaaatttggccaatttttgttgtccttaccctatgtcaacaatacagagttgagcgcactgcaatcctcaaagatattggaaagtccagaacctctccttaggtcagctagtgggagacaagaatcattgtctagtgccactcctggggaggcatctaaagaatgtagaaatgcaaagaaaatttcatgcataagccctagatttggagttcctatggaaaacttgactgcatgtggagaatccccaaattataagatatataaaacaccaaccaggatttacaaatcaaacaataagggagaaatatggtgtgcaggtgatgttcattgctttcaggaatttacgccagtactacaagaagtggtcgacaaattaaagaaaatgacatgttttttaacagagcctgaggcagaggaggatgcattctcaattgctatagctatgtgcaaaattctagacaaaggagtttgcaccataaacagcgaaaggtggaacatcataaaatgtgatagtggtcttatgtattatacagatcagagagatgggcaagatacagggaatgattttggggagtactgtatatcacacaattgtaagacagaaagattccctatcaatccgtctataataagtgattgtatatgggaataccattctagaaaatccaggtatattagcaccctgaatttagaaagtttagaagagttcaaaagggctatttcagaaaagctctcacatacactcatagtgtatcagtttaagccaacatctaaccttccccatatgaagccagtgtataaatatattacagcacaaggggttgaaaattctgatggaatagactcagcatttatcacagccagtatgccagctctcagtggaactagtataggatataatgtaatgtctaaagataatttccccttatttgatataattatatttataaagagtgcagttattaagaccacatacaatcatatttatgacacagggcccactattggtattaatgtaatgcatgatgaacattgcacaggacagtgtccgatagaaatacctcacaaagaaaactggttgacattctctcaagagagaacaagccgatggggttgtgaggaatttgggtgcttagctataaatacaggttgtgtgtttggatcttgtcaagatataatcaggcctgagactaaggtatataggaaggcaatagaagaaagtgtcttgttgacagtctgtgtgacatacccaggcaataccttttgcacagaaataaatgctatagaacctaaaataacagatgaattagagctccaattcaaaacagtagatacaaagacactacccaatttgctagcagttcaaaaccataagctgtacagtggtcagataaatgacctagggtcctttgcacaaggttgcggaaatatccagaaaactaacttatctgtgataggaactggaacagcaaaatttgactacatatgtcatggtgcctcaagaaaagacatagtggttagaagatgttataataacaattatgaatcatgcaaattgttgaaggaggagccaagcctaatcttttctgataatcatgaaacaatagaagtagcaaatattcggcaccttcttggagaattgcagtttaaattaatgctgggtgatttgagatataaatcatttgcagaaaacccagagctagagatagaggcaaggtgtgttggatgcccatcatgcttttctagttattcctgcaatttccgaataagttcaagtattgatacagtatgtgcaatagatggaccatgcacaatatttcacaatagattaattattagtccaactaagcaagattatggcatcaagatgagctgtaaagaaaagccaaacccagttgaaaaattcaacatatgtaagagagtatattcagtgttgttcacaactattgataaaaatgataagattgaaataaatacaggagaccaaacctcatttatacaagaaaaggatgacagatgcaaaacatggctctgtagagttagagatgaagggataagtgttatttttgagccgataaaagcattctttgggagttatttcagcattgcattctatgtggtaattgggataatagcactttttatcataatatatatctttttgccaatggtttttaaattaaaagacatacttaaaaagaatgaactcttatatttacaagagatgaaatataagtag

SEQ ID NO: 4127 - RNA, 4305 nt, synthetic construct
  misc_feature 1..4305: note = derived and/or modified CDS sequence (wt) from ANADV(EIV-18560Yak)__KT313754.1__GP
  source 1..4305: mol_type = other RNA
atgtttttaattcttgtcttattgataccattctatatcacagctactccagtgacaacaaggtgcttccatggaggccagctgatagcagaaagcaaatctttgacagcaatctcagagttttgcctaaaagatgatgtctcaactgtcaaatctgaaataatatacctgaaaaatgacacaggaatatttgctcacagcaaagtattaaggaattggataataaaagactggaaaaattgcaatcctgtaccaacagcaggaggcagtataaatgtcatagaggtaaatgcagatttgagcctatccacaaaaacatatgtatgcagccgagattgtacaatcacagttgataaagaggatgcccaaataatttttcaaacagacaaattaaatcactttgaagtttcaggcaccacactaagttcaggctggttcaagactaaggcatcagtaacattagatagaacatgtgagcatataaaagtgacttgtgggaaaaagacactacagttccatgcttgctttaagcatcacatgtcatgcataagattcttccacaatacaatactcccagggacaatggctgtatctatatgccagaatatagagctcattataataacaagcttaaccctgattatcttcatattgatggtgatattgacaaaaacatatatatgctatgtcttaatgcctttattcatgccagtagcatatttatatggctgggcttacaataggagttgcaaaaagtgttcatgttgtgggcttgcatatcatccattcaccaattgtggttcccattgtgtatgtgggctgaaatttgaagcatcagacagaatgaggatacatcgggaatcaggattgtgtcagggatataaaagcttaagggtggcgaggctgctatgcaaatcaaaaggctcttctttaattatctctatattactgtcagtgctaattttaagctttgttacacctatagagggaacactaacaaattacccagaatcaaagaaatacagtttggaagagatagctgatgttatagaaggattcattgctgagaaagggataaaagaatatattgtgctatatacttcaatatttggtgctttattattattaatagcattaatcatcacagtctctttaaacagaattacagaatatctaactaatctaaatgtcatttattgccatgaatgttccatgtatcattccaaaaagaatataaaatacattggtgactttactaataaatgtgggttctgtacatgtggcgaattagaagatcaggaaggtctcaatatgcataaagtaagcaaaaagtgcatataccgatatcagttaacttggtctaaagtgattatgacaatcttagtctgtctattaatcgctcagaacactgtgctgattgtagcagcaaatgatgactgctgggctaaacaatcattagaaatagaatgcgttggacccttacagcaggtagatgcttgtgaggataagtcaagtagatcttacaatgaagaggcaaaaaaactagttgggacatcaaaggtaacagaattagatgctggacaagtgaatcttcttggtcaaactatagagtcagcaatcattgcaataaggaaacaaagaacatatgcaactatgcatttccttgaatcagtatttttaggaaggcattgtgactattacaaagtatttgaacataatagtggttactctcaagcaaaatggaggttgctagccaaaacaaatcactttgatatctgctcaaggcatagcacacatcatttttgcagatgcatgtcagatggaacaaaatgcgaaaatggaaatcgggattttgcaggcgaaatgaatactacttaccattcaaaaagagatttctttaaacatgattttaatttattttgcactttacttgaaaatgcattccccggcacaacagagtccctttattaccaacttttgtcaaagagaaatacaacaggggcatcaaaattattagggaagttgattacaaaattcgggaataacaatctctttgtagggatctggaaatttggccaatttttgttgtccttaccctatgtcaacaatacagagttgagcgcactgcaatcctcaaagatattggaaagtccagaacctctccttaggtcagctagtgggagacaagaatcattgtctagtgccactcctggggaggcatctaaagaatgtagaaatgcaaagaaaatttcatgcataagccctagatttggagttcctatggaaaacttgactgcatgtggagaatccccaaattataagatatataaaacaccaaccaggatttacaaatcaaacaataagggagaaatatggtgtgcaggtgatgttcattgctttcaggaatttacgccagtactacaagaagtggtcgacaaattaaagaaaatgacatgttttttaacagagcctgaggcagaggaggatgcattctcaattgctatagctatgtgcaaaattctagacaaaggagtttgcaccataaacagcgaaaggtggaacatcataaaatgtgatagtggtcttatgtattatacagatcagagagatgggcaagatacagggaatgattttggggagtactgtatatcacacaattgtaagacagaaagattccctatcaatccgtctataataagtgattgtatatgggaataccattctagaaaatccaggtatattagcaccttgaatttagaaagtttagaagagttcaaaagggctatttcagaaaagctctcacatacactcatagtgtatcagtttaagccaacatctaaccttccccatatgaagccagtgtataaatatattacagcacaaggggttgaaaattctgatggaatagactcagcatttatcacagccagtatgccagctctcagtggaactagtataggatataatgtaatgtctaaagataatttccccttatttgatataattatatttataaagagtgcagttattaagaccacatacaatcatatttatgacacagggcccactattggtattaatgtaatgcatgatgaacattgcacaggacagtgtccgatagaaatacctcacaaagaaaactggttgacattctctcaagagagaacaagccgatggggttgtgaggaatttgggtgcttagctataaatacaggttgtgtgtttggatcttgtcaagatataatcaggcctgagactaaggtatataggaaggcaatagaagaaagtgtcttgttgacagtctgtgtgacatacccaggcaataccttttgcacagaaataaatgctatagaacctaaaataacagatgaattagagctccaattcaaaacagtagatacaaagacactacccaatttgctagcagttcaaaaccataagctgtacagtggtcagataaatgacctagggtcctttgcacaaggttgcggaaatatccagaaaactaacttatctgtgataggaactggaacagcaaaatttgactacatatgtcatggtgcctcaagaaaagacatagtggttagaagatgttataataacaattatgaatcatgcaaattgttgaaggaggagccaagcctaatcttttctgataatcatgaaacaatagaagtagcaaatattcggcaccttcttggagaattgcagtttaaattaatgctgggtgatttgagatataaatcatttgcagaaaacccagagctagagatagaggcaaggtgtgttggatgcccatcatgcttttctagttattcctgcaatttccgaataagttcaagtattgatacagtatgtgcaatagatggaccatgcacaatatttcacaatagattaattattagtccaactaagcaagattatggcatcaagatgagctgtaaagaaaagccaaacccagttgaaaaattcaacatatgtaagagagtatattcagtgttgttcacaactattgataaaaatgataagattgaaataaatacaggagaccaaacctcatttatacaagaaaaggatgacagatgcaaaacatggctctgtagagttagagatgaagggataagtgttatttttgagccgataaaagcattctttgggagttatttcagcattgcattctatgtggtaattgggataatagcactttttatcataatatatatctttttgccaatggtttttaaattaaaagacatacttaaaaagaatgaactcttatatttacaagagatgaaatataagtag

SEQ ID NO: 4128 - RNA, 4305 nt, synthetic construct
  misc_feature 1..4305: note = derived and/or modified CDS sequence (wt) from ANADV(EIV-18715Yak)__KT313757.1__GP
  source 1..4305: mol_type = other RNA
atgtttttaattcttgtcttattgataccattctatatcacagctactccagtgacaacaaggtgcttccatgggggccagctgatagcagaaagcaaatctttgacagcaatctcagagttttgcctaaaagatgatgtctcaactgtcaaatctgaaataacatacctgaaaaatgacacaggaatatttgctcacagcaaagtattaaggaattggataataaaagactggaaaaattgcaatcctgtaccaacagcaggaggcagtataaatgtcatagaggtaaatgcagatttgagcctatccacaaaaacatatgtatgcagccgagattgtacaatcacagttgataaagaggatgcccaaataatttttcaaacagacaaattaaatcactttgaggtttcaggcaccacactaagttcaggctggttcaagactaaggcatcagtaacattagatagaacatgtgagcatataaaagtgacttgtgggaaaaagacactacagttccatgcttgctttaagcatcacatgtcatgcataagattcttccacaatacaatactcccagggacaatggctgtatctatatgccagaatatagagctcattataataacaagcttaaccttgattatcttcatattgatggtgatattgacaaaaacatatatatgctatgtcttaatgcctttattcatgccagtagcatatttatatggctgggcttacaataggagttgcaaaaagtgtccatgttgtgggcttgcatatcatccatttaccaattgtggttcccattgtgtatgtgggctgaaatttgaagcatcagacagaatgaggatacatcgggaatcaggattgtgtcagggatataaaagcttaagggtggcgaggctgctatgcaaatcaaaaggctcttctttaattatctctatattactgtcagtgctaattttaagctttgttacacctatagaggggacactaacaaattacccagaatcaaagaaatacagtttggaagagatagctgatgttatagaaggattcattgctgagaaagggataaaagaatatattgtgctatatacttcaatatttggtgctttattattattaatagcattaatcatcacagtctctttaaacagaattacagaatatctaactaatctaaatgtcatttattgccatgaatgttccatgtatcattccaaaaagaatataaaatacattggtgactttactaataaatgtgggttctgtacatgtggcgaattagaagatcaggaaggtctcaatatgcataaggtaagcaaaaagtgcatataccgatatcagttaacttggtctaaagtgattatgacaatcttaatctgtctattaatcgctcagaacactgtgctgattgtagcagcaaatgatgactgctgggctaaacaatcattagaaatagaatgcgttggacccttacagcaggtagatgcttgtgaggataagtcaagtagatcttacaatggagaggcaaaaaaactagttgggacatcaagggtaacagaattagatgctggacaagtgaatcttcttggtcaaactatagagtcagcaatcattgcaataaggaaacaaagaacatatgcaactatgcatttccttgaatcagtatttttaggaaggcattgtgactattacaaagtatttgaacataatagtggttactctcaagcaaaatggaggttgctagccaaaacaaatcactttgatatctgctcaaggcatagcacacatcatttttgcagatgcatgtcagatggaacaaaatgcgaaaatggaaattgggattttgcaggcgaaatgaatactacttaccattcaaaaagagatttctttaaacatgattttagtttattttgcactttacttgaaaatgcattccccggcacaacagagtccctttattaccaacttttgtcaaagagaaatacaacaggggcatcaaaattattagggaagttgattacaaaattcgggaataacaatctctttgtagggatctggaaatttggccaatttttgttgtccttaccctatgtcaacaatacagagttgagcgcactgcaatcctcaaagatattggaaagtccagaacctctccttaggtcagctagtgggagacaagaatcattgtctagtgccactcctggggaggcatctaaagaatgtagaaatgcaaagaaaatttcatgcataagccctagatttggagttcctatggaaaacttgactgcatgtggagaatccccaaattataagatatataaaacaccaaccaggatttacaaatcaaacaataagggagaaatatggtgtgcaggtgatgttcattgctttcaggaatttacgccagtactacaagaagtggtcgacaaattaaagaaaatgacatgttttttaacagagcctgaggcagaggaggatgcattctcaattgctatagctatgtgcaaaattctagacaaaggagtttgcaccataaacagcgaaaggtggaatatcataaaatgtgatagtggtcttatgtattatacagatcagagagatgggcaagatacagggaatgattttggggagtactgtatatcacacaattgtaagacagaaagattccctatcaatccgtctataataagtgattgtgtatgggaataccattctagaaaatccaggtatattagcaccttgaatttagaaagtttagaagagttcaaaagggctatttcagaaaagctctcacatacactcgtagtgtatcagtttaagccaacatctaaccttccccatatgaagccagtgtataaatatattacagcacaaggggttgaaaattctgatggaatagactcagcatttatcacagccagtatgccagctcttagtggaactagtataggatataatgtaatgtctaaagataatttccccttatttgatataattatatttataaagagtgcagttattaagaccacatacaatcatatttatgacacagggcccactattggtattaatgtaatgcatgatgaacattgcacaggacagtgtccgatagaaatacctcacaaagaaaactggttgacattctctcaagagagaacaagccgatggggttgtgaggaatttgggtgcttagctataaatacaggttgtgtgtttggatcttgtcaagatataatcaggcctgagactaaggtatataggaaggcaatagaagaaagtgtcttgttgacagtctgtgtgacatacccaggcaataccttttgcacagaaataaatgctatagaacctaaaataacagatgaattagagctccaattcaaaacagtagatacaaagacactacccaatttgctagcagttcaaaaccataagctgtacagtggtcagataaatgacctagggtcctttgcacaaggttgcggaaatatccagaaaactaacttatctgtgataggaactggaacagcaaaatttgactacatatgtcatggtgcctcaagaaaagacatagtggttagaagatgttataataacaattatgaatcatgcaaattgttgaaggaggagccaagcctaatcttttctgataatcatgaaacaatagaagtagcaaatattcggcaccttcttggagaattgcagtttaaattaatgctgggtgatttgagatataaatcatttgcagaaaacccagagctagagatagaggcaaggtgtgttggatgtccatcatgcttttctagttattcctgcaatttccgaataagttcaagtattgatacagtatgtgcaatagatggaccatgcacaatatttcacagcagattaattattagttcaactaagcaagattatggcatcaagatgagctgtaaagaaaagccaaacccagttgaaaaattcaacatatgtaagagagtatattcagtgttgttcacaactattgataaaaatgataagattgaaataaatacaggagaccaaacttcatttatacaagaaaaggacgacagatgcaaaacatggctctgtagagttagagatgaagggataagtgttatttttgagccgataaaagcattctttgggagttatttcagcattgcattctatgtggtaattgggataatagcactttttatcataatatatatctttttgccaatggtttttaaattaaaagacatacttaaaaagaatgaactcttatatttacaagagatgaaatataagtag

SEQ ID NO: 4129 - RNA, 4305 nt, synthetic construct
  misc_feature 1..4305: note = derived and/or modified CDS sequence (wt) from ANADV(EIV-23263Tyum)__KT313760.1__GP
  source 1..4305: mol_type = other RNA
atgtttttaattcttgtcttattgataccattctatatcacagctactccagtgacaacaaggtgcttccatgggggccagctgatagcagaaagcaaatctttgacagcaatctcagagttttgcctaaaagatgatgtctcaactgtcaaatctgaaataacatacctgaaaaatgacacaggaatatttgctcacagcaaagtattaagaaattggataataaaagactggaaaaattgcaatcctgtaccaacagcaggaggcagtataaatgtcatagaggtaaatgcagatttgagcctatccacaaagacatatgtatgcagccgagattgtacaatcacagttgataaagaggatgcccaaataattttccaaacagacaaattaaatcactttgaagtttcaggcaccacactaagttcaggctggtttaagactaaggcatcagtaacattagatagaacatgtgagcatataaaagtgacttgtgggaaaaagacactacagttccatgcttgctttaagcatcacatgtcatgcataagattcttccacaatacaatactcccagggacaatggctgtatctatatgccagaatatagagctcattataataacaagcttaaccttgattatctttatattgatggtgatattgacaaaaacatatatatgttatgtcttaatgcctttattcatgccagtagcatatttgtatggctgggcttacaataggagttgcaaaaagtgttcatgttgtgggcttgcatatcatccattcaccaattgtggttcccattgtgtatgtgggctgaaatttgaagcatcagacagaatgaggatacatcgggaatcaggattgtgtcagggatataaaagcttaagggtggcgaggctgctatgcaaatcaaaaggctcttctttaattatctctatattactgtcagtgctaattttaagctttgttacacctatagagggaacactaacaaattacccagaatcaaagaaatacagtttggaagagatagctgatgttatagaaggattcattgctgagagagggataaaagaatatattgtgctatatacttcaatatttggtgctttattattattaatagcattaatcatcacagtctctttaaacagaattacagaatatctaactaatctaaatgtcatttattgccatgaatgttccatgtatcattccaaaaagaatataaaatacattggtgactttactaataaatgtgggttctgcacatgtggcgaattagaagatcaggaaggtctcaatatgcataaagtaagcaaaaagtgcatataccgatatcagttaacttggtctaaagtgattatgacaatcttagtctgtctattaatcgctcagaacactgtgctgattgtagcagcaaatgatgactgctgggctaaacaatcattagaaatagaatgcgttggacccttacagcaggtagatgcttgtgaggataagtcaagtagatcttacaatggagaggcaagaaaactagttgggacgtcaaaggtaacagaattagatgctggacaagtgaatcttcttggtcaaactatagagtcagcaatcattgcaataaggaaacaaagaacatatgcaactatgcatttccttgaatcagtatttttaggaaggcattgtgactattacaaagtatttgaacataatagtggttactctcaagcaaaatggaggttgctagccaaaacaaatcactttgatatctgttcaaggcatagcacacatcatttttgcagatgcatgtcagatggaacaaaatgcgaaaatggaaattgggattttgcaggcgaaatgaatactacttaccattcaaaaagagatttctttaaacatgattttaagttattttgcactttacttgaaaatgcattccctggcacaacagagtccctttattaccaacttttgtcaaagagaaatacaacaggggcatcaaaattattagggaagttgattacaaaattcgggaataacaatctctttgtagggatctggaaatttggccaatttttgttgtccttaccctatgtcaacaatacagagttgagcgcactgcaatcctcaaagatattggaaagtccagaacctctccttaggtcagctagtgggagacaagaatcattatctagtgccactcctggggaggcatctaaagaatgtagaaatgcaaagaaaatttcatgcataagccctagatttggagttcctatggaaaacttgaccgcatgtggagaatccccaaattataagatatttaaaacaccaaccaggatttacaaatcaaacaataagggagaaatatggtgtgcaggtgatgtccattgcttccaggagtttacaccaatactacaagaagtggttgacaaattaaagaaaatgacatgttttttaacagagcctgaggcagaggaggatgcattctcaattgctatagctatgtgcaaaattctagacaaaggagtttgcaccataaacagcgaaaggtggaacatcataaaatgtgatagtggtcttatgtattatacagatcagagagatgggcaagatacagggaatgattttggggagtactgtatatcacacaattgtaagacagaaaggttccctatcaatccgtccataataagtgattgtatatgggaataccattctagaaaatccaggtatattagcaccttgaatttagaaagtttagaagagttcaaaagggctatttcagaaaagctctcacatacactcgtagtgtatcagtttaagccaacatctaaccttccccatatgaagccagtgtataaatatattacagcacaaggggttgaaaattctgatggaatagactcagcatttatcacagccagtatgccagctctcagtggaactagtataggatataatgtaatgtctaaagataatttccccttatttgatataattatatttataaagagtgcagttattaagaccacatacaatcatatttatgacacaggccccactattggtattaatgtaatgcatgatgaacattgcacaggacagtgtccgatagaaatacctcacaaagaaaactggttgacattctctcaagagagaacaagccgatggggttgtgaggaatttgggtgcttagctataaatacaggttgtgtgtttggatcttgtcaagatataatcaggcctgagactaaggtatataggaaggcaatagaagaaagtgtcttgttgacagtctgtgtgacatacccaggcaataccttttgcacagaaataaatgctatagaacctaaaataacagatgaattagagctccaattcaaaacagtagatacaaagacactacccaatttgctagcagttcaaaaccataagctgtacagtggtcagataaatgacctagggtcctttgcacaaggttgcggaaatatccagaaaactaacttatctgtgataggaactggaacagcaaaatttgactacatatgtcatggtgcctcaagaaaagacatagtggttagaagatgttataataacaattatgaatcatgcaaattgttgaaggaggagccaagcctaatcttttctgataatcatgaaacaatagaagtagcaaatattcggcaccttcttggagaattgcagtttaaattaatgctgggtgatttgagatataaatcatttgcagaaaacccagagctagagatagaggcaaggtgtgttggatgcccatcatgcttttctagttattcctgcaatttccgaataagttcaagtattgatacagtatgtgcaatagatggaccatgcacaatatttcacaatagattaattattagttcaactaagcaagattatggcatcaagatgagctgtaaagaaaagccaaacccagttgaaaaattcaacatatgtaagagagtatattcagtgttgtttacaactattgataaaaatgataagattgaaataaatacaggagaccaaacttcatttatacaagaaaaggatgacagatgcaaaacatggctctgtagagttagagatgaagggataagtgttatttttgagccgataaaagcattctttgggagttatttcagcattgcattctatgtggtaattgggataatagcactttttatcataatatatatctttttgccaatgggttttaaattaaaagacatactcaaaaagaatgaactcttatatttacaagagatgaaatataagtag

SEQ ID NO: 4130 - RNA, 4305 nt, synthetic construct
  misc_feature 1..4305: note = derived and/or modified CDS sequence (wt) from BATV(804992)__FJ436801.1__GP
  source 1..4305: mol_type = other RNA
atgttgttacttcttgtcttattaatcccttgctgtgtatcagcctctcctgtaataacaagatgttttcatggagggcaactaatagcagaaaggaagtcccaagcggctatatcagaattttgcctcaaagatgatgtctctactatcaaatcagagataatatatgaaaaaaatgacactggtttatttgcacacaataaagttttacgaaattggattataaaggattggaaaaattgtaatcctgttcccacagcaggaggcagtataaatgttatagaagtcaatacagatctaagcctgactacaaaaacatatgtgtgtagcagggattgcacaatcacagttgataaagaagatgctcaaataattttccaaactgaaaaactgaatcattttgaagtttctgggaccacattgagctcaggttggttcaaaaccaaagcgtcagtaacattagatagaacctgcgaacacattaaagtaacatgtggaaaaaagaccctacagttccatgcctgtttcaagcaccacatgtcatgtattagatttttccatggcactatccttcctggaacaatggccacctctatctgtcagaacatagaactcataattataatcagtctgacattgattatttttatcttaatggtaatactgactaaaacttacatatgttatctattaatgccactatttatgccaatcgcatacttctatggttggtcatataacaaaagttgcaaaaaatgtccatgttgtggcttagcatatcacccttttacaaattgtggatcacattgtgtgtgcggattgaaatttgaggcatcagataggatgaggatacatagagagtcaggattgtgtcaaggctacaaaagcttacgtgttgctaggttgctgtgtaaatcaaaaggttcatcccttataatctcaatattattatctatgttgatactaagctttgttacaccaatagaggggacattaactaattatccggaatcaagaaaatacgacctagaggaaattgctgatgtcttagaaggattcgttgtggaaaaaggaataaaagaatatgtggtcttttatacttctattttcggagctttatttttattaatggcattgattgtcataatagcactaaacagagtcacagaatatctcacaaacattaatgttttatactgtcacgaatgttcaatgtatcactcaaagaagaatataaaatatattggagatttcacaaacaaatgtggcttttgtacatgtggagagcttgaagatcaagagggcttaaaaatacataaagtgagcaggaagtgcatatataaatatcagctcacctggtccaaggtaattatgatgatattagtgtgtttactgattgctcaaaacaccatcctgatagttgcagcatcagatgattgctggactaaaaagtctttagagatggaatgtataggccctttacagcaagtggatacatgtgatgacaaaacaagcaggtcatacagtggggaagcaaaaaaactagtgagggcatcaaaaatatcagatttggatgcagcacaggtggggctgttaggatccacaatagaatcagcaatagcaagcataagaaggcaaagaacatattcaactatgcatcttcttgaatcagttttcctgggaaagcattgtgattactataaagtttttgagcataacagtggctactctcaggcaaagtggaggttaacagctaagacacatcattttgatatttgttcaagacacagcacccatcacttctgtagatgcatctcagacggaactaaatgtcaaaatggagattgggactttgcaggtgaaatgaactcaatataccaatcaaagaaagacttttttaagcatgacttcaaactgttctgcactcttgtagaaaatgccttcccaggtacaacagagtcactcttctatgaaatgctatcaaagaaaaacacaactggtattacaaaattattagataaattaacaaaaaaattcgggaacaacaatatgttcgtaggaatatggaaatttgggcaatatctaatgtcactaccatacgtcaatgaaacatcattatctcctattcaacttgcaaaggtattagaggttacagatcaacatcaccggtccgtttctggcaggcaagagtcgctggctagtgctactcctgggagtaagtccagtgaatgtgaccatgcaaagaaggtttcttgcataagtcctagatttggcgctccaatggaaggattaatggcatgtgggaactcgccaaattacaaaatttacaagacaccagcaaagctttacaaatcaaacaacaagggagaagtgtggtgttcaggtgatgttcactgttttcaagagcttacccctgcctcacaagaatctgtagacaggataaaacaaatgacttgctttttgaccgaacccgaagtaaatgatgacgttttttctattgcaatagctatgtgcaaagtccaagataagggagtatgtacaataaatgaagataggtggaacataataaaatgtgatagtggcctgatatattatactgaccagagggaggggcaagacacaggcaatgattttggagagtattgtttgtcccacagctgtagaatagaaagattcccgataaatccggcaataattagtgattgtttatgggaatatcattcgcgaaaatcaaagtatataactagtttagacttagaaagcttagaagagtttaaaagggccatttctgaaaaattgtcacatactcttgtagtgtataattttaaaccgacagccaaccttcctcatataaagccagtatacaagtatatcacagtgcaaggagttgaaaattctgacggagtagattcagcatatataactgctagtatgccagctttaagtgggacaagcataggctataacataatgtctagggataacttcccactattcgatataattatatttataaaaagtgctattattaaagcaacttacaatcacatatatgacacaggtcctactatagggattaatgtaatgcatgatgaacattgtacaggacaatgcccaacagacataccacataaagaaaattggatcacatttgcccaagagagaactagtcgttggggatgtgaagaatttgggtgtcttgctgtcaacaccggctgtgtttttggctcttgtcaagatataataaggccagaaacgaaggtttatagaaaagcagttgaagagagtgtcttattaacagtttgtataacttaccctggtaaaacattttgcacagaaataaatgccatagagcctaaaattacagacgagttagaattgcagtttaaaacagttgatacaaaaacactgcccaacatcttagctgtccaaaatcataaattatatagtggacaaatcaatgacttgggatcattctcccagggctgtggtaacatacagaaaactaattcatctatcataggcacaggcactgcaaagtttgattatgtgtgtcatggtgcctctaggaaagatatcattgtaaggagatgctacaataataattatgaatcatgtaaattattgaaggaggaacaatccttaatgtttgcagataatcatgaaacaatcgatgtagccaatgtcagacatctccttggggatctgcagtttaaattaatgttgggagatctaaggtacaagtcatttgcggaaaacccagatttagaaatagaagcaaagtgtgttggatgcccatcatgttttactagttattcctgcagtttcaaaattgtttcaaatattgatactgtgtgctcaattgaagggccttgtacaacttttcataacagattaatgatcacctctacaaaacaagattatggcattaaaatgagctgtaagacaaagccagggctgacagaggagttccaaatttgcaaaaaaacttacacagtactgttcgcaacagttgaaaaaaatgataaaatcgaaataagcacaggagaccaaacatcttttatccaagaaagagatgatagatgcaaaacatggttatgtagggttagggatgaagggatcagtgttattttcgaaccgataagagctttctttggaagctactttagtatagctttttatatagtaattggtatcattgtcctgtttctagtaatctacattttcttgcccatgatgtttaaacttagagatgtgctaaaaagaaatgaatacctgtacctacaggagataaaacataagtaa

SEQ ID NO: 4131 - RNA, 4305 nt, synthetic construct
  misc_feature 1..4305: note = derived and/or modified CDS sequence (wt) from BATV(8627-11)__FJ436799.1__GP
  source 1..4305: mol_type = other RNA
atgttgttacttcttgtcttattaatcccttgctgtgtatcagcctctcctgtaataacaagatgttttcatggagggcaactaatagcagaaaggaagtcccaagcggctatatcagaattttgcctcaaagatgatgtctctactatcaaatcagagataatatatgaaaaaaatgacactggtttatttgcacacaataaagttttacgaaattggattataaaggattggaaaaattgtaatcctgttcccacagcagggggcagtataaatgttatagaagtcaatacagatctaagcctgactacaaaaacatatgtgtgtagcagggattgcacaatcacagttgataaagaagatgctcaaataattttccaaactgaaaaactaaatcattttgaagtttctgggaccacattgagctcaggttggttcaaaaccaaagcgtcagtaacattagatagaacctgcgaacacattaaagtaacatgtggaaaaaagaccctacagttccatgcctgtttcaagcaccacatgtcatgtattagatttttccatggcactatccttcctggaacaatggccacctctatctgtcagaacatagaactcataattataatcagtctgacattgattatttttatcttaatggtaatactgactaaaacttacatatgttatctattaatgccactatttatgccaattgcatacttctatggttggtcatataacaaaagttgcaaaaaatgtccatgttgtggcttagcatatcacccttttacaaattgtggatcacattgtgtgtgtggattgaaatttgaggcatcagataggatgaggatacatagagagtcaggattgtgtcaaggctacaaaagcttacgtgttgctaggttgctgtgtaaatcaaaaggttcttcccttataatctcaatattattatctatgttgatactaagctttgttacaccaatagaggggacattaactaattatccggaatcaagaaaatacgacctagaggaaattgctgatgtcctagaaggatttgttgtggaaaaaggaataaaagaatatgtggtcttttacacttctattttcggagctttatttttattaatggcattgattgtcataatagcactaaacagagtcacagaatatctcacaaacattaatgttttatactgtcacgaatgttcaatgtatcactcaaagaagaatataaaatatattggagatttcacaaacaaatgtggcttttgtacatgtggagagcttgaagatcaagagggcttaaaaatacataaagtgagcaggaagtgcatatataaatatcagctcacctggtccaaggtaattatgatgatattagtgtgtttattgattgctcaaaacaccatcctgatagttgcagcatcggacgattgctggactaaaaggtctttagagatggaatgtataggccctttacagcaagtggatacatgtgatgataaaacaagcaggtcatacagtggggaagcaaaaaaactagtgagggcatcaaaaatatcagatttggatgcagcacaggtggggctgttaggatccacaatagaatcagcaatagcaagcataagaaggcaaagaacatattcaactatgcatcttcttgagtcagttttcctgggaaagcattgtgattactataaagtttttgagcacaacagtggctactctcaggcaaagtggaggttaacagctaagacacatcattttgatatttgttcaagacacagcacccatcacttctgtagatgcatctcagacggaactaaatgtcaaaatggagattgggactttgcaggtgaaatgaactcaacataccaatcaaagaaagacttttttgagcatgacttcaaactgttctgcactcttgtagaaaatgccttcccaggtacaacagagtcactcttctatgaaatgctatcaaagaaaaacacaactggtattacaaaattattagataaattaacaaaaaaattcgggaacaacaatatgtttgtaggaatatggaaatttgggcaatatctaatgtcactaccatacgtcaatgaaacatcattatctcctactcaacttgcgaaagtattagaggttacagatcaacatcaccggtccgtttctggcaggcaagagtcgctggctagtgctactcccgggagtaagtccagtgaatgtgaccatgcaaagaaggtttcttgcataagtcctagatttggcgttccaatggaaggattaatggcatgtgggaactcgccaaattacaaaatttacaagacaccagcaaagctttacaaatcaaacaacaagggagaagtgtggtgttcaggtaatgttcactgttttcaagagcttaaccctgcctcacaagaatctgtagacaggataaaacaaatgacttgctttttgaccgaacccgaagtaaatgatgacgttttttctattgcaatagctatgtgcaaagtccaagataagggagtatgtacaataaataaagataggtggaacataataaaatgtgatagtggcctgatatattatactgaccagagagaggggcaagacacaggcaatgattttggagagtattgtttgtcccacagctgtagaatagaaagattcccgataaatccggcaataattagtgattgtttatgggaatatcattcacgaaaatcaaagtatataactagtttagacttagaaagcttagaagagtttaaaagggccatttctgaaaaattgtcacatactctcgtagtgtataattttaaaccgacagccaatcttcctcatataaagccagtatacgagtatatcacagtgcaaggagttgaaaattctgacggagtagattcagcatatataactgctagtatgccagctttaagtggaacaagcataggctataacataatgtctagggataacttcccactattcgatataattatatttataaaaagtgctattattaaagcaacttacaatcacatatatgacacaggtcctactatagggattaatgtaatgcatgatgaacattgtacaggacaatgcccaacagacataccacataaagaaaattggatcacatttgcccaggagagaactagtcgttggggatgtgaagaatttgggtgtcttgctgtcaacaccggctgtgtttttggctcttgtcaagatataataaggccagaaacgaaggtttatagaaaagcagttgaagagagtgtcttattaacagtttgtataacttaccctggtaaaacattttgcacagaaataaatgccatagagcctaaaattacagacgagttagaattgcagtttaaaacagttgatacaaaaacgctgcccaacatcttagctgtccaaaatcataaattatatagtggacaaattaatgacttaggatcattctcccagggctgtggtaacatacagaaaactaattcatccatcataggcacaggcactgcaaagtttgattatgtgtgtcatggtgcctctaggaaagatatcattgtaaggagatgctacaataataattatgaatcatgtaaattattgaaggaggaacaatccttaatgtttgcagataatcatgaaacaatcgatgtagccaatgtcagacatctccttggggatctgcagtttaaattaatgttgggagatctaaggtacaagtcatttgcggaaaacccagatttagaaatagaagcaaagtgtgttggatgcccatcatgttttactagttattcctgcagtttcaaaattgtttcaaatattgatactgtgtgctcaattgaagggccttgtacaacttttcataacagattaatgatcacctctacaagacaagattatggcattaaaatgagctgtaagacaaagccagggctaacagaggagttccaaatttgcaagaaaacttacacagtactgttcgcaacagttgaaaagaatgataaaatcgaaataagcacaggagaccaaacatcttttatccaagaaagagatgatagatgcaaaacatggttatgtagggttagggatgaagggatcagtgttattttcgaaccgataagagctttctttggaagctactttagtatagctttctatatagtaattggtatcattgtcctgtttctagtaatctacattttcttgcccatgatgtttaaacttagagatgtgttaaaaagaaatgaatacctgtacctacaggaaataaaacataagtaa

SEQ ID NO: 4132 - RNA, 4305 nt, synthetic construct
  misc_feature 1..4305: note = derived and/or modified CDS sequence (wt) from BATV(Chittoor/IG-20217)__JX846599.1__GP
  source 1..4305: mol_type = other RNA
atgttgctacttcttgtcttattaatcccttgctgtgtatcagcctctcctgtaataacaagatgttttcatggagggcaactgatagcagaaaggaagtcccaagcggctatatcagaattttgcctcaaggatgatgtctctactatcaaatcagaaataatatatgaaaaaaatgacactggtttatttgcacataataaagttttacgaaattggattataaaggactggaaaaattgcaatcctgttcccacagcagggggcagtataaatgttatagaagtcaatacagatttgagcttgactacaaaaacatatgtgtgtagcagggattgcacaatcacagttgataaagaagatgctcaaataattttccaaactgaaaaactgaatcactttgaagtttctggaaccacattgagctcaggttggttcaaaaccaaagcatcagtaacattagatagaacctgcgaacacattaaagtaacatgtgggaaaaagaccctacagttccatgcctgtttcaagcaccacatgtcatgtattagatttttccatggcactatccttcctggaacaatggctacctctatctgtcagaatatagaactcataattataataagtctgacattgattatttttatcttaatgataatactgaccaaaacctacatatgttatctattaatgccactatttatgccaatcgcatacttctatggttggtcatataacaaaagttgcaaaaaatgtccatgttgtggcttagcatatcacccttttacaaattgtggatcacattgtgtgtgcggattgaaatttgaggcatcagataggatgaggatacatagagaatcaggattgtgtcaaggctataaaagcttacgtgttgctaggttgctgtgtaaatcaaaaggttcatccctcataatctcgatattattatctatgttgatactaagctttgttacaccaatagaggggacattaaccaattatccagaatcaagaaaatacgacctagaggaaattgctgatgtcttagaaggattcgttgtggaaaaaggaataaaagaatatgtagtcttttatacttctattttcggagctttatttttattaatggcattgattgtcataatagcactaaacagagttacagaatatctcacaaacatcaatgttttatactgtcacgaatgttcaatgtatcactcaaagaagaatataaaatatattggagatttcacaaataaatgtggcttttgtacatgtggagagctcgaagatcaagagggcttaaaaatacataaagtgagcaggaagtgcatatataaatatcagctcacctggtccaaagtaattatgatgatattagtgtgtttactgattgctcaaaacaccatcctgatagttgcagcatcagacgattgctggactaaaaagtctttagagatggaatgtataggccctttacagcaagtggatacatgtgacgacaaaacaagcaggtcatacagtggggaggcaaaaaaactagtgagggcatcaaaaatatcagatttggatgcagcacaggtggggctgttaggatccacaatagaatcagcaatagcaagcataagaaggcaaagaacatattcaactatgcatcttcttgaatcagttttcctggggaagcattgtgattactataaagtttttgagcataacagtggctactctcaggcaaaatggaggttaacagctaaaacacatcattttgatatttgttcaagacacagcacccatcacttctgtagatgcatctcagacggaactaaatgtcaaaatggagattgggactttgcaggtgaaatgaactcaacataccaatcaaagagagacttttttgagcatgacttcaaactgttctgcactcttatagaaaatgccttcccaggcacaacagagtcactcttctatgaaatgctatcaaagaaaaacacaactggtattacaaaactattagataaattaacaaaaaaatttgggaacaacaatatgttcgtaggaatatggaaatttgggcaatatctaatttcactaccatacgtcaatgaaacatcattatctcctactcaacttgcaaaagtattagaggttacagatcaacatcaccggtccatttctggaaggcaagagtcgctggctagtgctacccctgggagtaagtccagtgaatgtgaccatgcaaagaaggcttcttgcataagtcctaggtttggtgttccaatggaaggattaatggcatgtgggaactcgccaaattacaaaatttacaagacaccagcaaagctttacaaatcaaacaacaagggagaagtgtggtgttcaggtaattttcactgttttcaagagctcatccccgcctcacaagaatctgttgacaggataaaacaaatgacttgctttttgaccgaacctgaagtaaatgatgacgttttttctattgcaatagctatgtgcaaagtccaagacaagggagtatgtacaataaataaggataggtggaacgtaataaaatgtgatagtggcctgatatattatactgaccagagagaggggcaagacacaggcaatgattttggagagtattgtttatcccacagctgtagaatagaaagattcccgataaatccggcaataattagtgattgtttatgggaatatcattcacgaaaatcaaagtatataactagtttagacttagaaagcttagaagagtttaaaagagctatttctgaaaaattgtcacatactctcatagtgtataattttaaaccgacagccaatcttcctcatataaagccagtatacaagtatatcacagtgcaaggagttgaaaattctgatggagtagattcagcatatataactgctagtatgccagctttaagtgggacaagcataggctataacataatgtctagggataacttcccactattcgatataattatatttataaaaagtgccattattaaagcaacttacaatcacatatatgacacaggtcctactatagggatcaatgtaatgcatgatgaacattgtacaggacaatgcccaacagacataccacataaagaaaattggatcacatttgcccaagagagaactagtcgttggggatgtgaagaatttgggtgtcttgctgtcaacaccggctgtgtttttggctcttgtcaagatataataaggccagaaacaaaggtttatagaaaagcagttgaggagagtgtcttattaacagtttgtataacttaccctggtaaaacattttgcacagaaataaatgccatagagcctaaaattacagacgaattagaattgcagtttaaaacagttgatataaaaacactgcccaacatcttagctgtccaaaatcataaattatatagtggacagattaatgacttaggatcattctcccagggctgtggtaacatacagaaaactaattcatccatcataggcacaggcactgcaaagtttgattatgtgtgtcatggtgcctctaggaaagatatcattgtaaggagatgctacaataataattatgagtcatgtaaattattgaaggaggaacaatccttgatgtttgcagataatcatgaaacaatcgatgtagccaatgtcagacatctccttggggatctgcagtttaaattaatgttgggagatctaaggtacaaatcatttgcggaaaatccagatttagaaatagaagcaaagtgtgttggatgcccatcatgttttactagttattcctgcagtttcaaaattgtttcaaatattgatactgtgtgctcaattgaagggccttgtacaacttttcataacagattaatgatcacctccacaaaacaagattatggcattaaaatgagctgtaagacaaagccagggctgacagaggagttccagatttgcaagaaaacttatacagtactgttcgcaacagttgaaaagaatgataaaatcgaaataagcacaggagaccaaacatcttttatccaagaaagagatgatagatgcaaaacatggttgtgtagggttagggatgaagggatcagtgttattttcgaaccgataagagctttctttggaagctactttagtatagctttttatatagtaattggtatcattgtcctgtttctagtaatctacattttcttgcccatgatgtttaaacttagagatgtgttaaaaagaaatgaatacctgtacctacaggaaataaaacataagtaa

SEQ ID NO: 4133 - RNA, 4305 nt, synthetic construct
  misc_feature 1..4305: note = derived and/or modified CDS sequence (wt) from BATV(41.3)__KM507322.1__GP
  source 1..4305: mol_type = other RNA
atgttgctattcctcatcttactaattccctgttatgcatcagcctcccctgtagtaacaagatgcttccatggagggcaattaatagcagagagtaggtccccaacagctgtgtcagagttctgcttaaaagacgatgtctctactattaaatcagagataatatatgtcaagaatgatactggattgtttgcgcacaacaaagttttaaggaattggatcataaaagactggaagaattgcaatcctgtgcctacagctgggggtagtattaatgtcatagaagtcaatacagacctgagcttgagcacaaaaacatacgtgtgtagtagagattgcacaattacagttgataaagaagatgctcagataatattccaaactgagaaattaaatcattttgaagtttctggaaccacattaagttcaggctggttcaaaactaaagcatcagtaacgctggatagaacatgtgagcatatcaaggtcacatgtgggaaaaagactctgcaatttcatgcatgttttaagcaccatatgtcatgcattagatttttccatagtaccattcttcccggaacaatggcaacttcaatctgtcaaaatatagagcttataattataataagtttgacactgctcatttttatcttgatggcaatattgactaaaacctacatatgttatttgctaatgcccttattcatgcctattgcatatctttatggttggtcatataatagaagctgtaaaaaatgttcatgctgcggcctagcatatcatccattcacaaattgtggctcacattgtgtctgtggtttaaagtttgaagcatcagacagaatgagaatacacagagaatcagggttatgccagggctacaaaagcttaagagtagcaagactgttgtgcaaatcaaaaggttcatctcttataatttcaatattgttatctatgttaatcctgagctttgttacgccgatagaagggactttaactaattacccagagtcaaggaaatacgatctagaagaaattgctgacgtcttggaggggtttattacagaaaagggaataaaagaatatgtagttttttatacttctatttttgggggtttatttttattactggcattgattattataattgcattgaacagagttacagaatacctcacaaatattaatgtcttttattgtcacgaatgctcaatgtatcattcaaagaagaatataaaatatattggtgattttacaaataagtgtgggttttgtacatgtggggagctagaagatcaagaaggattaaagatacacaaagtcagcaggaagtgcatatacaaatatcaacttacttggtccaaaataatcatgataatattagtgtgtctactgattgcccaaaataccatcttaatagttgcagcatcaaatgattgttgggcaaaaaaatctttagagatggaatgcatagggcccttgcagcaagtggaatcatgtgatgacaaagcaagcagatcttacagcggagaggcaaaaaagctagtaagagcatctaaaatatcagatttagatgcagcacaagtaggcttactaggttctacaatagaatcagcaatagcaagtataaggaaacaaagaacatatccaaccatgcatctccttgaatcagtatttttggcaaaacattgtgattactataaatcctttgagcataatagtggttattcccaagcaaaatggcggttaacagctaaaacacatcattttgacatttgttcaagacacagcacccaccatttctgtaggtgcatttctgatggaaccaaatgccagaatggggattgggattttgcaggtgagatgaattcaacatatcaatcaaaaaaagatttttttgagcatgattttaaactattctgcaccctcctggagaatgctttcccaggcacaacagaatcattttattatcaaatgctgcaaaagaaaaatacaactggcgttgtaaaactattggatgaattaacaaagaaatttggaaacaataacatgtttgtggggatatggaaatttggacaatatttaatgtcactcccgtacatcaatgaaacatcattaactcctttacaactttcaaaaatattggaagcttcaaaccagcatcaccgctctatatctggaaggcaagaatcattagctaatgctgcctctgggggtaaatctaaagaatgcgatcatgcaaaaaaagtctcttgcataagtcctaggtttggtgttccaatggaagggctaatagcatgtggaagctcaccaaattataaaatttataagatgccaacaaagctttacaaatcgaataataaaggcgaagtgtggtgttcaggtgatgttcattgcttccaagaattgaaccctgcttcacaggagtctgtggatagaataaagcaaatgacatgttttttgactgagcctgagacaaatgaagatgtcttttcaattgccatatctatgtgcaaggttcaagataaaggagtgtgcacaataaatgaagagagatggaatgtaataaaatgcgacagtggcttaatatattacactgaccagagggatggacaagacacaggtaacgactttggagaatattgcctatcacacaattgtaggattgaaaggtttccaataaaccctacaataataaatgattgcctatgggaatatcattcacgaaaatctaagtacattactagtttagacttagaaagtcttgaagaattcaaaagggctatttctgagaaattatcacataccctcatagtatataattttaaaccaacggccaacctccctcatatcaagccagtgtataaatatattacagtacaaggggttgagaattctgatggagtggattcagcatacataactgctagcatgccggctctaagtggaacaagtataggatataatataatgtctaaagataacttcccattatttgatataatcatattcataaaaagcgctgttatcaaggcaacttataatcacatatatgatacaggccccactatagggataaatgtaatgcatgatgagcactgcacaggtcagtgcccaacagatataccacataaagagaattggatcacattttcccaggaaaggactagccgttggggatgtgaagaattcggatgccttgctgtgaatacaggttgtgtctttggttcttgccaagatataataagaccagaaacaaaagtatatagaaaagcaatcgaagaaagtgtcttattaacagtctgcataacttatcccggtaagacattttgtacagaaataaatgctatagaacctaaaattacagatgaattagaactgcaatttaaaacagttgacacaaaaacattacccaatatattagctgttcaaaaccacaaattgtatagtgggcaaataaatgatttaggatcgttttcacaaggttgtggtaacatacagaaaaccaattcatctataataggaacaggcactgccaaatttgattacgtatgtcatggtgcctctagaaaagatattattgtaagaagatgttacaacaataactatgaatcatgcagattattaaaagaagaacaatccttaatgtttgcagacaaccatgaaactattgacgtagctaatgtcaggcacctccttggggatctacaatttaagttgatgttaggagatttaagatacaagtcatttgcagaagacccagacttagagatagaagcaaaatgtgttgggtgtccatcatgtttcactagttactcctgcaattttagaattgtttcaaatattgatactgtgtgttcaattgaagggccttgcacaacctttcacaacaggctaatgattacttccacaaaacaggattatggcatcaagatgagctgtaagggaaagccaggatcaacagaagaatttcagatctgcaagaaaacttacacagtgttgtttacaacagttgaaaagaatgacaaaattgagataaacacaggagaccaaacatctttcattcaagagagggatgatagatgcaaaacatggttatgtagggtcagagatgaagggattagtgttatttttgaaccaataagggcctttttcgggagttattttagtatagccttctatatcgtggttggaatcattgtcctgttccttatgatctacattttcttgcctatggcatttaaacttagggatgtattaaaaaggaatgaatatctatatctacaggagataaagcacaagtag

SEQ ID NO: 4134 - RNA, 4305 nt, synthetic construct
  misc_feature 1..4305: note = derived and/or modified CDS sequence (wt) from BATV(EIV-1217Astr)__KT313699.1__GP
  source 1..4305: mol_type = other RNA
atgttgctattcctcatcttactaatcccctgttatgcatcagcctcccctgtagtaacaagatgcttccatggagggcaattaatagcagaaagtaggtccccaacagctgtgtcagaattctgcttaaaagatgatgtctctactattaaatcagagataatatatgttaagaatgatactggattgtttgcacacaacaaagttttaaggaactggatcataaaagactggaaaaactgcaatcctgtgcctacagctgggggtagcattaatgtcatagaagttaatacagacctgagcttgagcacaaaaacatacgtgtgtagtagagattgcacaattacagttgataaagaagatgctcagataatcttccaaactgagaaattaaatcattttgaagtttctggaaccacattaagttcaggctggttcaaaactaaagcatcagtaacactggatagaacatgtgagcatatcaaggtcacatgtgggaaaaagactctgcaatttcatgcatgttttaagcaccatatgtcatgcattagatttttccatggtaccattctccccggaacaatggcaacttcgatctgtcaaaatatagagcttataattataataagtttgacactgcttatttttatcttgatggcaatattgactaaaacctacatatgttatttgctaatgcccttattcatgcctattgcatatctttatggttggtcatataatagaagctgtaaaaaatgttcatgctgtggcctagcctatcatccattcacaaattgtggctcacattgtgtctgtggtttaaagtttgaagcatcagacagaatgagaatacacagagaatcaggattatgccagggctacaaaagcttaagagtagcaagactattgtgcaaatcaaaaggttcatctcttataatttcaatattgttatctatgttaatcctgagctttgttacgccaatagaagggactttaactaattacccagagtcaaggaaatacgatctagaggaaattgctgacgtcttggagggatttgttacagaaaagggaataaaagaatatgtagttttttatacttctatttttgggggtttgtttttattactggcattgattattataattgcattgaacagagttacagaatacctcacaaatattaatgtcttttattgtcacgaatgctcaatgtatcattcaaaaaagaatataaaatatattggtgattttacaaataagtgtgggttttgcacatgtggggagctagaagatcaagaaggattaaagatacacaaagtcagcagaaagtgcatatacaaatatcaacttacttggtccaaaataatcatgataatattagtgtgtctactgattgcccaaaataccatcttaatagttgcagcatcaaatgattgttgggcaaagaaatctttagagatggaatgcatagggcctttgcagcaaatggaatcatgtgatgacaaagcaagcagatcttatagtggagaggcaaaaaagctagtaagggcatctaaaatatcagatttagatgcagcacaagtaggcttactaggttctacaatagaatcagcaatagcaagtataagaaaacaaagaacatatccaaccatgcatctccttgaatcagtatttttggcaaaacattgtgattactataaatcctttgagcataatagtggttattcccaagcaaaatggcggttaacagctaaaacacatcattttgacatttgttcaagacacagcacccaccatttctgtagatgcatttctgatggaactaaatgccagaatggggactgggattttgcaggtgagatgaattcaacatatcaatcaaaaaaagatttcttcaagcatgattttaaactattctgcaccctcctggagaatgctttcccaggcacaacagaatcattttattatcaaatgctgcaaaagaaaaatacaactggtgttgtaaaactattggatgaattaacaaagaaatttggaaacaataatatgttcgtagggatatggaaatttggacaatatttaatgtcactcccatacatcaatgaaacatcattaactcctttacaactttcaaaaatattggaggcttcagaccagcatcatcgctctatatctggaaggcaagaatcattagctaatgccgcctctgggggtaaatctaaagaatgtgatcatgcaaaaaaagtctcttgcataagtcctaggtttggtgtcccaatggaagggctaatagcatgtggaggctcaccaaattataaaatttataagatgccaacaaagctttacaaatcaaataataaaggagaagtatggtgttcaggtgatgttcattgtttccaagaattgaaccctgctttacaggagtctgtagatagaataaagcaaatgacatgttttttgactgaacctgagacaaatgaagatgtcttttcaattgccatatctatgtgcaaggttcaagataaaggagtgtgcacaataaatgaagagagatggaatgtaataaaatgcgacagtggcttaatatattacactgaccagagggatggacaagacacaggtaacgactttggagaatattgcctatcacacaattgtagaattgaaaggtttccaataaaccctacaataataaatgattgcctatgggaatatcattcacgaaaatctaagtacattactagtttagacttagaaagtcttgaagaattcaaaagggcaatttctgagaaattatcacataccctcatagtatataattttaaaccaacggctaacctccctcatatcaagccagtgtataaatatattacagtacaaggggttgagaattctgatggagtagattcagcatacataactgctagcatgccggctctaagtggaacaagtataggatataatataatgtctaaagataacttcccattatttgatataatcatattcataaaaagcgctgttatcaaggcaacttataatcacatatatgatacaggccccactatagggataaatgtaatgcatgatgagcactgcacaggtcagtgcccaacagatataccacataaagagaattggatcacattttctcaggaaaggactagccgttggggatgtgaagaattcggatgccttgctgtgaatacaggttgtgtctttggttcttgccaggatataataagaccagaaacaaaagtatatagaaaagcaatcgaagaaagtgttttattaacagtctgcataacttatcccggtaagacattttgtacagaaataaatgctatagaacctaaaattacagatgaattagaactgcaatttaaaacagttgacacaaaaacattacccaatatattagctgttcaaaaccacaaattatatagtgggcaaataaatgatttaggatcgttttcacaaggctgtggtaatatacagaaaaccaattcatctataataggaacaggcactgccaaatttgattacgtatgtcatggtgcttctagaaaagatattattgtaagaaggtgttacaacaataactatgaatcatgcagattattaaaagaagaacaatccttaatgtttgcagacaaccatgagactattgacgtagctaatgtcaggcacctccttggggatctacaatttaagttaatgttaggagatttaagatacaagtcatttgcagaagacccagacttagagatagaagcaaaatgtgttgggtgtccatcatgttttactagctactcctgcaattttagaattgtttcaaatattgatactgtgtgttcaattgaagggccttgcacaacctttcacaacaggctaatgatcacttccacaaaacaggattatggcatcaagatgagctgtaagggaaaaccaggatcaacagaagaatttcagatctgcaagaaaacttacacagtgttgtttacaacagttgaaaagaacgacaaaattgagataaacacaggagaccaaacatctttcattcaagagagggatgatagatgcaaaacatggttatgtagggtcagagatgaagggattagtgttgtttttgaaccaataagggcctttttcgggagctattttagtatagccttctatatcgtggttggaatcattgtcctgttccttgtgatctacattttcttgcctatggcatttaagcttagggatgtattaaaaaggaatgaatatctatatctacaggagataaagcacaagtag

SEQ ID NO: 4135 - RNA, 4305 nt, synthetic construct
  misc_feature 1..4305: note = derived and/or modified CDS sequence (wt) from BATV(EIV-12497Bl)__KT313692.1__GP
  source 1..4305: mol_type = other RNA
atgttgctattcctcatcttactaattccctgttatgcatcagcctcccctgtagtaacaagatgcttccatggagggcaattaatagcagagagtaggtccccaacagctgtgtcagagttctgcttaaaagatgatgtctctactatcaaatcagagataatatatgtcaagaatgatactggattgtttgcgcacaacaaagttttaaggaattggatcataaaagactggaagaactgcaatcctgtgcctacagctgggggtagcattaatgtcatagaagttaatacagacctgagcttgagcacaaaaacatacgtgtgtagtagagattgcacaattacagttgataaagaagatgctcagataatcttccaaactgagaaattaaatcattttgaagtttctggaaccacattaagttcaggctggttcaaaactaaagcatcagtaacactggataggacatgtgagcatatcaaggtcacatgtgggaaaaagactctgcaatttcatgcatgctttaagcaccatatgtcatgcattagatttttccatggtaccattctccccggaacaatggcaacttcaatctgtcaaaatatagagcttataattataacaagtttgacactgctcatttttatcttgatggcaatattgactaaaacctacatatgttatttgctaatgcccttattcatgcctattgcatatctttatggttggtcatataatagaagctgtaaaaaatgttcatgctgtggcctagcatatcatccattcacaaattgtggctcacattgtgtctgtggtttaaagtttgaagcatcagacagaatgagaatacacagagaatcagggttatgccagggctacaaaagcttaagagtagcaagactattgtgcaaatcaaaaggttcatctcttataatttcaatattgttatctatgttaatcctgagctttgttacaccgatagaagggactttaactaattacccggagtcaaggaaatatgatctagaagaaattgctgacgtcttggaggggtttattacagaaaagggaataaaagaatatgtagttttttatacttctatttttgggggtttgtttttattactggcattgattattataattgcattaaacagagttacagaatacctcacaaatattaatgtcttttattgtcatgaatgctcaatgtatcattcaaagaagaatataaaatatattggtgattttacaaataagtgtgggttttgtacatgtggggagctagaagatcaagaaggattaaagatacacaaagtcagcagaaagtgcatatacaaatatcaacttacttggtccaaaataatcatgataatattagtgtgtctactgattgcccaaaataccatcttaatagttgcagcatcaaatgattgttgggcaaagaaatctttagagatggaatgcatagggcccttgcagcaagtggaatcatgtgatgacaaagcaagcagatcctacagcggagaggcaaaaaagctagtaagagcatccaaaatatcagatttagatgcagcacaagcaggcttactaggttctacaatagaatcagcaatagcaagtataaggaaacaaagaacatatccaaccatgcatctccttgaatcagtatttttggcaaaacattgtgattattataaatcctttgagcataatagtggttattcccaagcaaaatggcggttaacggctaaaacacatcattttgacatttgttcaagacacagcacccaccatttctgtaggtgcatttctgatggaactaaatgccagaatggagactgggattttgcaggtgagatgaattcaacatatcaatcaaaaaaagatttttttgagcatgattttaaactattctgcaccctcttggagaatgcttttccaggtacaacagaatcattctattatcaattgctgcaaaagaaaaatacaactggtgttgtaaaactattggatgaattaacaaagaaatttggaaacaataatatgtttgtagggatatggaaatttggacagtatttaatgtcactcccatacatcaatgaaacatcactaactcctttacaactttcaaaaatattggaagcttcagaccagcatcatcgttctatatctggaaggcaagaatcattagctagtgccgcctctgggggtaaatctaaagagtgcgatcatgcaaaaaaagtctcttgcataagtcctaggtttagtgtcccaatggaagggctaatagcatgtggaagctcaccaaattataaaatttataggatgccaacaaagctttataaatcaaataataaaggagaagtgtggtgttcaggtgatgttcattgtttccaagaattgaaccctgcttcacaggagtctgtagatagaataaagcaaatgatatgttttttgactgagcctgaggtaaatgaagatgtcttttcaattgccatatctatgtgcaaggttcaagataaaggagtgtgcacaataaatgaagagagatggaatgtaataaaatgcgacagtggtttaatatattacactgaccagagggatggacaagacacaggtaatgactttggagaatattgcctatcacacaattgtagaattgaaaggtttccaataaaccctacaataataaatgattgcctatgggaatatcattcacgaaaatctaagtacattactagtttagacttagaaagtcttgaagaattcaaaagggctatttctgagaaattatcacataccctcatagtatataattttaaaccaacagctaacctccctcatatcaagccagtgtataaatatattacagtacaaggggttgagaattctgatggagtagattcagcatacataactgccagcatgccggctctaagtgggacaagtatagggtataatataatgtctagagataacttcccattatttgatataatcatatttataaaaagtgctgttatcaaggcaacttataatcacatatatgatacaggccccactatagggataaatgtaatgcatgacgagcactgcacaggtcagtgtccaacagatataccacataaagagaattggatcacattttctcaggaaaggactagccgttggggatgtgaagaattcggatgccttgctgtaaatacaggttgtgtctttggttcttgccaagatataataagaccagaaacaaaggtatatagaaaagcagtcgaagaaagtgttttattaacagtctgcataacttatcccggtaagacattttgtacagaaataaatgctatagaacctaagattacagatgaattagaactgcaatttaaaacagttgacacaaaaacattacccaatatattagctgttcaaaaccacaaattatacagtgggcaaataaatgatttaggatcgttttcacaaggctgtggtaatatacagaaaaccaattcatctataatagggacaggcactgccaaatttgattacgtatgtcatggtgcttctagaaaagatattattgtaagaagatgttacaacaataactatgaatcatgcagattattaaaagaagaacaatctttaatgtttgcagacaatcatgaaaccattgacgtagctaatgtcaggcacctccttggggatctacaatttaagttgatgttaggagatttaagatacaagtcatttgcagaagacccaggcttagagatagaagcaaaatgtgttgggtgtccatcatgttttaccagctactcctgcaattttagaattgtttcaaatattgatactgtgtgttcaattgaagggccttgcacaacctttcacaacaggctaatgatcacttccacgaaacaagattatggcatcaagatgagctgtaagggaaaaccaggatcaacagaagaatttcagatctgcaagaaaacttacacagtgttgtttacaacaattgaaaagaatgacaaaattgagataaacacaggagaccaaacatctttcgttcaagagagggatgatagatgcaaaacatggttatgtagggttagagatgaagggattagtgttatttttgaaccaataagagccttttttgggagctattttagtatagccttctatatcgtggttggaatcattgtcctgttccttgtgatctacattttcttgcctatggcatttaaacttagggatgtattaaaaaggaatgaatatctatatctacaggagataaagcacaagtag

SEQ ID NO: 4136 - RNA, 4305 nt, synthetic construct
  misc_feature 1..4305: note = derived and/or modified CDS sequence (wt) from BATV(EIV-12845Ms)__KT313690.1__GP
  source 1..4305: mol_type = other RNA
atgttgctattcctcatcttactaattccctgttatgcatcagcctcccctgtagtaacaagatgcttccatggagggcaattaatagcagagaataggtccccaacagctgtgtcagagttctgcttaaaagatgatgtctctactattaaatcagaaataatatatgtcaagaatgatactggattgtttgcgcacaacaaagttttaaggaattggatcataaaagactggaagaactgcaatcctgtgcctacagctgggggtagcattaatgtcatagaagttaatacagacctgagcttgagcacaaaaacatacgtgtgtagtagagattgcacaattacagttgataaagaagatgctcagataatcttccaaactgagaaattaaatcattttgaagtttctggaaccacattaagttcaggctggttcaaaactaaagcatcagtaacactggatagaacatgtgagcatatcaaggtcacatgtgggaaaaagactctgcaatttcatgcatgttttaagcaccatatgtcatgcattagatttttccatagtaccattcttcccggaacaatggcaacttcaatctgtcaaaatatagagcttataattataataagtttgacactgcttatttttatcttgatggcaatattgactaaaacctacatatgttatttgctaatgcccttattcatgcctattgcatatctttatggttggtcatataatagaagctgtaaaaaatgttcatgctgtggcctagcatatcatccattcacaaattgtggctcacattgtgtctgtggtttaaagtttgaagcatcagacagaatgagaatacacagagaatcagggttatgccagggctacaaaagcttaagagtagcaagactattgtgcaaatcaaaaggttcatctcttataatttcaatattgttatctatgttaatcctgagctttgttacgccgatagaagggactttaactaattacccagagtcaaggaaatacgatctagaagaaattgctgacgtcttggaggggtttattacagaaaagggaataaaagaatatgtagttttttatacttctatttttgggggtttgtttttattactggcattgattattataattgcattgaacagagttacagaatacctcacaaatattaatgtcttttattgtcacgaatgctcaatgtatcattcaaagaagaatataaaatatattggtgattttacaaataagtgtgggttttgtacatgtggggagctagaagatcaagaaggattaaagatacacaaagtcagcagaaagtgcatatacaaatatcaacttacttggtccaaaataatcatgataatattagtgtgtctactgattgcccaaaataccatcttaatagttgcagcatcaaatgattgttgggcaaagaaatctttagagatggaatgcatagggcccttgcagcaagtggaatcatgtgatgacaaagcaagcagatcttacagcggagaggcaaaaaagctagtaagagcatctaaaatatcagatttagatgcagcacaagtaggcttactaggttctacaatagaatcagcaatagcaagtataaggaaacaaagaacatatccaaccatgcatctccttgaatcagtatttttggcaaaacattgtgattactataaatcctttgagcataacagtggttattcccaagcaaaatggcggttaacagctaaaacacatcattttgacatttgttcaagacacagcacccaccatttctgtaggtgcatttctgatggaactaaatgccagaatggggattgggattttgcaggtgagatgaattcaacatatcaatcaaaaaaagatttttttgagcatgattttaaactattctgcaccctcctggagaatgctttcccaggcacaacagaatcattttattatcaaatgctgcaaaagaaaaatacaactggcgttgtaaaactattggatgaattaacaaagaaatttggaaacaataatatgtttgtagggatatggaaatttggacaatatttaatgtcactcccatacatcaatgaaacatcattaactcctttacaactttcaaaaatattggaagcttcagaccagcatcatcgctctatatctggaaggcaagaatcattagctaatgccgcctctgggagtaaatctaaagaatgcgatcatgcaaaaaaagtctcttgcataagtcctaggtttggtgtcccaatggaagggctaatagcatgtggaagctcaccaaattataaaatttataagatgccaacaaagctttacaaatcaaataataaaggcgaagtgtggtgttcaggtgatgttcattgcttccaagaattgaaccctgcttcacaggagtctgtggatagaataaagcaaatgacatgttttttgactgagcctgagacaaatgaagatgtcttttcaattgccatatctatgtgcaaagttcaagataaaggagtgtgcacaataaatgaagagagatggaatgtaataaaatgcgacagtggcttaatatattacactgaccagagggatggacaagatacaggtaacgactttggagaatattgcctatcacacaattgtaggattgaaaggtttccaataaaccctacaataataaatgattgcctatgggaatatcattcacgaaaatctaagtacattactagtttagacttagaaagtcttgaagaattcaaaagggctatttctgagaaattatcacataccctcatagtatataattttaaaccaacagctaacctccctcatatcaagccagtgtataaatatattacagtacaaggggttgagaattctgatggagtagattcagcatacataactgctagcatgccggctctaagtggaacaagtataggatataatataatgtctaaagataactttccattatttgatataatcatattcataaaaagcgctgttatcaaggcaacttataatcacatatatgatacaggccccactatagggataaatgtaatgcatgatgagcactgcacaggtcagtgcccaacagatataccacataaagagaattggatcacattttcccaggaaaggactagccgttggggatgtgaagaattcggatgcctcgctgtgaatacaggttgtgtctttggttcttgccaagatataataagaccagaaacaaaagtatatagaaaagcaatcgaagaaagtgttttattaacagtctgcataacttatcctggcaagacattttgtacagaaataaatgctatagaacctaaaattacagatgaattagaactgcaatttaaaacagttgacacaaaaacattacccaatatattagctgttcaaaattacaaattatatagtgggcaaataaatgatttaggatcgttttcacaaggttgtggtaacatacagaaaaccaattcatctataataggaacaggcactgccaaatttgattacgtatgtcatggtgcctctagaaaagatattattgtaagaaggtgttacaacaataactatgaatcatgcagattattaaaagaagaacaatccttaatgtttgcagacaaccatgaaactattgacgtagctaatgtcaggcacctccttggggatctacaatttaagttgatgttaggagatttaagatacaagtcatttgcagaagacccagacttagagatagaagcaaaatgtgttgggtgtccatcatgttttactagctattcctgcaattttagaattgtttcaaacattgatactgtgtgttcaattgaagggccttgcacaacctttcacaacaggctaatgatcacttccacaaaacaggattatggcatcaagatgagctgtaagggaaagccaggatcaacagaagaatttcagatctgcaagaaaacttacacagtgttgtttacaacagttgaaaagaatgacaaaattgagataaacacaggagaccaaacatctttcattcaagagagggatgatagatgcaaaacatggttatgtagggtcagagatgaagggattagtgttatttttgaaccaataagggccttttttgggagctattttagtatagccttctatatcgtggttggaatcattgtcctgttccttgtgatctatatttttttgcctatggcatttaaacttagggatgtattaaaaaggaatgaatatctatatctacaggagataaagcacaagtag

SEQ ID NO: 4137 - RNA, 4305 nt, synthetic construct
  misc_feature 1..4305: note = derived and/or modified CDS sequence (wt) from BATV(EIV-2077Astr)__KT313702.1__GP
  source 1..4305: mol_type = other RNA
atgttgctattcctcatcttactaatcccctgttatgcatcagcctcccctgtagtaacaagatgcttccatggagggcaattaatagcagaaagtaggtccccaacagctgtgtcagaattctgcttaaaagatgatgtctctactattaaatcagagataatatatgttaagaatgatactggattgtttgcacacaacaaagttttaaggaactggatcataaaagactggaaaaactgcaatcctgtgcctacagctgggggtagcattaatgtcatagaagttaatacagacctgagcttgagcacaaaaacatacgtgtgtagtagagattgcacaattacagttgataaagaagatgctcagataatcttccaaactgagaaattaaatcattttgaagtttctggaaccacattaagttcaggctggttcaaaactaaagcatcagtaacactggatagaacatgtgagcatatcaaggtcacatgtgggaaaaagactctgcaatttcatgcatgttttaagcaccatatgtcatgcattagatttttccatggtaccattctccccggaacaatggcaacttcgatctgtcaaaatatagagcttataattataataagtttgacactgcttatttttatcttgatggcaatattgactaaaacctacatatgttatttgctaatgcccttattcatgcctattgcatatctttatggttggtcatataatagaagctgtaaaaaatgttcatgctgtggcctagcatatcatccattcacaaattgtggctcacattgtgtctgtggtttaaagtttgaagcatcagacagaatgagaatacacagagaatcaggattatgccagggctacaaaagcttaagagtagcaagactattgtgcaaatcaaaaggttcatctcttataatttcaatattgttatctatgttaatcctgagctttgttacgccaatagaagggactttaactaattacccagagtcaaggaaatacgatctagaggaaattgctgacgtcttggagggatttgttacagaaaagggaataaaagaatatgtagttttttatacttctatttttgggggtttgtttttattactggcattgattattataattgcattgaacagagttacagaatacctcacaaatattaatgtcttttattgtcacgaatgctcaatgtatcattcaaaaaagaatataaaatatattggtgattttacaaataagtgtgggttttgcacatgtggggagctagaagatcaagaaggattaaagatacacaaagtcagcagaaagtgcatatacaaatatcaacttacttggtccaaaataatcatgataatattagtgtgtctactgattgcccaaaataccatcttaatagttgcagcatcaaatgattgttgggcaaagaaatctttagagatggaatgcatagggcctttgcagcaaatggaatcatgtgatgacaaagcaagcagatcttatagtggagaggcaaaaaagctagtaagggcatctaaaatatcagatttagatgcagcacaagtaggcttactaggttctacaatagaatcagcaatagcaagtataagaaaacaaagaacatatccaaccatgcatctccttgaatcagtatttttggcaaaacattgtgattactataaatcctttgagcataatagtggttattcccaagcaaaatggcggttaacagctaaaacacatcattttgacatttgttcaagacacagcacccaccatttctgtagatgcatttctgatggaactaaatgccagaatggggactgggattttgcaggtgagatgaattcaacatatcaatcaaaaaaagatttctttgagcatgattttaaactattctgcaccctcctggagaatgctttcccaggcacaacagaatcattttattatcaaatgctgcaaaagaaaaatacaactggtgttgtaaaactattggatgaattaacaaagaaatttggaaacaataatatgttcgtagggatatggaaatttggacaatatttaatgtcactcccatacatcaatgaaacatcattaactcctttacaactttcaaaaatattggaggcttcagaccagcatcatcgctctatatctggaaggcaagaatcattagctaatgccgcctctgggggtaaatctaaagaatgtgatcatgcaaaaaaagtctcttgcataagtcctaggtttggtgtcccaatggaagggctaatagcatgtggaggctcaccaaattataaaatttataagatgccaacaaagctttacaaatcaaataataaaggagaagtgtggtgttcaggtgatgttcattgtttccaagaattgaaccctgctttacaggagtctgtagatagaataaagcaaatgacatgttttttgactgaacctgagacaaatgaagatgtcttttcaattgccatatctatgtgcaaggttcaagataaaggagtgtgcacaataaatgaagagagatggaatgtaataaaatgcgacagtggcttaatatattacactgaccagagggatggacaagacacaggtaacgactttggagaatattgcctatcacacaattgtagaattgaaaggtttccaataaaccctacaataataaatgattgcctatgggaatatcattcacgaaaatctaagtacattactagtttagacttagaaagtcttgaagaattcaaaagggcaatttctgagaaattatcacataccctcatagtatataattttaaaccaacggctaacctccctcatatcaagccagtgtataaatatattacagtacaaggggttgagaattctgatggagtagattcagcatacataactgctagcatgccggctctaagtggaacaagtataggatataatataatgtctaaagataacttcccattatttgatataatcatattcataaaaagcgctgttatcaaggcaacttataatcacatatatgatacaggccccactatagggataaatgtaatgcatgatgagcactgcacaggtcagtgcccaacagatataccacataaagagaattggatcacattttctcaggaaaggactagccgttggggatgtgaagaattcggatgccttgctgtgaatacaggttgtgtctttggttcttgccaggatataataagaccagaaacaaaagtatatagaaaagcaatcgaagaaagtgttttattaacagtctgcataacttatcccggtaagacattttgtacagaaataaatgctatagaacctaaaattacagatgaattagaactgcaatttaaaacagttgacacaaaaacattacccaatatattagctgttcaaaaccacaaattatatagtgggcaaataaatgatttaggatcgttttcacaaggctgtggtaatatacagaaaaccaattcatctataataggaacaggcactgccaaatttgattacgtatgtcatggtgcttctagaaaagatattattgtaagaaggtgttacaacaataactatgaatcatgcagattattaaaagaagaacaatccttaatgtttgcagacaaccatgagactattgacgtagctaatgtcaggcacctccttggggatctacaatttaagttaatgttaggagatttaagatacaagtcatttgcagaagacccagacttagagatagaagcaaaatgtgttgggtgtccatcatgttttactagctactcctgcaattttagaattgtttcaaatattgatactgtgtgttcaattgaagggccttgcacaacctttcacaacaggctaatgatcacttccacaaaacaggattatggcatcaagatgagctgtaagggaaaaccaggatcaacagaagaatttcagatctgcaagaaaacttacacagtgttgtttacaacagttgaaaagaacgacaaaattgagataaacacaggagaccaaacatctttcattcaagagagggatgatagatgcaaaacatggttatgtagggtcagagatgaagggattagtgttgtttttgaaccaataagggcctttttcgggagctattttagtatagccttctatatcgtggttggaatcattgtcctgttccttgtgatctacattttcttgcctatggcatttaagcttagggatgtattaaaaaggaatgaatatctatatctacaggagataaagcacaagtag

SEQ ID NO: 4138 - RNA, 4305 nt, synthetic construct
  misc_feature 1..4305: note = derived and/or modified CDS sequence (wt) from BATV(Italy-2009)__KC168047.1__GP
  source 1..4305: mol_type = other RNA
atgttgctattcctcatcttactaattccctgttatgcatcagcctcccctgtagtaacaagatgcttccatggagggcaattaatagcagagagtaggtccccaacagctgtgtcagagttctgcttaaaagatgatgtctctactattaaatcagagataatatatgtcaagaatgatactggattgtttgcgcacaacaaagtcttaaggaattggatcataaaagactggaagaactgcaatcctgtgcctacagctgggggtagcattaatgtcatagaagtcaatacagacctgagcttgagcacaaaaacatacgtgtgtagtagagattgcacaattacagttgataaagaagatgctcagataatattccaaactgagaaattaaatcattttgaagtttctggaaccacattaagttcaggctggttcaaaactaaagcatcagtaacactggatagaacatgtgagcatatcaaggtcacatgtgggaaaaagactctgcaatttcatgcatgttttaagcaccatatgtcatgcattagatttttccatagtaccattcttcccggaacaatggcaacttcaatctgtcaaaatatagagcttataattataataagtttgacactgcttatttttatcttgatggcaatattgactaaaacctacatatgttatttgctaatgcccttattcatgcctattgcatatctttatggttggtcatataatagaagctgtaaaaaatgttcatgctgtggcctagcatatcatccattcacaaattgtggctcacattgtgtctgtggtttaaagtttgaagcatcagacagaatgagaatacacagagaatcagggttatgccagggctataaaagcttaagagtagcaagactgttgtgcaaatcaaaaggttcatctcttataatttcaatattgttatctatgttaatcctgagctttgttacgccgatagaagggactttaactaattacccagagtcaaggaaatacgatctagaagaaattgctgacgtcttggaggggtttattacagaaaagggaataaaagaatatgtagttttttacacttctatttttgggggtttatttttattactggcattgataattataattgcattgaacagagttacagaatacctcacaaatattaatgtcttttattgtcacgaatgctcaatgtatcattcaaagaagaatataaaatatattggtgattttacaaataagtgtgggttttgtacatgtggggagctagaagatcaagaaggattaaagatacacaaagtcagcaggaagtgcatatacaaatatcaacttacttggtccaaaataatcatgataatattagtgtgtctactgattgcccaaaataccatcttaatagttgcagcatcaaatgattgttgggcaaaaaaatctttagagatggaatgcatagggcccttgcagcgagtggaatcatgtgatgacaaagcaagcagatcttacagcggagaggcaaaaaagctagtaagagcatctaaaatatcagatttagatgcagcacaagtaggcttactaggttctacaatagaatcagcaatagcaagtataaggaaacaaagaacatatccaaccatgcatctccttgaatcagtatttttggcaaaacattgtgattactataaatcctttgagcataatagtggttattcccaagcaaaatggcggttaacagctaaaacacatcattttgacatttgttcaagacacagcacccaccatttctgtaggtgcatctctgatggaactaaatgccagaatggggattgggattttgcaggtgagatgaattcaacatatcaatcaaaaaaagatttttttgagcatgattttaaactattctgcaccctcctggagaatgctttcccaggcacaacagaatcattttattatcaaatgctgcaaaagaaaaatacaactggcgttgtaaaactattggatgagttaacaaagaagtttggaaacaataatatgtttgtagggatatggaaatttggacaatatttaatgtcactcccgtacatcaatgaaacatcattaactcctttacaactttcaaaaatattggaagcttcaaaccagcatcatcgctctatatctggaaggcaagaatcattagctaatgccgcctctgggggtaaatctaaagaatgcgataatgcaaagaaagtctcttgcataagtcctaggtttggtgttccaatggaagggctaatagcatgtggaagctcaccaaattataaaatttataagatgccaacaaagctttacaaatcaaataataaaggcgaagtgtggtgttcaggtgatgttcattgtttccaagaattgaaccctgcttcacaggagtctgtggatagaataaagcaaatgacatgttttttgactgagcctgagacaaatgaagatgttttttcaattgccatatctatgtgcaaggttcgagataaaggagtgtgcacaataaatgaagagagatggaatgtaataaaatgcgacagtggcttaatatattacactgaccagagggatggacaagacacaggtaacgattttggagaatattgcctatcacacaattgtaggattgaaaggtttccaataaaccctgcaataataaatgattgcctatgggaatatcattcacggagatctaagtacattactagtttagacttagaaagtcttgaagaattcaaaagggctatttctgagaaattatcacataccctcatagtatataattttaaaccaacggctaacctccctcatatcaagccagtgtataaatatattacagtacaaggggttgagaattctgatggagtggattcagcatacataactgctagcatgccggctctaagtggaacaagtataggatataatataatgtctaaagataacttcccattatttgatataatcatattcataaaaagcgctgttatcaaggcaacttataatcacatatatgatacaggccccactatagggataaatgtaatgcatgatgagcactgcacaggtcagtgcccaacagatataccacataaagagaattggatcacattttcccaggaaaggactagtcgttggggatgtgaagaattcggatgccttgctgtgaatacaggttgtgtctttggttcttgccaagatataataagaccagaaacaaaagtatatagaaaagcaatcgaagaaaatgtcttattaacagtttgcataacttatcccggtaagacattttgtacagaaataaatgctatagaacctaaaattacagatgaattagaactgcaatttaaaacagttgacacaaaaacattacccaatatattagctgttcaaaaccacaaattgtatagtgggcaaataaatgatttaggatcgttttcacaaggttgtggtaacatacagaaaaccaattcatctataataggaacaggcactgccaaatttgattatgtatgtcatggtgcctctagaaaagatattattgtaagaagatgttacaacaataactatgaatcatgcagattattaaaagaagaacaatccttaatgtttgcagacaaccatgaaactattgacgtagctaatgtcaggcacctccttggggatctacaatttaagttgatgttaggagatttaagatacaagtcatttgcagaagacccagacttagagatagaagcaaaatgtgttgggtgtccatcatgttttactagctactcctgcaattttagaattgtttcaaatattgatactgtgtgttcaattgaagggccttgcacaacctttcacaacaggctaatgatcacttccacaaaacaggattatggcatcaagatgagctgtaagggaaagccaggatcaacagaagaatttcagatctgcaagaaaacttacacagtgttgtttacaacagttgaaaagaatgacaaaattgagataaacacaggagaccaaacatctttcattcaagagagggatgatagatgcaaaacatggttatgtagggtcagagatgaagggattagtgttatttttgaaccaataagggcctttttcgggagctattttagtatagctttctatatcgtggttggaatcattgtcctgttccttatgatctacattttcttgcctatggcatttaaacttagggatgtattgaaaaggaatgaatatctatatctacaggaaataaagcacaagtag

SEQ ID NO: 4139 - RNA, 4305 nt, synthetic construct
  misc_feature 1..4305: note = derived and/or modified CDS sequence (wt) from BATV(MM2222)__AB257763.1__GP
  source 1..4305: mol_type = other RNA
atgttgctacttcttgtcttattaatctcttgctgtgtatcagcctctcctgtaataacgagatgttttcatggagggcaactgatagcagaaaggaagtcccaaacagctatatcagaattttgcctcaaggatgatgtctctactattaagtcagaaataatatatgaaaaaaatgacactggtttatttgcacataataaagttttacgaaattggatcataaaagactggaaaaattgcaatcctgttcccacagcagggggcagtataaatgttatagaagtcaatacagatttgagcttgaccacaaaaacatatgtgtgtagcagagattgcacaatcacagttgataaagaagatgcccaaatagttttccaaactgaaaaattgaatcattttgaggtttctggaaccacattgagctcaggttggttcaaaaccaaggcatcagtaacattagatagaacctgcgaacacattaaagtgacatgtgggaagaagaccttacaattccatgcctgtttcaaacaccacatgtcgtgtattagatttttccatggtactatccttcctggaacaatggctacttctatctgccagaatatagaactcataattataataagtctaacattaattatttttatcttaatggtgatactgaccaaaacctacatatgttatctattaatgccactatttatgccaatcgcatacttttatggttggtcatacaacaaaagttgcaaaaaatgcccgtgttgtggcctagcatatcaccctttcacaaattgtggatcacattgtgtgtgcgggttgaaatttgaggcatcagataggatgaggatacatagagaatcaggattatgtcaaggctacaaaagcttacgtgtagctaggttgctgtgtaaatcaaaaggttcatccctcataatctcaatattattatctatgttgatactgagctttgttacaccaatagaggggacattaactaattatccagaatcaagaaaatacaacctagaggagattgctgatgtcttagaaggattcgttgtggaaaaaggaataaaggaatatgtagtcttttatacttctattttcggagctttatttttattaatggcactaattgtcataatagcactaaatagagttacagaatatctcacaaacatcaatgttttgtactgtcatgaatgttcaatgtatcactcaaagaagaatataaaatatattggagatttcacaaacaaatgtggcttttgtacatgtggagagctagaagatcaagaaggcttaaaaatacataaagtaagcagaaagtgcatatataaatatcagctcacctggtccaaaataattatgatgatattagtgtgtctactgattgctcaaaacaccatcctaatagttgcagcatcagacgattgctggacaaaaaagtctttggagatggaatgtataggccctttacagcaagtggatacatgtgaagacaaaacaagcaggtcttacagtggagaggcaaaaaaactagtgagggcatcaaaaatatcagatttagatgcagcacaggtagggctgttaggatccacgatagaatcagcaatagcaagcataagaaggcaaagaacatattcaactatgcatcttcttgaatcagtattcctggggaagcattgtgattactataaagtttttgagcataacagtggctactctcaggcgaaatggaggttaacagctaaaacacatcattttgatatttgctcaagacatagcacccatcatttctgcagatgcatctcagatggaactaaatgtcaaaatggggattgggattttgcaggtgaaatgaactcaatataccaatcaaagagagacttttttaagcatgacttcaaactgttctgtactcttatagaagatgctttcccaggcacaactgagtcactcttttatgaaatgctatcaaagaaaaacacaactggtattacaaaactattagataaattaacaaaaaaatttgggaacaacaatatgttcgtaggaatttggaaatttgggcaatatctaatgtcactgccatatgtcaatgaaacatcattatcccctactcaacttgctaaagtattagaggttacagatcatcatcaccggtctatatctggaaggcaagagtcgctggctagtgctacctctgggagtaagtccagtgagtgtgaccatgcaaagaaggtttcttgcataagtcctaggtttggtgttccaatggaaggattaatagcatgtggaaactcaccaaattacaagatttataagacaccagcaaagctttacaaatcaaacaacaagggagaagtgtggtgttcaggtgatgttcattgtttccaagaactaatccctgcctcacaagaatctgttgacaggataaaacaaatgacttgctttttaactgaacctgaagtaaatgatgacgttttctccattgcaatatctatgtgcaaagtccaagacaagggagtatgtacaataaatgaagataggtggaacgtaataaaatgtgatagtggcctgatatattatactgaccagagagaagggcaagacacaggcaatgattttggggaatattgtttatcccacagctgtagaatagaaaggttcccaataaatccgacaataatcagtgattgtttatgggaatatcattcacgaaaatcaaaatatattaccagtttagatctagaaagcttagaagagtttaaaagagctatttctgagaaattgtcacatactcttatagtgtataattttaaaccgacagccaatcttcctcatataaagccagtatacaagtatatcacagttcaaggggttgaaaattctgatggggtagattcagcatatataactgctagtatgccagctttaagtggaacaagcataggttataatataatgtctagggataacttcccactatttgatataattatattcataaaaagtgccattattaaggcgacttataatcacatatatgacacaggtcctactatagggattaatgtaatgcatgatgaacattgtacaggacaatgtccgacagacataccacataaagaaaattggatcacatttgcccaagagagaactagtcgttggggatgtgaagaatttgggtgccttgctgtcaacactggctgtgtttttggctcttgtcaagacataataaggccagaaacaaaggtttataggaaagcagttgaggagagtgtcttattgacagtttgtataacttatcctggtaaaacattttgcacagaaataaatgccatagagcctaaaattacagatgaattagaattgcagtttaaaacagttgatacaaaaacactgcccaacatcttggctgtccaaaaccataaattatacagtggacagatcaatgacttaggatcattctcacaaggctgtggtaacatacagaaaaccaattcatccatcataggcacaggcactgcaaagtttgattatgtgtgtcatggtgcctctagaaaagatataattgtgaggagatgctacaataataattatgaatcatgtaaattattgaaggaggaacaatccttaatgtttgcagataatcatgaaacaatcgatgtagccaatgtcagacaccttcttggggatctgcaatttaaattaatgttaggagatctgaggtacaaatcatttgcggaaaatccagatttggaaatagaagcaaagtgtgttgggtgcccatcatgttttactagttattcctgcagttttaagattgtttcaaatattgacactgtgtgctcaattgaagggccttgtacaacttttcacaacagattgatgatcacctccacaaaacaagattatggcattaaaatgagctgcaagacaaagccagggccaatagaggagttccagatttgcaagaaaacttacacaatactgtttacaacagttgaaaagaatgataaaatcgaaataagcacaggggaccaaacatctttcatccaagaaaaagatgatagatgcaaaacatggttatgtagagttagagatgaagggatcagtgttattttcgaaccaataagagctttctttggaagctactttagtatagctttttatatagtaattggtatcattgtcctgttcctagtaatttacatttttttacctatgatgtttaaacttagagatgtattaaaaagaaatgaatacctgtacctacaggaaataaaacataagtaa

SEQ ID NO: 4140 - RNA, 4305 nt, synthetic construct
  misc_feature 1..4305: note = derived and/or modified CDS sequence (wt) from BATV(MM2222)__AY772534.1__GP
  source 1..4305: mol_type = other RNA
atgttgctacttcttgtcttattaatctcttgctgtgtatcagcctctcctgtaataacgagatgttttcatggagggcaactgatagcagaaaggaagtcccaaacagctatatcagaattttgcctcaaggatgatgtctctactattaagtcagaaataatatatgaaaaaaatgacactggtttatttgcacataataaagttttacgaaattggatcataaaagactggaaaaattgcaatcctgttcccacagcagggggcagtataaatgttatagaagtcaatacagatttgagcttgaccacaaaaacatatgtgtgtagcagagattgcacaatcacagttgataaagaagatgcccaaatagttttccaaactgaaaaattgaatcattttgaggtttctggaaccacattgagctcaggttggttcaaaaccaaggcatcagtaacattagatagaacctgcgaacacattaaagtgacatgtgggaagaagaccttacaattccatgcctgtttcaaacaccacatgtcgtgtattagatttttccatggtactatccttcctggaacaatggctacttctatctgccagaatatagaactcataattataataagtctaacattaattatttttatcttaatggtgatactgaccaaaacctacatatgttatctattaatgccactatttatgccaatcgcatacttttatggttggtcatacaacaaaagttgcaaaaaatgcccgtgttgtggcctagcatatcaccctttcacaaattgtggatcacattgtgtgtgcgggttgaaatttgaggcatcagataggatgaggatacatagagaatcaggattatgtcaaggctacaaaagcttacgtgtagctaggttgctgtgtaaatcaaaaggttcatccctcataatctcaatattattatctatgttgatactgagctttgttacaccaatagaggggacattaactaattatccagaatcaagaaaatacaacctagaggagattgctgatgtcttagaaggattcgttgtggaaaaaggaataaaggaatatgtagtcttttatacttctattttcggagctttatttttattaatggcactaattgtcataatagcactaaatagagttacagaatatctcacaaacatcaatgttttgtactgtcatgaatgttcaatgtatcactcaaagaagaatataaaatatattggagatttcacaaacaaatgtggcttttgtacatgtggagagctagaagatcaagaaggcttaaaaatacataaagtaagcagaaagtgcatatataaatatcagctcacctggtccaaaataattatgatgatattagtgtgtctactgattgctcaaaacaccatcctaatagttgcagcatcagacgattgctggacaaaaaagtctttggagatggaatgtataggccctttacagcaagtggatacatgtgaagacaaaacaagcaggtcttacagtggagaggcaaaaaaactagtgagggcatcaaaaatatcagatttagatgcagcacaggtagggctgttaggatccacgatagaatcagcaatagcaagcataagaaggcaaagaacatattcaactatgcatcttcttgaatcagtattcctggggaagcattgtgattactataaagtttttgagcataacagtggctactctcaggcgaaatggaggttaacagctaaaacacatcattttgatatttgctcaagacatagcacccatcatttctgcagatgcatctcagatggaactaaatgtcaaaatggggattgggattttgcaggtgaaatgaactcaatataccaatcaaagagagacttttttaagcatgacttcaaactgttctgtactcttatagaagatgctttcccaggcacaactgagtcactcttttatgaaatgctatcaaagaaaaacacaactggtattacaaaactattagataaattaacaaaaaaatttgggaacaacaatatgttcgtaggaatttggaaatttgggcaatatctaatgtcactgccatatgtcaatgaaacatcattatcccctactcaacttgctaaagtattagaggttacagatcatcatcaccggtctatatctggaaggcaagagtcgctggctagtgctacctctgggagtaagtccagtgagtgtgaccatgcaaagaaggtttcttgcataagtcctaggtttggtgttccaatggaaggattaatagcatgtggaaactcaccaaattacaagatttataagacaccagcaaagctttacaaatcaaacaacaagggagaagtgtggtgttcaggtgatgttcattgtttccaagaactaatccctgcctcacaagaatctgttgacaggataaaacaaatgacttgctttttaactgaacctgaagtaaatgatgacgttttctccattgcaatatctatgtgcaaagtccaagacaagggagtatgtacaataagtgaagataggtggaacgtaataaaatgtgatagtggcctgatatattatactgaccagagagaagggcaagacacaggcaatgattttggggaatattgtttatcccacagctgtagaatagaaaggttcccaataaatccgacaataatcagtgattgtttatgggaatatcattcacgaaaatcaaaatatattaccagtttagatctagaaagcttagaagagtttaaaagagctatttctgagaaattgtcacatactcttatagtgtataattttaaaccgacagccaatcttcctcatataaagccagtatacaagtatatcacagttcaaggggttgaaaattctgatggggtagattcagcatatataactgctagtatgccagctttaagtggaacaagcataggttataatataatgtctagggataacttcccactatttgatataattatattcataaaaagtgccattattaaggcgacttataatcacatatatgacacaggtcctactatagggattaatgtaatgcatgatgaacattgtacaggacaatgtccgacagacataccacataaagaaaattggatcacatttgcccaagagagaactagtcgttggggatgtgaagaatttgggtgccttgctgtcaacactggctgtgtttttggctcttgtcaagacataataaggccagaaacaaaggtttataggaaagcagttgaggagagtgtcttattgacagtttgtataacttatcctggtaaaacattttgcacagaaataaatgccatagagcctaaaattacagatgaattagaattgcagtttaaaacagttgatacaaaaacactgcccaacatcttggctgtccaaaaccataaattatacagtggacagatcaatgacttaggatcattctcacaaggctgtggtaacatacagaaaaccaattcatccatcataggcacaggcactgcaaagtttgattatgtgtgtcatggtgcctctagaaaagatataattgtgaggagatgctacaataataattatgaatcatgtaaattattgaaggaggaacaatccttaatgtttgcagataatcatgaaacaatcgatgtagccaatgtcagacaccttcttggggatctgcaatttaaattaatgttaggagatctgaggtacaaatcatttgcggaaaatccagatttggaaatagaagcaaagtgtgttgggtgcccatcatgttttactagttattcctgcagttttaagattgtttcaaatattgacactgtgtgctcaattgaagggccttgtacaacttttcacaacagattgatgatcacctccacaaaacaagattatggcattaaaatgagctgcaagacaaagccagggccaatagaggagttccagatttgcaagaaaacttacacaatactgtttacaacagttgaaaagaatgataaaatcgaaataagcacaggggaccaaacatctttcatccaagaaaaagatgatagatgcaaaacatggttatgtagagttagagatgaagggatcagtgttattttcgaaccaataagagctttctttggaagctactttagtatagctttttatatagtaattggtatcattgtcctgttcctagtaatttacatttttttacctatgatgtttaaacttagagatgtattaaaaagaaatgaatacctgtacctacaggaaataaaacataagtaa

SEQ ID NO: 4141 - RNA, 4305 nt, synthetic construct
  misc_feature 1..4305: note = derived and/or modified CDS sequence (wt) from BATV(MM2222)__JX846596.1__GP
  source 1..4305: mol_type = other RNA
atgttgctacttcttgtcttattaatctcttgctgtgtatcagcctctcctgtaataacgagatgttttcatggagggcaactgatagcagaaaggaagtcccaaacagctatatcagaattttgcctcaaggatgatgtctctactattaagtcagaaataatatatgaaaaaaatgacactggtttatttgcacataataaagttttacgaaattggatcataaaagactggaaaaattgcaatcctgttcccacagcagggggcagtataaatgttatagaagtcaatacagatttgagcttgaccacaaaaacatatgtgtgtagcagagattgcacaatcacagttgataaagaagatgcccaaatagttttccaaactgaaaaattgaatcattttgaggtttctggaaccacattgagctcaggttggttcaaaaccaaggcatcagtaacattagatagaacctgcgaacacattaaagtgacatgtgggaagaagaccttacaattccatgcctgtttcaaacaccacatgtcgtgtattagatttttccatggtactatccttcctggaacaatggctacttctatctgccagaatatagaactcataattataataagtctaacattaattatttttatcttaatggtgatactgaccaaaacctacatatgttatctattaatgccactatttatgccaatcgcatacttttatggttggtcatacaacaaaagttgcaaaaaatgcccgtgttgtggcctagcatatcaccctttcacaaattgtggatcacattgtgtgtgcgggttgaaatttgaggcatcagataggatgaggatacatagagaatcaggattatgtcaaggctacaaaagcttacgtgtagctaggttgctgtgtaaatcaaaaggttcatccctcataatctcaatattattatctatgttgatactgagctttgttacaccaatagaggggacattaactaattatccagaatcaagaaaatacaacctagaggagattgctgatgtcttagaaggattcgttgtggaaaaaggaataaaggaatatgtagtcttttatacttctattttcggagctttatttttattaatggcactaattgtcataatagcactaaatagagttacagaatatctcacaaacatcaatgttttgtactgtcatgaatgttcaatgtatcactcaaagaagaatataaaatatattggagatttcacaaacaaatgtggcttttgtacatgtggagagctagaagatcaagaaggcttaaaaatacataaagtaagcagaaagtgcatatataaatatcagctcacctggtccaaaataattatgatgatattagtgtgtctactgattgctcaaaacaccatcctaatagttgcagcatcagacgattgctggacaaaaaagtctttggagatggaatgtataggccctttacagcaagtggatacatgtgaagacaaaacaagcaggtcttacagtggagaggcaaaaaaactagtgagggcatcaaaaatatcagatttagatgcagcacaggtagggctgttaggatccacgatagaatcagcaatagcaagcataagaaggcaaagaacatattcaactatgcatcttcttgaatcagtattcctggggaagcattgtgattactataaagtttttgagcataacagtggctactctcaggcgaaatggaggttaacagctaaaacacatcattttgatatttgctcaagacatagcacccatcatttctgcagatgcatctcagatggaactaaatgtcaaaatggggattgggattttgcaggtgaaatgaactcaatataccaatcaaagagagacttttttaagcatgacttcaaactgttctgtactcttatagaagatgctttcccaggcacaactgagtcactcttttatgaaatgctatcaaagaaaaacacaactggtattacagaactattagataaattaacaaaaaaatttgggaacaacaatatgttcgtaggaatttggaaatttgggcaatatctaatgtcactgccatatgtcaatgaaacatcattatcccctactcaacttgctaaagtattagaggttacagatcatcatcaccggtctatatctggaaggcaagagtcgctggctagtgctacctctgggagtaagtccagtgagtgtgaccatgcaaagaaggtttcttgcataagtcctaggtttggtgttccaatggaaggattaatagcatgtggaaactcaccaaattacaagatttataagacaccagcaaagctttacaaatcaaacaacaagggagaagtgtggtgttcaggtgatgttcattgtttccaagaactaatccctgcctcacaagaatctgttgacaggataaaacaaatgacttgctttttaactgaacctgaagtaaatgatgacgttttctccattgcaatatctatgtgcaaagtccaagacaagggagtatgtacaataaatgaagataggtggaacgtaataaaatgtgatagtggcctgatatattatactgaccagagagaagggcaagacacaggcaatgattttggggaatattgtttatcccacagctgtagaatagaaaggttcccaataaatccgacaataatcagtgattgtttatgggaatatcattcacgaaaatcaaaatatattaccagtttagatctagaaagcttagaagagtttaaaagagctatttctgagaaattgtcacatactcttatagtgtataattttaaaccgacagccaatcttcctcatataaagccagtatacaagtatatcacagttcaaggggttgaaaattctgatggggtagattcagcatatataactgctagtatgccagctttaagtggaacaagcataggttataatataatgtctagggataacttcccactatttgatataattatattcataaaaagtgccattattaaggcgacttataatcacatatatgacacaggtcctactatagggattaatgtaatgcatgatgaacattgtacaggacaatgtccgacagacataccacataaagaaaattggatcacatttgcccaagagagaactagtcgttggggatgtgaagaatttgggtgccttgctgtcaacactggctgtgtttttggctcttgtcaagacataataaggccagaaacaaaggtttataggaaagcagttgaggagagtgtcttattgacagtttgtataacttatcctggtaaaacattttgcacagaaataaatgccatagagcctaaaattacagatgaattagaattgcagtttaaaacagttgatacaaaaacactgcccaacatcttggctgtccaaaaccataaattatacagtggacagatcaatgacttaggatcattctcacaaggctgtggtaacatacagaaaaccaattcatccatcataggcacaggcactgcaaagtttgattatgtgtgtcatggtgcctctagaaaagatataattgtgaggagatgctacaataataattatgaatcatgtaaattattgaaggaggaacaatccttaatgtttgcagataatcatgaaacaatcgatgtagccaatgtcagacaccttcttggggatctgcaatttaaattaatgttaggagatctgaggtacaaatcatttgcggaaaatccagatttggaaatagaagcaaagtgtgttgggtgcccatcatgttttactagttattcctgcagttttaagattgtttcaaatattgacactgtgtgctcaattgaagggccttgtacaacttttcacaacagattgatgatcacctccacaaaacaagattatggcattaaaatgagctgcaagacaaagccagggccaatagaggagttccagatttgcaagaaaacttacacaatactgtttacaacagttgaaaagaatgataaaatcgaaataagcacaggggaccaaacatctttcatccaagaaaaagatgatagatgcaaaacatggttatgtagagttagagatgaagggatcagtgttattttcgaaccaataagagctttctttggaagctactttagtatagctttttatatagtaattggtatcattgtcctgttcctagtaatttacatttttttacctatgatgtttaaacttagagatgtattaaaaagaaatgaatacctgtacctacaggaaataaaacataagtaa

SEQ ID NO: 4142 - RNA, 4305 nt, synthetic construct
  misc_feature 1..4305: note = derived and/or modified CDS sequence (wt) from BATV(MS50)__JX846605.1__GP
  source 1..4305: mol_type = other RNA
atgaagatgctgactctgattattattgtttcatgctgggttgcaactttgcaaaacccactcatctcaagatgtttccacggtggtcaactaatagcagaaaagaaatcattgacatcgatatctgaattctgcatcaaagatgatgtatctatgttaaaatcagaagtgatataccaaaaaaatgatactggaatctatggtcatagcaaagttttcagacattggactattgcagattggaaatactgtaacccagtccctacagcaggaggcagcattaatgtaattgagttggataaaaacttgaatctgatagcaaaaaactatgtatgcactagagattgcactattaccgtagacaaagaaaatgcacagattgtgttccagactgacaaacttaatcattttgaagtgactggtacaacaataagtacggggtggttcaaaaccaaagcatcagtagcactagatagaacttgtgaacatatcaaagtcagttgcggaaagaaaacactgcaattccatgcttgcttcaaacaacacatgtcatgtgttagatttttacacagaagtatgctaccagggtctatggcaaactctatttgccagaatatagagttaattataattataacattgacattagttatatttatacttatgttgatagcaactagattttatatatgttatcttctaataccagtgtttatgcctattgcttatgcttatggctgggcttacaatcgtagttgtaagaaatgtagttgttgtggcttagcataccacccgtttacaaactgtggatcttattgtgtatgtggagctaggtttgaaacatctgacaggatgaggctacatagggaatcagggctatgtcaaggctttaaaagtcttaggatggcacgaagattatgtaaatcaaaagggtcttcccttgttatatctattttgctagcgacattaatcttatcttttgtaacaccaatagaaggtacaatgacaaattaccctaccaatgagaaatactctctagatgaaattgcagatgttctaaaatggaaagaacaagaaagtgaatataaatattatgccatactatatgcttctataattggtgcgtgttttacagtattatttgcaggcactgctttagccctcaacatagtgttagagttattgacaaaaataaatgttatatattgtgaagaatgtagtatgtaccacagcaagtcaaatataaagtatattggtgattttacaaacaaatgtgggttttgcacatgtggattactagaagatccagatggtgttgtggtccataaggtgaagagatcatgcacataccagtacaaactcacttgggttaaaacaataatgatagtgttatctattttattcttgctacaaaatattatagttatagttgctgcagatagtgattgttggactaatgaagaactcaaaccagaatgtgtagggcctctaattgcaccagcagattgtaccgaaaaagataagaagacatacctaacagaagcagctgcattggtaaaaactaaaaagatatcacaggtagatgcagataatgttgaaattctaggaaagacgatagagtcagcaataaaggctatagaaaagcaaaaaacctaccacaggatgcacctcttggaagcagtttttttaaataaacattgcgattattataaattgtttgagcataatagtggttactcacaagtaaagtggagaatgttagcaaaaacccaacactttgatatatgtgcttttgcaaaagaaagcaaattctgcaaatgtatggctggtggtgcttgcgctgaagactcttgggactttgatacaaccatgaattcaacatatacatcgaaaggagacaattttaaacatgacatgtctctatttttaaaaatatttgaggcagcatttccaggtacatcgtatgtctacatgcttaataaaatcaaggaaaagaaaccttaccaatcagtaactatgatagacaaaatcaaaactaaatatcctaataataaaatgctggtagcttacctagagtttggaaaatgtttgatgggtgtaggacatgcatcaacctttgaacttcaacagagtcaactagaaagattataccaaccagcagagctgagtagatcggttggtcaacttacttcattatcaaatgcacaagtgggcacaatcacaaaagaatgctctaagtataaagatataagttgcttaagtccaaggtttggaatacctatggaaaatatggttgcctgtggggatagtccaaattataaaatatataaaaaacccattaaggtttacaaagcacatgatagagtagaaacatggtgtattaaagaccagcattgtttggtagactacacgccagcagaggcagatgtggtaaaaaaactcaaaacaatgaagtgttggttaaatgatccgggtactgaaactgatgcctacaccactgctattaaaagttgcaggatcatggacaaaggtgtttgtacagttaatgggcaaaaatggtcaataataaaatgtgactctgatttactttattatacagatcatatagagggagaggatactggaaatgacattggccactattgtatatctgttggttgcaaaacagatagatacccaattaatccagatatagttactgattgtacttgggagtttaaatcaagaaaatcatcttacataggtaaaatatcaatgcaatcattagaagattataaaaaagcactcacagacaaattaacacacacacttgaaacatacagctttgcaccaactgcagacttgccccatataaaacccatttataaatatattacagcacaaggtgtcgaaaactctgatggaatagagggtgcttatataacagcaaccatccctgcactggggggaactagcataggatatagtgttcaatcaaaggatggtttccctctattagacctgattatatatataaaagctgcagttattagaagcacatatatacacttatatgatactgggccaactattagcataaataccaaacatgatgagaaatgcactggccaatgcccagcagaaatagaacatgaagctaattggttgactttctcacaagagagaactagcagatggggttgtgaagaatttgggtgtttagcaatcaatactggctgtgtctttggatcatgccaagacgtgataaggccagaaactaaagtatacagaaagtcagtagaagaagaagttgttctaactgtctgtataaattatcctggcaacacattctgtacagagataaatgcaatagaaccgaaaataactgaagaggtagagctccagtttaagactgtagacacaaaaacactaccaactttactagcagtgacaaatcataaattatttagtggccaaatcaatgatttaggaacatttggtcagatgtgtggtaatgtacagaaaactaactctagcatcttaggctccggcacacctaagtttgattacacatgccatggtgctagtagaaaagacataattgttagaaaatgttacaataataattatgattcttgtaaactgctgaaggaagagaagcagcttgtatttaatgacgaccatgagactataactgttgtaaataaccgacatttggttggggaattagcaataaaattaatcttaggagacatacagtacaagctttttacagaaaaattagaccttcagatagatgcaaaatgtgttgggtgcccagattgctttgagagttatgcctgcaatttccagattgtttctaatatagataccgtctgtgctattaatgggccatgtgacatattccacaatagaatttctattcgatcaacgcagcaaaattatggtgttaaaatgtcttgtaaaagaacaccagatcaaaatgagaaatttgtgatctgtggaagggagtacagtgtctttttccatactgttcaaaagaatgataaaattgaaataaacactggcgatcagacctcttatataaaggagatggatactagatgtaaaacctggttatgcagagtaagggatgaaggccttagtgttatatttgagcctattaaagccttctttggtagttacttcagtattgctttttatatagtactattcataattatagccttcttggtaatctatatatttatgccaatgttcatgaagctaagggatatattaaagcagaatgaaaagctttatcttcaagaaatcaaacagaaataa

SEQ ID NO: 4143 - RNA, 4305 nt, synthetic construct
  misc_feature 1..4305: note = derived and/or modified CDS sequence (wt) from BATV(NM/12)__KJ187039.1__GP
  source 1..4305: mol_type = other RNA
atgttgctacttcttgtcttattaatcccttgctgtgtatcagcctctcctgcaataacaagatgttttcatggagggcaactgatagcagaaaggaagtcccaaacagctatatcagaattttgccttaaggatgatgtctctactattaagtcagaaataatatatgaaaaaaatgacactggtttatttgcgcataataaggttttacgaaattggatcataaaggactggaaaaattgcaatcctgttcccacagcagggggcagtataaatgttatagaagtcaatacagatttgagcttgactacaaaaacatatgtgtgtagcagagattgcacaatcacagttgataaagaagatgctcaaataattttccgaactgaaaaattgaatcattttgaggtttctgggaccacattgagctcaggttggttcaaaaccaaagcatcagtaacattagatagaacctgcgaacacattaaagtgacatgtgggaagaagaccctacagttccatgcctgttttaagcaccacatgtcgtgtattagattttttcatggcactatccttcctggaacaatggctacttctatctgtcagaatatagaactcataattataataagtctgacattgattatttttatcttaatggtgatattgaccagaacctacatatgttatctattaatgccactatttatgccaatcgcatacttttatggttggtcatataacaaaagttgcaaaaaatgtcaatgttgtggcctagcatatcatccttttacaaattgtggatcacattgtgtgtgcggattgaaatttgaggcatcagataggatgaggatacatagagaatcaggattgtgtcaaggctacaaaagcttacgtgtagctaggttgctgtgtaaatcaaaaggttcatccctcataatctcaatattattatctatgttgatactgagctttgttacaccaatagaggggacattaactaattacccagaatcaagaaaatacgatctggaggaaattgctgatgtcttagaaggattcgttgtggaaaaaggaataaaagaatatgtagtcttttatacttctattttcggagctttattcttattaatggcattgattattataatagcactaaacagagttacagaatatctcacaaacatcaatgttttctactgccatgaatgttcaatgtatcactcaaagaagaatataaagtatattggagatttcacaaacaaatgtggcttttgtacatgtggggaactagaagatcaagagggcttaaaaatacataaagtaagcaggaagtgcatatataaatatcagctcacctggtccaaaataattatgatgatattagtgtgtttactaattgctcaaaacactatcctaatagttgcagcatcagacgactgttggacaaaaaggtctttagagatgggatgtataggccctctacagcaagtggatacatgcgacgacaaaacaagcaggtcttacagtggggaagcaaaaaaactagtgagggcatcaaaaatatcggatttggatgcagcacaggtggggctgttaggatccacaatagaatcagcaatagcaagcataagaaagcaaagaacgtattcaactatgcatcttcttgaatcagtattcctggggaagcattgtgattactataaggtttttgagcataacagtggctactctcaggcaaaatggaggttgacagctaaaacacatcattttgatatttgctcaagacatagcacccatcatttctgtagatgcatctcagatggaactaaatgtcaaaatggagattgggattttgcaagtgaaatgaactcaacataccaatcaaagagagacttttttgaacatgactttaaacagttctgcactcttatagaaaatgctttcccaggcacaactgagtcactcttttatgaaatgctatcaaagaaaaacacaactggtatcacaaaactattagataaattaacaaaaaaattcgggaacaacaatatgttcgtaggaatatggaaatttgggcaatatctaatgtcattgccatacgtcaatgaaacatcattatctcctactcaacttgctaaagtattagaggttacagatcatcatcaccggtctatatctggaaggcaagagtcgctggctagtgcagcccctgggagtaagtccagtgagtgtgaccatgcaaggagggtttcttgcataagtcctaggtttggtgttccaattgaaggattaactgcttgtgggagctcaccaaattacaaaatttataagacaccagcaaagctttacaaatcaaacaacaagggcgaagtgtggtgttcaggtgatgtccactgtcttcaagagctgatccctgccccacaggaatctgttgacaggataaaacaaatgacttgctttttgactgaacctggagtgaatgatgatattttttctattgcaatatctatgtgcaaggtccaagacaaaggggtatgtacaataaatgaagataggtggaacgtagtaaaatgtgataggggcctgatatattatactgaccagagagaagggcaagacacaggcaatgattttggaaagtattgtttatctcacagctgtagaatagaaaggttcccaataaatccggcaataattaatgattgtttatgggaatatcattcacgaaaatcaaagtatattaccagcttagacctagaaagcttagaagaatttaaaagagctatttctgagaaattgtcacatactcttatagtacataattttaagccgacagccaatcttcctcatataaagccggtatacaagtatatcacagtgcaaggggttgaaaattctgatggggtagattcagcatatataactgctagtatgccagctttaagtggaacaagcataggttataacataatgtctagggataactttccactatttgatataattatattcataaaaagtgccattattaaggcaacttataatcacatatatgacacaggtcctactatagggatcaatgtgattcatgatgaacattgtacaggacaatgcccaacagacataccacataaagaaaattggattacatttgcccaagagagaactagtcgttggggatgtgaagaatttgggtgtcttgctatcaacactggctgtgtttttggctcttgtcaagatataataaggccagaaacaaaggtttatagaaaagcagttgaggagagtgtcttattaacagtttgtataacttatcctggtaaaacattttgcacagaaataaatgccatagagcctaaaattacagacgaattagaattgcagttcaaaacagttgatacaaaaacactgcccaacatcttagctgtccaaaaccataaattatatagtggacagattaatgacttaggatcattctcacaaggctgtggtaatatacagaagaccaattcatccatcataggcacaggcactgcaaagtttgattatgtgtgtcatggcgcctctagaaaagatatcattgtaaggagatgctacaataataattatgagtcatgtaaattattgaaggaggaacaatccttaatgtttgcggataatcatgaaacaatcgatgtagccaatgttagacatctccttggagatctgcagtttaaattaatgttgggagatctaaggtacaaatcatttgctgaaaacccagatttggaaatagaagcaaaatgtgttgggtgcccatcatgctttactagttattcctgcagttttaagattgtttcaaatattgatactgtgtgctcaattgaagggccttgcacaatttttcatagcagattgatgatcacctctacaaaacaagattatggcattaaaatgagctgtaagacaaagccagggccaacagaggagttccagatttgcaagaaaacttacacaatactatttacaacaattgaaaagaatgataaaatcgaaataagcacaggggatcaaacatcttttatccaagaaagagatgatagatgcagaacatggttatgtagggttagggatgaagggatcggtgttattttcgaaccaataagagctttctttggaagctactttagtatagctttttatatagtaattggtatcattatcctgtttctagtaatctacattttcttgcctatggtgtttaaacttagagatgtattgaaaagaaatgagtacctgtacctacaggaaataaaacataagtaa

SEQ ID NO: 4144 - RNA, 4305 nt, synthetic construct
  misc_feature 1..4305: note = derived and/or modified CDS sequence (wt) from BATV(ON-1/E/94)__AB257764.1__GP
  source 1..4305: mol_type = other RNA
atgttgctatttcttgtattattaatctcttgctatgtgtcagcctctcctgtaataacaagatgttttcatggagggcaactgatagcagaaaggaagtcacaaacagctatatcagaattttgccttaaagatgatgtctctactattaagtcagaaataatatatgaaaaaaatgacactggtttatttgcgcatagtaaagttttacgaaattggattataaaggactggaaaaattgcaatcctgttcccacagcagggggcagtataaatgttatagaggtcaatgcagatttgagcttggccacaaaaacatatgtgtgtagcagagattgcacaatcacagttgataaagaagatgctcaaatagtattccaaactgaaaaattgaatcattttgaggtttctggaaccacattgagctcaggttggtttaaaaccaaggcatcagtaacgttagatagaacctgcgaacacatcaaagtaacatgtgggaagaagaccctacaatttcatgcctgtttcaaacaccacatgtcgtgcattagatttttccatggcactatccttcctggaacaatggctacttctatctgtcagaatatagagctcataattataataagtctaacattaattatttttatcttaatggtaatactaaccaaaacctacatatgttatctattgatgccactatttatgccaatcgcatacttttatggttggtcatacaacaaaagctgcaaaaaatgctcatgctgtggcttagcatatcatccttttacaaattgtggatcacattgtgtgtgcgggttgaaatttgaggcatcagatagaatgcggatacatagagaatcagggttatgtcaaggctataaaagcttacgtgtagctaggttgctgtgtaaatcaaagggttcatctctcataatctcaatattattatctatgttgatactgagctttgttacaccaatagaggggacattaactaattacccagaatcaaggaaatacgacctggaggaaattgctgacgtcttagaaggatttgttgtggaaaaaggaattaaagaatatgtagtcttttatacttctattttcggagctttatttttattaatggcacttattgtcataatagcactaaacagagttacagaatatctcacaaacatcaatgttttgtactgtcatgaatgttcgatgtatcattcaaagaagaatataaagtacattggagatttcacaaataaatgtggcttttgtacatgtggagagctagaagaccaggaaggcttaaaaatacataaagtaagcagaaagtgcatatataaatatcagctcacctggtccaaaataatcatgataatattagtgtgtctactgattgcccaaaacaccatcttaatagttgcagcatcagacgattgctggacaaagaaatctctggagatggaatgtgtaggccctttacagcaagtggacacatgtgaagacaaaacaagcaggtcttatagtggagaagcaaaaaaactagtgagggcatcaaaaatatcagatttggatgcagcacaggtggggctgttaggatccacaatagaatcagcaatagcaagcataagaaagcaaagaacatattcaactatgcatcttcttgaatcagtcttcttggggaaacattgtgattactataaagtttttgagcacaacagtggctattctcaagcaaagtggaggttaacagctaaaacacatcattttgatatttgctcaagacatagcacccaccatttttgtagatgcatttcagatggaactaagtgtcaaaatggagattgggattttgcaggtgaaatgaactcaacataccaatcaaagagagacttttttgagcatgactttaaactgttctgtacccttatagaaaatgcttttccaggcacaacagagtcactgttttatgaaatgctatcaaagaaaaacacaactggtattacaaaattattagataaattaacaaagaaatttggaaataacaatatgttcgtaggaatatggaaatttgggcaatatctaatgtcattgccatatgtcaatgaaacatcattatcccctactcaacttgctaaagtactagaggttacagatcatcttcaccgatccatatctggaaggcaagagttactgactagtgctacccctgggagtaagtccagtgagtgtgaccatgcaaagaaggtttcttgcataagccctaggtttggtgtaccaatggaaggattaatagcatgtggaaactcaccaagttacaaaatttataagacaccaacaaagctttacaaatcaaacaacaagggagaagtgtggtgttcaggtgatgtccactgtttccaagaactaatccctgcctcacaagaatctgttgacaggataaaacaaatgacttgctttttaactgaacctgaagtaagtgatgacgttttttccattgcaatatctatgtgcaaagtccaggacaagggagtatgcacaataaatgaagataggtggaatgtaataaaatgtgatagtggcctgatatattatactgaccagagagaagggcaagatacaggcaatgatttaggggagtattgtttgtctcacagttgtagaatagaaaggttcccaataaacccaataataattagtgattgtttatgggaatatcattcacgaaaatcaaagtatattaccagtttagacctagaaagcttggaagaatttaaaagggctatctctgaaaaattgtcacatactcttatagtctataattttaaaccaacagccaatcttcctcatataaagccagtatacaagtatatcacagttcaaggggttgaaaattctgatggggtagattcagcatatataactgctagcatgccagctttaagtgggacaagcataggttataatataatgtccagagacaactttccactatttgatataattatattcataaaaagtgccattattaaggcgacatataatcacatatatgacacaggtcctactatagggattaatgtaatgcacgatgaacattgtacaggacaatgccctacagacataccgcataaggaaaattggatcacattcgcccaagagaggactagtcgttggggatgtgaagaattcgggtgtcttgctgttaatactggctgcgtttttggctcttgtcaagatataataaggccagaaacaaaggtttataggaaagcagttgaagagagtgtattattgacagtttgtataacttaccctggtaaaacattttgcacagaaataaatgccatagagcctaaaattacagacgaattagaattgcagtttaaaacagtggatacaaaaacactacccaacattttagctgtccaaaaccataaattatatagtggacaaattaatgacttaggatcattctcacaaggttgtggtaacatacagaaaaccaattcatccatcataggcacaggcactgcaaagtttgattatgtgtgtcatggtgcttctagaaaagatatcgttgtgaggagatgctataataacaactatgagtcatgcaaattattgaaggaggagcaatccttaatgtttgcagataatcatgaaacaattgatgtagccaatgtcagacatcttcttggggacctacagttcaaattaatgctgggagatctaaggtacaaatcatttgcagaaaatccagatttggaaatagaagcaaagtgtgttgggtgcccatcatgtttcactagctattcttgcagttttaagattgtttcaaatattgatactgtatgctcaattgaagggccttgtacaactttccataacagattgatgatcacctccacaaaacaagattatggcattaagatgagctgcaagacaaagccagggcctacagaggaattccagatttgcaagaaaacttacacaatactgtttacaacagttgaaaagaatgataaaattgaaataagcacaggggaccaaacatcttttatccaagaaaaagatgatagatgcaaaacatggttatgtagggttagggatgaggggatcagtgttattttcgaaccaataagagctttctttggaagctactttagtatagctttttatatagtaattggtatcattgtcctgtttctagtaatctacatttttttgcctatgatttttaaacttagggatgtattaaaaagaaatgaatacttgtacctacaagagataaaacataagtaa

SEQ ID NO: 4145 - RNA, 4305 nt, synthetic construct
  misc_feature 1..4305: note = derived and/or modified CDS sequence (wt) from BATV(ON-7/B/01)__AB257765.1__GP
  source 1..4305: mol_type = other RNA
atgttgctacttcttgtcttattaatcccctgctgtgtatcagcctctcctgtaataacaagatgttttcatggagggcagctgatagcagaaaggaagtcccaagcggctatatcagaattttgcctcaaggatgatgtctctactatcaaatcagaaataatatatgaaaaaaatgacactggtttatttgcacataataaagtcttacgaaattggattataaaggactggaaaaactgcaatcctgtccccacagcagggggcagtataaatgttatagaagtcaatacagatttgagcttgaccacaaaaacatatgtgtgtagcagggattgcacaattacagttgataaagaagatgctcaaataattttccaaactgaaaaactgaatcattttgaagtttctgggactacattgagctcaggttggttcaaaaccaaagcatcagtaacattggataggacctgcgaacacattaaagtaacatgtgggaaaaagaccctacaattccatgcctgtttcaagcaccacatgtcatgtattagattttttcatggcactatccttcctgggacaatggccacctctatctgtcagaatatagaactcataattataataagtctgacattgattatttttatcttaatggtaatactgaccaaaacttacatatgttatctattaatgccactatttatgccaatcgcatacttctatggttggtcatataacaaaagttgtaaaaaatgtccatgttgtggcttagcatatcacccttttacaaattgtggatcacattgtgtgtgcggattgaaatttgaggcatcagataggatgaggatacatagagaatcaggattgtgtcaaggctacaaaagcttacgtgttgctaggttgctatgtaaatcaaaaggttcatccctcataatctcaatattattatctatgttgatactaagctttgttacaccaatagaggggacattaactaattatccagaatcaaggaaatacgacctagaggaaattgctgatgtcttagaaggattcattgtggaaaaaggaataaaagaatatgtggtcttttatacttctattttcggagctttatttttattaatagcactgattgtcataatagcactaaacagagttacagaatatctcacaaacatcaatgttttatactgtcatgaatgttcaatgtatcattcaaagaagaatataaaatatattggagatttcacaaataaatgtggcttttgtacatgtggagagctcgaagatcaagagggcttaaaaatacataaagtgagtaggaagtgcatatataaatatcagcttacctggtccaaagtaattatgatgatattagtgtgtttactgattgctcaaaacactattctgatagttgcagcatcggatgattgctggactaaaaagtctttagagatgggatgtataggccctttacagcaagtggacacatgtgatgacaaagcaagcaggtcatacagtggggaggcaaaaaaactagtgagggcatcaaaaatatcagatttggatgcagcacaggtggggcagttgggatccacaatagaatcagcaatagcaagcataagaaggcagagaacatattcaactatgcatcttcttgaatcagttttcctggggaagcattgtgattactataaggtttttgagcataacagtggctactctcaggcaaaatggaggttaacagctaaaacacatcattttgacatttgttcaagacacagcacccatcacttctgtagatgcatctcagatggaaccaaatgtcaaaatggagattgggactttgcaggtgaaatgaactcaacataccagtcaaagagagacttttttgagcatgacttcaacctgttctgcactcttatagaaaatgccttcccaggcacaacagagtctctcttctatgaaatgctatcaaagaaaaacacaactggtatcacaaaactattagataaattaacaaaaaaatttgggaacaacaatatgttcgtaggaatatggaagtttgggcaatatctaatatcactaccatatgtcaatgaaacatcattgtctcctactcaacttgcaaaagtattagtggttacagatcaacatcacaggtccatttctggaaggcaagagtcgctggctagtgctactcctgggagtaagtccagtgaatgtggccatgcaaaaaaggtttcttgcataagccccaggtttggtgttccaatggaaggattaatggcatgtgggagctcaccaaattataaaatttataagacaccagcaaagctttacaaatcaaataacaagggagaagtgtggtgttcaggtgatgttcactgttttcaagatcttatccctgcctcacaagaatctgttgacaggataaaacaaatgacttgctttttgaccgaacctgaagtaaatgatgacgttttttctattgcaatagctatgtgcaaagtccaagacaaaggagtatgtacaataaatgaagataggtggaacttaataaaatgtgatagtggcctgatatattatactgaccagagggaggggcaagacacaggcaatgattttggggagtattgtttatcccacaactgtaaaatggaaagattcccaataaatccggcaataattagtgattgtctatgggaatatcattcacgaaaatcaaagtatataactagtttagacttagaaagcttagaagagtttaaaagagccatttctgaaaaattgtcgcatactctcgtagtgtataattttaaaccaacagcaaatcttcctcatataaagccagtatacaagtatatcacagtacaaggagttgaaaattctgatggagtagattcagcatatataactgctagtatgccagctttgagtgggacaagcataggctataacataatgtccagggataacttcccactattcgatataattatatttataaaaagtgccattattaaagcaacttacaatcatatatatgacacaggtcctactatagggattaatgtaatgcatgatgaacattgtacaggacaatgcccgacagatataccgcacaaagagaattggatcacgtttgcccaagagagaactagtcgctgggggtgtgaagaatttgggtgtcttgctgtcaacaccggctgtgtttttggctcttgtcaagatataataaggccagaaacaaaggtttatagaaaagcagttgaggagagtgtcttattaacagtttgtataacttaccctggcaaaacattttgcacagaaataaatgccatagagcctaaaattacagacgaattagagttacagtttaaaacagtcgatacaaaaacactgcccaacatcttagctgtccaaaaccacaaattatatagtggacagattaacgatttgggatcattctcccagggctgtggcaacatacagaaaaccaatctatctatcataggaacaggcactgcaaagtttgattatgtgtgccatggtgcctctaggaaagatatcattgtaagaagatgctacaataacaattatgagtcatgtaaattattgaaagaggaacaatccttaatgtttgcagataatcatgaaacaatcgatgtagccaatgtcagacatctccttggggatctgcagtttaaattaatgctgggagatctaaggtacaaatcatttgcagaaaatccggatttagaaatagaagcaaagtgtgttggatgcccatcatgttttactagttactcctgcaatttcaaaattgtttcaaatattgatactgtgtgctcaattgaagggccttgtacaacttttcataacagattaatgatcacttccgctaaacaagattatggcattaaaatgagctgtaagacaaagccaggactgacagaagagttccagatttgtaagaaaacttatacagtactgtttgcaacagtcgaaaagaatgatgaaattgaaataagcacaggagatcaaacatcttttatccaagaaagagatgatagatgcaaaacatggttatgtagggttagagatgaaggcatcagtgttatttttgaaccgataagggctttctttggaagctactttagtatagctttttatatagtaattggcatcattgttctgttcctagtaatttacattttcttgcccatggtgtttaaacttagagatgtgttaaaaagaaatgaatacctgtatctacaagaaataaaacataagtaa

SEQ ID NO: 4146 - RNA, 4305 nt, synthetic construct
  misc_feature 1..4305: note = derived and/or modified CDS sequence (wt) from BATV(UgMP-6830)__DQ436460.1__GP
  source 1..4305: mol_type = other RNA
atgttgctacttcttgtcttattaatcccctgctatgtatcagcctctcctgtagtaacaagatgcttccatggagggcaattgatagcagagaagaaatcccaaacagctgtatcagaattttgcctgaaagatgatgtctctactattaagtcagaaataacatatgagaagaacaacactggcttatttgcacataacaaagttttacgaaactggatcataaaagactggaaaaattgtaaccctgttcccacagcagggggcagcataaatgttatagaagtcaatacggatttgagcttgaccacaaaaacatatgtgtgtagcagagattgcacaattacagttgataaagaagatgctcagataattttccaaactgagaagttgaaccattttgaggtctctgggactacattgagctcaggctggtttaagaccaaggcatcagtaacattagataggacttgtgaacatattaaagtaacatgtgggaaaaagaccttacaattccatgcctgttttaagcaccacatgtcttgtattagattctttcatggcactattcttcctggaacaatggctacttccatctgtcaaaatatagaactcataattataataagtctgacattaattatctttatcctgatggtaatattgaccaaaacctacatatgctatctactgatgccactatttatgccaattgcatacttttatggttggtcatataacaaaagctgtaaaaaatgctcatgttgtggcctagcttatcacccctttacaaattgtggatcacactgtgtatgcgggctaaaatttgaagcatcagataggatgagaatacacagagaatcaggattatgtcaaggctacaaaagtctacgtgtggctaggttgttgtgcaaatcaaaaggttcatctcttataatctcaatattattatctatgttgatactaagctttgttacaccaatagaggggacattaactaattacccagaatcaaggaagtatgatctggaggaaattgctgatgtcctagaaggattcattgtagaaaaagggataaaagaatacgtagtcttttatacttctatttttggggctttattcttactaatggcattagttatcataatagcactaaacaaggttacagagtatcttacaaacatcaatgttttatactgtcatgaatgttcaatgtatcactcaaagaaaaatataaaatatattggggattttacaaataaatgtggcttttgcacatgtggagagttggaagatcaagaaggtttaaaaatacataaagttagcagaaagtgcatatataaatatcaactcacctggtccaaaataatcatgatgatattagtgtgtttactgattgctcaaaacaccatcctaatagtcgcagcatcagatgattgctggacaaaaaaatctttagagatggaatgtataggccctttacagcaagtggatacatgcgatgataaatcaagcaggtcttacagtggggaggcaaaaaagctagtgagagcatctaaaatatcagatttgaatgcagcacaggtggggctattgggatctacgatagaatcagcaatagcaagcataagaaagcagagaacatattcaaccatgcatctccttgaatcagtattcctgggaaagcattgtgattactataaagctttcgaacataacagtggctactctcaggcaaagtggaggttaacagctaaaacacatcattttgatatttgctcaagacatagtactcatcatttctgtagatgcatctcagatgggacaaagtgccaaaatggggattgggattttgcaggtgaaatgaactcaacataccagtcgaaaaaagacttttttgagcatgacctcaagctgttctgcactcttgtagaaaatgcttttccaggcacaacagagtcactcttttatgaaatgttatctaagaaaaacacaactggtgtcaaaaagctattagataaactaacaaaaaaatttggaaataacaatatgttcgtaggaatatggaaatttgggcaatatctaatgtcactgccatatgtcaatgaaacatcattaacccctgctcaacttgctaaaatattggaggttacagatcagcaccatcggtctatatctggaaggcaagagtcattggctagtgctacccctgggagtaagtccaaggagtgtggtcatgcaaaaaaggtctcttgtataagccctaggtttggtgttccgatggaaggattattggcatgtggggactcaccaaattacaaaatttataaaacaccagcaaagctttataaatcaaacaacaagggggaagtgtggtgttcaggtgacgttcattgttcccaggagctaagcccagcatcacaagaatctgttgacaggataaaacaaattacttgctttttgacggaacctgaagtaagtgatgacgttttttcaattgcaatatccacgtgcaaagttcaagataagggagtatgtacagtaaatgaagatagatggaacgtaataaaatgtgatagtgggctgatatattacactgaccagagagatgggcaggatacaggcaatgatttcggagagtattgtttgtcccatagctgcagaatagaaaggtttcccataaacccggcaataatcagtgattgtttatgggagtaccattcccgaaaatccaagtacatcaccagcttggacctggaaagtctagaagaatttaaaagagctatttctgaaaaattgtcacatactcttatagtgtataatttcaaaccaacagctaatcttcctcatataaagccgatatacaaatatatcacagtgcaaggggtggagaattctgatggagtggattcagcatatataactgctagtatgccagctttaagcggaacaagtataggatataatataatgtctagagataactttccattatttgatataatcatatttataaagagcgccattattaaggcaacttacaatcatatatatgacacaggccccactataggaatcaatgtaatgcatgatgaacattgcacagggcaatgcccaacagacataccacacaaagaaaattggattacatttgctcaagagagaactagtcgttggggatgcgaagaatttgggtgccttgctgtaaatacaggctgtgtctttggttcttgtcaggatataataaggccagaaacaaaggtgtatagaaaggcagttgaggagagtgtcttattaacagtatgtataacttaccctggtaaaacattctgcacggaaataaatgctatagaacctaaaatcacagatgaattagaattacagttcaaaacagttgatacaaaaacattacccaatatcttagctgtccaaaaccataagctatatagtggacaaattaatgatttgggatcattttcacaaggttgtgggaacatacagaaaaccaattcatccattataggaacaggtactgcaaagtttgattatgtgtgtcacggtgcttccagaaaagatatcattgtaagaagatgttacaataataactatgagtcatgcaaattgttgaaggaggaacaatctttaatgttcgcagataaccatgaaactattgacgtagctaatgtcagacatctccttggagatctgcagtttaaattgatgttgggagatctgaggtacaagtcatttgcagaaaacccagatttggaaatagaggcaaagtgtgttggatgcccatcatgttttactagttactcctgcagcttcaagattgtttcaaatattgacactgtatgctcaattgaagggccttgtacaacttttcataataggttgatgatcacctctacaaaacaagattatggcatcaaaatgagctgtaagacaaagccagaagaaacagaagagtttcagatttgcaagaaaacttacacagtattgtttacaacagttgagaaaaatgataaaatcgaaataagcacaggggatcaaacatcctttatccaagagagggatgatagatgcaaaacatggttatgcagagttagagatgaagggatcagtgttatttttgagccaataagggctttctttggaagctactttagtatagctttttatgtagtggtcagtattattgtcctatttctagcaatctacatcttcttacctatggtgttcaaactcagagatgtgttaaaaaagaatgaatatctatacttgcaggaaataaagcataagtaa

SEQ ID NO: 4147 - RNA, 4305 nt, synthetic construct
  misc_feature 1..4305: note = derived and/or modified CDS sequence (wt) from BATV(ZJ2014)__KU746870.1__GP
  source 1..4305: mol_type = other RNA
atgttggtacttcttgtcttattaatcccttgctgtgtatcagcctctcctgcaataacaagatgttttcatggagggcaactgatagcagagaggaagtcccaaacagctatatcagaattttgccttaaggatgatgtctctactattaagtcagaaataatatatgaaaaaaatgacactggtttatttgcgcataataaggttttacgaaattggatcataaaggactggaaaaattgcaatcctgttcccacagcagggggcagtataaatgttatagaagtcaatacagatttgagcttgactacaaaaacatatgtgtgtagcagagattgcacaatcacagttgataaagaagatgctcaaataattttccaaactgaaaaattgaatcattttgaggtttctgggaccacattgagctcaggttggttcaaaaccaaagcatcagtaacattagatagaacctgcgaacacattaaagtgacatgtgggaagaagaccctacagttccatgcctgtttcaagcaccacatgtcgtgtattagattttttcatggcactatccttcctggaacaatggctacttctatctgtcagaatatagaactcataattataataagtctgacattgattatttttatcttaatggtgatattgaccagaacctacatatgttatctattaatgccactatttatgccaatcgcatacttttatggttggtcatataacaaaagttgcaaaaaatgtcaatgttgtggcctagcatatcatccttttacaaattgtggatcacattgtgtgtgcggattgaaatttgaggcatcagataggatgaggatacatagagaatcaggattgtgtcaaggctacaaaagcttacgtgtagctaggttgctgtgtaaatcaaagggttcatccctcataatctcaatattattatctatgttgatactgagctttgttacaccaatagaggggacattaactaattacccagaatcaagaaaatacgacctggaggaaattgctgatgtcttagaaggattcgttgtggaaaaaggaataaaagaatatgtagtcttttatacttctattttcggagctttattcttattaatggcattgattgtcataatagcactaaacagagttacagaatatctcacaaacatcaatgttttctactgccatgaatgttcaatgtatcactcaaagaagaatataaagtatattggagatttcacaaacaaatgtggcttttgtacatgtggggaactagaagatcaagagggcttaaaaatacataaagtaagcagaaagtgcatatataaatatcagctcacctggtccaaaataattatgatgatattagtgtgtttactaattgctcaaaacactatcctaatagttgcagcatcagacgactgctggacaaaaaagtctttagagatgggatgtataggccctttacagcaagtggatacatgcgacgacaaaacaagcaggtcttacagtggggaagcaaaaaaactagtgagggcatcaaaaatatcggatttggatgcagcacaggtggggctgttaggatccacaatagaatcagcaatagcaagcataagaaagcaaagaacgtattcaactatgcatcttcttgaatcagtattcctggggaagtattgtgattactataaggtttttgagcataacagtggctactctcaggcaaaatggaggttgacagctaaaacacatcattttgatatttgctcaagacatagcacccatcatttctgtagatgcatctcagatggaactaaatgtcaaaatggagattgggattttgcaagtgaaatgaactcaacataccaatcaaagagggacttttttgaacatgactttaaagtgttctgcactcttatagaaaatgctttcccaggtacaacagagtcactcttttatgaaatgctatcaaagaaaaacacaactggtatcacaaaactattagataaattaacaaaaaaattcgggaacaataatatgttcgtaggaatatggaaatttgggcaatatctaatgtcactgccatacgtcaatgaaacatcattatctcctactcaacttgctaaagtattagaggttacagatcatcatcaccggtctatatctggaaggcaagagtcactggctagtgctgcccctgggagtaagtccagtgagtgtgaccatgcaaagaaggtttcttgcataagtcctaggtttggtgttccaattgaaggattaactgcttgtgggagctcaccaaattacaaaatttataagacaccagcaaagctttacaaatcaaacagcaagggcgaagtgtggtgttcaggtgatgtccactgtcttcaagagctaatccccgcctcacaggaatctgttgacaggataaaacaaatgacttgctttttgactgagcctggagtgaatgatgatattttttctattgcaatatctatgtgcaaagtccaagacaaaggggtatgcacaataaatgaagataggtggaacgtagtaaaatgtgatagtggcctgatatattatactgaccagagagaagggcaagacacaggcaatgatttcggagaatattgtttatctcacagctgtagaataaaaaggttcccaataaatccggcaataattaatgattgtttatgggaatatcattcacgaaaatcaaagtatattaccagcttagacctagaaagcttagaagaatttaaaagagcgatttctgagaaattgtcacatactcttatagtatataattttaagccgacagccaatcttcctcatataaagccggtatacaagtatatcacagtgcaaggggttgaaaattccgatggggtagattcagcatatataactgctagtatgccagctttaagtgggacaagcataggttataacataatgtctagggataacttcccactatttgatataattatattcataaaaagtgccattattaaggcaacttataatcacatatatgacacaggtcctactatagggatcaatgtaattcatgatgaacattgtacaggacaatgcccaacagacataccacataaagaaaattggattacatttgcccaagagagaactagtcgttggggatgtgaagaatttgggtgtcttgctatcaacactggctgtgtttttggctcttgtcaagatataataaggccagaaacaaaggtttatagaaaagcagttgaggagagtgtcttattaacagtttgtataacttatcctggtaaaacattttgcacagaaataaatgccatagagcctaaaattacagacgaattagaattgcagttcaaaacagttgatacaaaaacactgcccaacatcttagctgtccaaaaccataaattatatagtggacagattaatgacttaggatcattctcacaaggctgtggtaatatacagaagaccaattcatccatcataggcacaggcactgcaaagtttgattatgtgtgtcatggcgcctctagaaaagatatcattgtaaggagatgctacaataataattatgagtcatgtaaattattgaaggaggaacaatccttaatgtttgcggataatcatgaaacaatcgatgtagccaatgttagacatcttcttggggatctgcagtttaaattaatgttgggagatctaaggtacaaatcatttgctgaaaacccagatttggaaatcgaagcaaaatgtgttgggtgcccatcatgttttactagttattcctgcagtttcaagattgtttcaaatattgatactgtgtgctcaattgatgggccttgtacaatttttcataacagattgatgatcacctctacaaaacaagattatggcattaaaatgagctgtaagacaaagccagggccgacagaggagttccagatttgcaagaaaacttacacaatactatttacaacaattgaaaagaatgataaaatcgaaataagcacaggggatcaaacatcttttatccaagaaagagatgatagatgcagaacatggttatgtagggttagggatgaagggatcagtgttattttcgaaccaataagagctttctttggaagctactttagtatagctttttatatagtaattggtatcattatcctatttctagtaatctacattttcttgcctatggtgtttaaacttagagatgtattgaaaagaaatgaatacctgtacctacaggaaataaaacataagtaa

SEQ ID NO: 4148 - RNA, 4305 nt, synthetic construct
  misc_feature 1..4305: note = derived and/or modified CDS sequence (wt) from CVV__AF082576.1__GP
  source 1..4305: mol_type = other RNA
atgctattcctgctcatactagcctttttagggttctcaacaagcaaccctattgcaactaggtgtttccatgggggccaattaatagcagagtcaaagtctgctacatctatatcagaattctgcctcaaggatgatgtctcaatgttaaaatctgaagtggtatacataaagaatgatactggattatttggtcataataaagtttttagaagctggacaataaaagattggaaactctgcaaccctatacctactgcaggaggaacaataaatgtaattgaggttaacaaagatcttagtctaatgacaaagacatacatatgtagtagagattgcactataaccatagataaagaggaagctcagattatcttccaaacagataagctaaatcattttgaagtgtctggcactacattaagttcaggatggtttaaaagcaaggcgtctgtcaccctggatagaacctgtgagcatgttaaggttacttgtggaaagaaatctctgcaattccatgcatgttttaaacaccacatgtcatgtgttaggttcttccacaataccatattacctggcaatatgataacctcaatgtgccagaatatagaattaataattatcttagggctaacattagccatattcatattaatggttatgcttacaaaaacttatatatgttatttactgatgccaattttcatgccgatagcttatctttatggttgggcctacaataagagctgcaaaaagtgcaactgttgtggtttagcataccatccatttactaattgtgggtcacattgtgtttgtggcttgaaatttgaggcatcagataggatgagaatccatagagaatctggcttgtgtcaagggtacaagagtttacgaattgccagacttttgtgtaaatctaaagggtcatctttagttatatctggattattgtccatgttaatcttaagcttcgtaacgcctatagaggggactataactagctacccagagagcagaaaatatacactggaagagataacagatgttgttgaaggactggtatctgagcagaatataaaggagtatattgttttctatacctcattgtttggaagtttaatactattattagcatttataatgtctataactttaagcaaaataacaagcatattagcaaaaagaaatgttatttattgcgaagaatgctcaatgtatcattcaaaaagaggcataaagtacaatggtgacttcacaaacaaatgcggcttttgcacatgcaatgaacaagaggatacagaaggattagtaatacataaagttagtaagagatgcacatataaataccagctaaagtgggctaaagtgctgatgattacactagtcttgcttctaatagcgcaaaacactattctaattgttgcagctgaaacagattgctggacaaaaaaaagcctagatatagactgtataggaccaatgctagatataggctcttgcacaaataagaataccagaagctatgatgcagaagcacagaaattggtgagccagtctaaaataagtcaactagatgcagaccaagcatcgttgttaggcaactctatagatagtgctattaaggcaatcagagcccagaaaacttaccctacaatgcacttgttggaaacaatattcttaatgaaaaattgcgattattacacgagtttcaaccataacagtggctattcacaagccaaatggcgattgattgcaaaaacaggacactttgacatatgctccagacatagcacccaccatttctgccaatgtataaatgatggaaccaaatgtcagaatggtgattgggatttcgctggtgaaatgaatgaaacttacaatagcaaaaatgatttttattcacatgatctgaatttgttttacacaatttttgaaaatgcattcccaggaacaactgaatccttattttatcaattgatccaaaagaaaaatactacaggggcctccaaagtcttggggaagttaataactaaatatggtaataataacatgttcgttggaatctggaaatttggacagtacttacttacattaccatatataaataatactgaattgagccagaataggagactaacaatcctggcaacacaagaactattaagtaggtcgcactctggcaggcaggagtctatgtccaatgcaattcagggcagtattacaaaagaatgccataatgcaaaaggtgttgggtgcataagtcctcagtttggtattccaattggtaaccttacagcatgtggtgactcacctaattataaaatatataagactccagaaaaattgtataaatcaaataataaaggggaagtttggtgttcaaatgatgttcactgcctgaatgattttgagcctgcagatgaagaagttgtcaataaaattaagaaactcacttgcttcttaacagacgtctcagttgaagtagacatcttttcagtggctgcatccacatgtaagatggcagacaaaggcgtctgtacagtaaatggtgctaaatggaatataatcaagtgtgatagtggattatactattttacagaccatagagaaggccaggacacaggcaatgactttggtgagtattgtatatctcacagttgcaatactgagcgattccctatcaacccagacacattaaaagattgtacttgggagttccattccagaaagtctaaatatatttcaaccatcagtttagaatcattggaagaattcaggagggcaatggcagaaaagttatcacacaccctaacaatttacaattttaaaccaacagctaaccttcctcatattaggccaacctacaaattcattacagccaatggtgtcgaaaactctgacggtattgaatcagcatacatcttgtctagcatccctgcattaggtggaattagtgttggttataatgttcaaaccaaagacaacttcccattgttggatataattgtatttattaaaagcgcagtcatcaggacaacatacaatcatatttatgataccgggcctactataggtataaacacacaacatgatgagcactgtacagggccgtgcccagctgtggtgccacataaagagaactggatgacattttctcaggaaagaacaagtagatggggatgtgaagaatttggttgcttggccatcaacacagggtgtgtttttggttcttgccaagatataatacatccagaaactaaagtataccgcaaagcagtagaagaggaagttgtcttaacggtgtgcatcaattttccaggcaataattactgcactgaaataaatgccattgagcctaagataacagatgagatagagctccagttcaaaacagtcgatacaaaaaccttacccaaccttcttgcagtgcagaatcacaagctttacagtggccagataaacgatttgggctctttttcacaaggttgtggaaatgtccaaaaaacaaatcactcaatcctaggcatgggtacagtcaaatttgattatgtctgccacggcgctagtaggaaagatgtgatagtcaggaggtgctacaacaataattttgattcatgcaaattactgaaagaagaaacatcattaatatttgcagataatcatgagactctagaggtagcacacacaaagcatctgataggtgaattacagtttaagataatgttaggagatataagatacaaatcatttgctgaatcacctgagttggaaattgatgcaaaatgtgtcgggtgtccatcatgttttgaaagctactcctgcaactttcaaatagtgtcaaatatagacactgtgtgctcagtcgaagggccatgcacactatttcataatcgaattattatatcagctaacaaacagtcatatgggcttaaaatgagttgccaaacaaagcctaaccaaaatgaagagttcattatctgtaacaggaaatacagtgtcttattcacaacaattgataaaaatgacaaaatagaagtgaacacaggggaccagacttcatatatttatgaaaaggacagcagatgtaagacttggttgtgcagggttagagatgaggggatcagtgtcctatttgaaccattgaaagcattctttgggagctattttagcataatattttatgttgttgttggaattattgtccttttcttgattatatacatatttttgccaatgttcttcaaactaaaagatgttttgaaaagaaatgaatatttgtatcttcaggaactgaaacataaatga

SEQ ID NO: 4149 - RNA, 4305 nt, synthetic construct
  misc_feature 1..4305: note = derived and/or modified CDS sequence (wt) from CVV(Montgomery County/VA/2015 4b)__KX583998.1__GP
  source 1..4305: mol_type = other RNA
atgctattcttgctcatactagcctttttagggttctcaacgagcaaccctattgcgactaggtgtttccatgggggccaattaatagcagagtcaaagtctgctacatctatatcagaattctgcctcaaggatgacgtctcaatgttaaaatctgaagtggtatatacaaagaatgatactgggctatttggtcataataaagtttttagaagctggacaataaaagattggaaactctgcaatcctatacctactgcaggaggaacaataaatgtaattgaggtcaataaagatcttagtctaatgacaaagacatacatatgtagtagagattgcaccataactatagataaagaggaagctcagattatcttccaaacagataagttaaatcattttgaagtgtctggtaccacattaaattcaggatggttcaaaagcaaagcatctgttaccctggatagaacctgtgaacatgttaaggttacttgtggaaaaaagtctctgcaattccatgcatgctttaagcaccacatgtcatgtgttaggttcttccacaataccatattacctggcaatatgataaactctatgtgccagaatatagaattaataattatcttagggctaacattagctatatttatattaatggttatgcttacaaagacttatatatgttacttattgatgccaattttcatgccaatagcttatctttatggttgggcatataacaaaagctgcaaaaagtgtaactgctgtggtctagcatatcatccatttactaattgtggctcacactgtgtttgtggcttaaaatttgaggcatcagataggatgaggatccatagagaatctggcttatgtcaagggtacaagagtttacgaattgccaggcttttgtgtaaatctaaagggtcatctctagttatatctggattattatccatgttaatcttaagctttgtaacgcctatagagggaactataactagctacccagaaagcaggaaatatacactggaagagataacagatgttgttgaaggattagtatctgagcagaatataaaggagtacattgttttctacacctcattgtttggaagtttaatattgttactagcatttataatgtccataactttaagcaaaataacaagcatactagcaagaagaaatgttatttattgtgaagaatgctcaatgtatcattcaaaaagaggcataaagtataacggtgactttacaaacaaatgcggcttttgcacatgcaatgaacaggaggatgcagaagggttggtaatacataaagttagtaagagatgcacatataaatatcaactaaagtgggctaaagtgctgatggtcacactggtcttgcttctaatagcacaaaacactattctaattgttgcagctggaacagattgctgggcaaaaaaaagcctagatatggactgtatagggccaatgttagacataggctcttgcacaaataagaataccagaaactatgatacagaagcacagaaattggtgagccaatctaaagtaagtcaactagatgcagaccaggcatcattattgggcaactctatagatagtgctattaaagcaataagagcccagaaaacttatcctacaatgcacttattggaaacaatattcttaatgaagaattgtgattattacacaagttttaaccataatagtggctattcacaagctaaatggcgattaattgcaaaaacagggcactttgatatatgttctaggcatagcacccaccacttttgccgatgtataaatgatgggaccaaatgtcagaatggtgattgggattttgctggtgaaatgaatgaaacttataatagcaaaaatgatttttattcacatgatctgaacttgttttacacaatttttgaaaatgcattcccagggactactgaatccttattttaccagttaatccagaagaaaaatactacaggagcctccaaaatcttgggaaagttaataaccaagtatggtaataataacatgtttgttggagtctggaaatttggacagtacttacttacattgccatatataaataatactgaattgagccagaataggaggcaaacaatcttggcaacacaagaatcattaagtagatcacactctggcaggcaagagtctatgtccagtgcaattcagggcagtgttacaaaagaatgccacaatgcaaaggatgttgggtgcataagccctcggtttggcattccaattggcaacctcacagcatgtggcgactcacctaattataagatatataaaactccagaaaagttgtataaatcaaataataaaggggaagtttggtgttcgaatgatgttcactgcctgaatgattttgagcctgcagatgaagaagttgtcaataaagttaaaaaactcacttgtttcttaacagacgtctcagtcaaaacagacatcttttcagtagctgtatctacatgtaagatggcagataaaggcacttgtacagtgaaggatgctaaatggaatataatcaagtgtgatagtggattatactattttacagaccatagagaaggtcaagacacaggcaatgattttggtgagtattgtatatctcacagttgcaacactgagcgattccctattaacccagacatattaaaagattgcacttgggagttccattccaggaagtctaaatatatttcaaccattagtttagaatcattggaagaattcaggagagcaatgacagagaagttatcacacaccctaacaatttacaattttaaaccaacagctaacctccctcatattaggccaacttataaattcatcacagcaaatggtgtcgaaaactctgatggtattgaatcggcatatatcttatctagtatccctgcattaggtgggattagtgttggttataatgttcaaaccaaagacaatttcccattattggatataattgtatttattaaaagtgcagtcatcaggacaacatacaaccatatttatgatactgggcctactataggcataaacacacaacatgatgagcactgcacaggaccatgcccggctgtggtgccacataaagaaaactggataacattctctcaggaaagaacaagcagatgggggtgtgaagagtttggttgcttggccatcaacacagggtgtgtttttggttcttgccaagatataatacatccagaaaccaaagtataccgtaaagcagtagaagaagaagttgtcttaacagtgtgcattaatttcccaggtaataattactgcacagagataaatgccgttgagcccaagataacagatgagatagagctccagttcaaaacagttgatacaaaaaccttgcccaaccttcttgcagtgcaaaatcgcaaactttacagtggccagataaacgatttgggctctttttcacaaggttgtggaaatgtccaaaaaacaaatcactcaatcctaggcatgggtacagccaaatttgattatgtctgtcatggtgctagtagaaaagatgtgatagtcaggaggtgctataataataattttgattcatgtagattactgaaagaggaaacatcattgatatttgcagataatcatgagactctagaggtagcacacacaaagcatctgataggtgaattacagtttaagataatgttaggagatataagatacaaatcatttgctgaatcacctgagctggaaattgatgcaaaatgtgttgggtgtccatcatgttttgaaagttattcctgcaacttccaaatagtgacaaacatagacaccgtatgctcagttgaagggccatgcacactatttcataacagaatcattatatcagctaacaagcagtcatatggactcaaaatgagttgccaaacaaagcctaatcaaaatgaagagttcattatctgcaacaggaaatatagtgtcctattcacaacaattgataaaaatgataaaatagaagtgaatacaggggatcagacttcatatatttatgaaaaggatagcagatgtaagacttggttgtgcagggttagagatgaggggatcagtgtcctatttgaaccattaaaggcattctttggaagttactttagtataatattttatgttgtcgttggaattattgtcctttttttgattatatacatatttttgccaatgttcttcaaactaaaagatgttttgaaaagaaatgaatatttgtatcttcaagaactgaaacataaatga

SEQ ID NO: 4150 - RNA, 4305 nt, synthetic construct
  misc_feature 1..4305: note = derived and/or modified CDS sequence (wt) from CVV(Montgomery County/VA/2015 K)__KX583999.1__GP
  source 1..4305: mol_type = other RNA
atgctattcttgctcatactagcctttttagggttctcaacgagcaaccctattgcgactaggtgtttccatgggggccaattaatagcagagtcaaagtctgctacatctatatcagaattctgcctcaaggatgacgtctcaatgttaaaatctgaagtggtatatacaaagaatgatactgggctatttggtcataataaagtttttagaagctggacaataaaagattggaaactctgcaatcctatacctactgcaggaggaacaataaatgtaattgaggtcaataaagatcttagtctaatgacaaagacatacatatgtagtagagattgcaccataactatagataaagaggaagctcagattatcttccaaacagataagttaaatcattttgaagtgtctggtaccacattaaattcaggatggttcaaaagcaaagcatctgttaccctggatagaacctgtgaacatgttaaggttacttgtggaaaaaagtctctgcaattccatgcatgctttaagcaccacatgtcatgtgttaggttcttccacaataccatattacctggcaatatgataaactctatgtgccagaatatagaattaataattatcttagggctaacattagctatatttatattaatggttatgcttacaaagacttatatatgttacttattgatgccaattttcatgccaatagcttatctttatggttgggcatataacaaaagctgcaaaaagtgtaactgctgtggtctagcatatcatccatttactaattgtggctcacactgtgtttgtggcttaaaatttgaggcatcagataggatgaggatccatagagaatctggcttatgtcaagggtacaagagtttacgaattgccaggcttttgtgtaaatctaaagggtcatctctagttatatctggattattatccatgttaatcttaagctttgtaacgcctatagagggaactataactagctacccagaaagcaggaaatatacactggaagagataacagatgttgttgaaggattagtatctgagcagaatataaaggagtacattgttttctacacctcattgtttggaagtttaatattgttactagcatttataatgtccataactttaagcaaaataacaagcatactagcaagaagaaatgttatttattgtgaagaatgctcaatgtatcattcaaaaagaggcataaagtataacggtgactttacaaacaaatgcggcttttgcacatgcaatgaacaggaggatgcagaagggttggtaatacataaagttagtaagagatgcacatataaatatcaactaaagtgggctaaagtgctgatggtcacactggtcttgcttctaatagcacaaaacactattctaattgttgcagctggaacagattgctgggcaaaaaaaagcctagatatggactgtatagggccaatgttagacataggctcttgcacaaataagaataccagaaactatgatacagaagcacagaaattggtgagccaatctaaagtaagtcaactagatgcagaccaggcatcattattgggcaactctatagatagtgctattaaagcaataagagcccagaaaacttatcctacaatgcacttattggaaacaatattcttaatgaagaattgtgattattacacaagttttaaccataatagtggctattcacaagctaaatggcgattaattgcaaaaacagggcactttgatatatgttctaggcatagcacccaccacttttgccgatgtataaatgatgggaccaaatgtcagaatggtgattgggattttgctggtgaaatgaatgaaacttataatagcaaaaatgatttttattcacatgatctgaacttgttttacacaatttttgaaaatgcattcccagggactactgaatccttattttaccagttaatccagaagaaaaatactacaggagcctccaaaatcttgggaaagttaataaccaagtatggtaataataacatgtttgttggagtctggaaatttggacagtacttacttacattgccatatataaataatactgaattgagccagaataggaggcaaacaatcttggcaacacaagaatcattaagtagatcacactctggcaggcaagagtctatgtccagtgcaattcagggcagtgttacaaaagaatgccacaatgcaaaggatgttgggtgcataagccctcggtttggcattccaattggcaacctcacagcatgtggcgactcacctaattataagatatataaaactccagaaaagttgtataaatcaaataataaaggggaagtttggtgttcgaatgatgttcactgcctgaatgattttgagcctgcagatgaagaagttgtcaataaagttaaaaaactcacttgtttcttaacagacgtctcagtcaaaacagacatcttttcagtagctgcatctacatgtaagatggcagataaaggcacttgtacagtgaatgatgctaaatggaatataatcaagtgtgatagtggattatactattttacagaccatagagaaggtcaagacacaggcaatgattttggtgagtattgtatatctcacagttgcaacactgagcgattccctattaacccagacatattaaaagattgcacttgggagttccattccaggaagtctaaatatatttcaaccattagtttagaatcattggaagaattcaggagagcaatgacagagaagttatcacacaccctaacaatttacaattttaaaccaacagctaacctccctcatattaggccaacttataaattcatcacagcaaatggtgtcgaaaactctgatggtattgaatcggcatatatcttatctagtatccctgcattaggtgggattagtgttggttataatgttcaaaccaaagacaatttcccattattggatataattgtatttattaaaagtgcagtcatcaggacaacatacaaccatatttatgatactgggcctactataggcataaacacacaacatgatgagcactgcacaggaccatgcccggctgtggtgccacataaagaaaactggataacattctctcaggaaagaacaagcagatgggggtgtgaagagtttggttgcttggccatcaacacagggtgtgtttttggttcttgccaagatataatacatccagaaaccaaagtataccgtaaagcagtagaagaagaagttgtcttaacagtgtgcattaatttcccaggtaataattactgcacagagataaatgccgttgagcccaagataacagatgagatagagctccagttcaaaacagttgatacaaaaaccttgcccaaccttcttgcagtgcaaaatcacaaactttacagtggccagataaacgatttgggctctttttcacaaggttgtggaaatgtccaaaaaacaaatcactcaatcctaggcatgggtacagccaaatttgattatgtctgtcatggtgctagtagaaaagatgtgatagtcaggaggtgctataataataattttgattcatgtagattactgaaagaggaaacatcattgatatttgcagataatcatgagactctagaggtagcacacacaaagcatctgataggtgaattacagtttaagataatgttaggagatataagatacaaatcatttgctgaatcacctgagctggaaattgatgcaaaatgtgttgggtgtccatcatgttttgaaagttattcctgcaacttccaaatagtgacaaacatagacaccgtatgctcagttgaagggccatgcacactatttcataacagaatcattatatcagctaacaagcagtcatatggactcaaaatgagttgccaaacaaagcctaatcaaaatgaagagttcattatctgcaacaggaaatatagtgtcctattcacaacaattgataaaaatgataaaatagaagtgaatacaggggatcagacttcatatatttatgaaaaggatagcagatgtaagacttggttgtgcagggttagagatgaggggatcagtgtcctatttgaaccattaaaggcattctttggaagttactttagtataatattttatgttgtcgttggaattattgtcctttttttgattatatacatatttttgccaatgttcttcaaactaaaagatgttttgaaaagaaatgaatatttgtatcttcaagaactgaaacataaatga

SEQ ID NO: 4151 - RNA, 4305 nt, synthetic construct
  misc_feature 1..4305: note = derived and/or modified CDS sequence (wt) from CVV(1156)__EU583730.1__GP
  source 1..4305: mol_type = other RNA
atgctattcctgctcatactagcctttttagggttctcaacaagcaaccctattgcaactaggtgtttccatgggggccaattaatagcagagtcaaagtctgctacatctatatcagaattctgcctcaaggatgatgtctcaatgttaaaatctgaagtggtatacataaagaatgatactggattatttggtcataataaggtttttcgaagctggacaataaaagattggaaactctgcaatcctatacctactgcaggaggaacaataaatgtaattgaggttaacaaagatcttagtctaatgacaaaaacatacatatgtagtagagattgcactataaccatagacaaagaggaagctcagatcatcttccaaacggataagctaaatcattttgaagtgtctggcactacattaagttcagggtggtttaaaagcaaggcgtctgtcaccctggatagaacctgtgagcatgttaaggttacttgtggaaagaaatctctgcaattccatgcatgttttaaacaccacatgtcatgtgttaggttcttccacaataccatattacctggcaatatgataacctcaatgtgtcagaatatagaattaataatcattttagggctaacattagccatattcatattaatggttattcttacaaaaacttatatatgttatttactgatgccaattttcatgccgatagcttatctttatggttgggcctacaataagagctgcaaaaagtgcaactgttgtggtttagcataccatccatttactaattgtgggtcacattgtgtttgtggcctgaaatttgaggcatcagataggatgagaatccatagggaatctggcttgtgtcaagggtacaagagtttacgaattgccagacttttgtgtaaatctaaagggtcatctttagttatatctggattattgtccatgttaatcttaagcttcgtaacacctatagaggggactataactagctacccagagagcagaaaatatacactagaagagataacagatgttgttgaaggactggtatctgaacagaatataaaggagtacattgttttctatacctcattgtttggaagtttaatactattattagcatttataatgtctataactttaagcaaaataacaagcatattagcaaaaagaaatgttatttattgcgaagaatgctcaatgtatcattcaaaaagaggcataaagtacaatggtgacttcacaaacaaatgcggcttttgcacatgcaatgaacaagaagatacggaaggattagtaatacataaaattagtaagagatgcacatataaataccagctaaagtgggctaaagtgctgatgatcacactagtcttgcttctaatagcgcaaaacactattctaattgttgcagctgaaacagattgctggacaaaaaaaagcctagatatagactgtataggaccaatgctagatataggctcttgtacaaataagaataccagaagctatgatgcagaagcacagaaattggtgagccagtctaaaataagtcaactagatgcagaccaagtatcgttgttaggcaactctatagatagtgctattaaggcaatcagagcccagaaaacttaccctacaatgcacttgttggaaacaatattcttaatgaaaaattgcgattattacacgagtttcaaccataacagtggttattcacaagccaaatggagattaattgcaaaaacaggacattttgacatatgttccagacatagcacccaccatttctgccgatgtataaatgatgggaccaaatgtcagaatggtgattgggatttcgctggtgaaatgaatgaaacttacaatagcaaaaatgatttttattcacatgacctgaatttgttttacacaatttttgaaaatgcattcccaggaacaactgaatccttattttatcaattgatccaaaagaaaaatactacaggggcctccaaggtcttggggaagttaataactaaatatggtaataataacatgtttgttggagtctggaaatttggacagtacttacttacattaccatatataaataatactgaattgagccaaaataggaggctaacaatcctgacaacacaagaactattaagtagatcgcactctggcaggcaggagtctatgtctaatgcaattcagggcagtattacaaaagaatgccataatgcaaagggtgttgggtgcataagtcctcggtttggtattccaattggtaaccttacagcatgtggtgactcacctaattataagatatataaaactccagaaaaattgtataaatcaaataataaaggggaagtttggtgttcaaatgatgttcactgcctgaatgattttgagcctgcagatgaagaagttgtcaataaaattaagaaactcacttgcttcttaacagacgtctcagttgaagtagacatcttttcagtggctgcatccacatgtaaaatggcagacaaaggcgtctgtacagtaaatggtgctaaatggaatataatcaagtgtgatagtgggttatactattttacagaccatagagaaggccaagacacaggcaatgactttggtgagtattgtatatctcacagttgcaatactgagcgattccctatcaacccagacatattaaaagattgtacttgggaattccattccagaaagtctaaatatatttcaaccatcagtttagaatcattggaagaattcaggagggcaatggcagagaagctatcacacaccctaacaatttacaattttaaaccaacagctaaccttcctcatattaggccaacttacaaattcattacagccaatggtgtcgaaaactctgacggtattgaatcagcatacatcttgtctagcatccctgcattaggtggaatcagtgttggttataatgttcaaaccaaagacaacttcccattgttggatataattgtatttattaaaagcgcagtcatcaggacaacatacaatcatatttatgataccgggcctactataggtataaacacacaacatgatgagcactgtacagggccgtgcccagctgtggtgccacataaagagaactggatgacattttctcaggaaagaacaagtagatgggggtgtgaggaatttggttgtttggccatcaacacagggtgtgtttttggttcttgccaagatataatacatccagaaactaaagtataccgcaaagcggtagaagaggaagttgtcttaacggtgtgcattaattttccaggcaacaattactgcactgaaataaatgccattgagcctaagataacagatgagatagagctccagttcaaaacagtcgatacaaaaaccttacccaacctccttgcagtgcagaatcacaagctttacagtggccagataaacgatttgggctctttttcacaaggttgtggaaatgtccaaaaaacaaatcactcaatcctaggcatgggtacagtcaaatttgattatgtctgtcacggcgctagtaggaaagatgtgatagtcaggaggtgctacaacaataattttgattcatgcaaattactgaaagaagaaacatcattaatatttgcagataatcatgagactctagaggtagcacacacaaagcatttgataggtgaattacagtttaagataatgttaggagatataagatacaaatcatttgctgaatcacctgagttggaaattgatgcaaaatgtgtcgggtgtccatcatgttttgaaagctattcctgcaactttcaaatagtgacaaatatagacactgtgtgctcagtcgaagggccatgcacactatttcataatcgaattattatatcagctaacaaacagtcatatgggcttaaaatgagttgccaaacaaagcctaaccaaaatgaagagttcattatctgtaaccggaaatacagtgtcttattcacaacaattgataaaaatgacaaaatagaagtgaacacaggggaccagacctcatatatttatgaaaaagacagcagatgtaagacttggttatgcagggttagagatgaggggatcagtgtcctatttgaaccattgaaagcattctttggaagttattttagcataatattttatgttgtcattggaattattgtccttttcttgattatatacatatttttgccaatgttcttcaaattaaaagatgttttgaaaagaaatgaatacttgtatcttcaggaactgaaacataaataa

SEQ ID NO: 4152 - RNA, 4305 nt, synthetic construct
  misc_feature 1..4305: note = derived and/or modified CDS sequence (wt) from CVV(6V633)__KX100134.1__GP
  source 1..4305: mol_type = other RNA
atgctattcctgctcatactagcctttttagggttctcaacaagcaaccctattgcaactaggtgtttccatgggggccaattaatagcagagtcaaagtctgctacatctatatcagaattctgcctcaaggatgatgtctcaatgttaaaatctgaagtggtatacataaagaatgatactggattatttggtcataataaagtttttagaagctggacaataaaagattggaaactctgcaaccctatacctactgcaggaggaacaataaatgtaattgaggttaacaaagatcttagtctaatgacaaagacatacatatgtagtagagattgcactataaccatagataaagaggaagctcagattatcttccaaacagataagctaaatcattttgaagtgtctggcactacattaagttcaggatggtttaaaagcaaggcgtctgtcaccctggatagaacctgtgagcatgttaaggttacttgtggaaagaaatctctgcaattccatgcatgttttaaacaccacatgtcatgtgttaggttcttccacaataccatattacctggcaatatgataacctcaatgtgccagaatatagaattaataattatcttagggctaacattagccatattcatattaatggttatgcttacaaaaacttatatatgttatttactgatgccaattttcatgccgatagcttatctttatggttgggcctacaataagagctgcaaaaagtgcaactgttgtggtttagcataccatccatttactaattgtgggtcacattgtgtttgtggcttgaaatttgaggcatcagataggatgagaatccatagagaatctggcttgtgtcaagggtacaagagtttacgaattgccagacttttgtgtaaatctaaagggtcatctttagttatatctggattattgtccatgttaatcttaagcttcgtaacgcctatagaggggactataactagctacccagagagcagaaaatatacactggaagagataacagatgttgttgaaggactggtatctgagcagaatataaaggagtatattgttttctatacctcattgtttggaagtttaatactattattagcatttataatgtctataactttaagcaaaataacaagcatattagcaaaaagaaatgttatttattgcgaagaatgctcaatgtatcattcaaaaagaggcataaagtacaatggtgacttcacaaacaaatgcggcttttgcacatgcaatgaacaagaggatacagaaggattagtaatacataaagttagtaagagatgcacatataaataccagctaaagtgggctaaagtgctgatgattacactagtcttgcttctaatagcgcaaaacactattctaattgttgcagctgaaacagattgctggacaaaaaaaagcctagatatagactgtataggaccaatgctagatataggctcttgcacaaataagaataccagaagctatgatgcagaagcacagaaattggtgagccagtctaaaataagtcaactagatgcagaccaagcatcgttgttaggcaactctatagatagtgctattaaggcaatcagagcccagaaaacttaccctacaatgcacttgttggaaacaatattcttaatgaaaaattgcgattattacacgagtttcaaccataacagtggctattcacaagccaaatggcgattgattgcaaaaacaggacactttgacatatgctccagacatagcacccaccatttctgccgatgtataaatgatggaaccaaatgtcagaatggtgattgggatttcgctggtgaaatgaatgaaacttacaatagcaaaaatgatttttattcacatgatctgaatttgttttacacaatttttgaaaatgcattcccaggaacaactgaatccttattttatcaattgatccaaaagaaaaatactacaggggcctccaaagtcttggggaagttaataactaaatatggtaataataacatgttcgttggaatctggaaatttggacagtacttacttacattaccatatataaataatactgaattgagccagaataggagactaacaatcctggcaacacaagaactattaagtaggtcgcactctggcaggcaggagtctatgtccaatgcaattcagggcagtattacaaaagaatgccataatgcaaaaggtgttgggtgcataagtcctcggtttggtattccaattggtaaccttacagcatgtggtgactcacctaattataaaatatataagactccagaaaaattgtataaatcaaataataaaggggaagtttggtgttcaaatgatgttcactgcctgaatgattttgagcctgcagatgaagaagttgtcaataaaattaagaaactcacttgcttcttaacagacgtctcagttgaagtagacatcttttcagtggctgcatccacatgtaagatggcagacaaaggcgtctgtacagtaaatggtgctaaatggaatataatcaagtgtgatagtggattatactattttacagaccatagagaaggccaggacacaggcaatgactttggtgagtattgtatatctcacagttgcaatactgagcgattccctatcaacccagacacattaaaagattgtacttgggagttccattccagaaagtctaaatatatttcaaccatcagtttagaatcattggaagaattcaggagggcaatggcagaaaagttatcacacaccctaacaatttacaattttaaaccaacagctaaccttcctcatattaggccaacctacaaattcattacagccaatggtgtcgaaaactctgacggtattgaatcagcatacatcttgtctagcatccctgcattaggtggaattagtgttggttataatgttcaaaccaaagacaacttcccattgttggatataattgtatttattaaaagcgcagtcatcaggacaacatacaatcatatttatgataccgggcctactataggtataaacacacaacatgatgagcactgtacagggccgtgcccagctgtggtgccacataaagagaactggatgacattttctcaggaaagaacaagtagatggggatgtgaagaatttggttgcttggccatcaacacagggtgtgtttttggttcttgccaagatataatacatccagaaactaaagtataccgcaaagcagtagaagaggaagttgtcttaacggtgtgcatcaattttccaggcaataattactgcactgaaataaatgccattgagcctaagataacagatgagatagagctccagttcaaaacagtcgatacaaaaaccttacccaaccttcttgcagtgcagaatcacaagctttacagtggccagataaacgatttgggctctttttcacaaggttgtggaaatgtccaaaaaacaaatcactcaatcctaggcatgggtacagtcaaatttgattatgtctgtcacggcgctagtaggaaagatgtgatagtcaggaggtgctacaacaataattttgattcatgcaaattactgaaagaagaaacatcattaatatttgcagataatcatgagactctagaggtagcacacacaaagcatctgataggtgaattacagtttaagataatgttaggagatataagatacaaatcatttgctgaatcacctgagttggaaattgatgcaaaatgtgtcgggtgtccatcatgttttgaaagctactcctgcaactttcaaatagtgacaaatatagacactgtgtgctcagtcgaagggccatgcacactatttcataatcgaattattatatcagctaacaaacagtcatatgggcttaaaatgagttgccaaacaaagcctaaccaaaatgaagagttcattatctgtaacaggaaatacagtgtcttattcacaacaattgataaaaatgacaaaatagaagtgaacacaggggaccagacttcatatatttatgaaaaggacagcagatgtaagacttggttgtgcagggttagagatgaggggatcagtgtcctatttgaaccattgaaagcattctttgggagctattttagcataatattttatgttgttgttggaattattgtccttttcttgattatatacatatttttgccaatgttcttcaaactaaaagatgttttgaaaagaaatgaatatttgtatcttcaggaactgaaacataaatga

SEQ ID NO: 4153 - RNA, 4305 nt, synthetic construct
  misc_feature 1..4305: note = derived and/or modified CDS sequence (wt) from CVV(807270)__AF186243.1__GP
  source 1..4305: mol_type = other RNA
atgctattcctgctcatactagcctttttagggttctcaacaagcaaccctattgcaactaggtgtttccatgggggccaattaatagcagagtcaaagtctgctacatctatatcagaattctgcctcaaggatgatgtctcaatgttaaaatctgaagtggtatacataaagaatgatactggattatttggtcataataaagtttttcgaagctggacaataaaagattggaaactctgcaatcctatacctactgcaggaggaacaataaatgtaattgaggttaacaaagatcttagtctaatgacaaaaacatacatatgtagtagagattgcactataaccatagataaagaggaagctcagatcatcttccaaacagataagctaaatcattttgaagtgtctggcactacattaagttcaggatggtttaaaagcaaggcgtctgtcaccctggatagaacctgtgagcatgttaaggttacttgtggaaagaaatctctgcaattccatgcatgttttaaacaccacatgtcatgtgttaggttcttccacaataccatattacctggcaatatgataacctcaatgtgtcagaatatagaattaataatcatcttagggctaacattagccatattcatattaatggttattcttacaaaaacttatatatgttatttactgatgccaattttcatgccgatagcttatctttatggttgggcctacaataagagctgcaaaaagtgcaactgttgtggtttagcataccatccatttactaattgtgggtcacattgtgtttgtggcctgaaatttgaggcatcagataggatgagaatccatagagaatctggcttgtgtcaagggtacaagagtttacgaattgccagacttttgtgtaaatctaaagggtcatctttagttatatctggattattgtccatgttaatcttaagcttcgtaacgcctatagaaggaactataactagctacccagagagcagaaaatatacactagaagagataacagatgttgttgaaggactggtatctgagcagaatataaaggagtacattgttttctatacctcattgtttggaagtttaatactattattagcatttataatgtctataactttaagcaaaataacaagcatattagcaaaaagaaatgttatttattgcgaagaatgctcaatgtatcattcaaaaagaggcataaagtacaatggtgacttcacaaacaaatgcggcttttgcacatgcaatgaacaagaggatacggaaggattagtaatacataaagttagtaagagatgcacatataaataccagctaaagtgggctaaagtgctgatgatcacactagtcttgcttctaatagcgcaaaacactatcctaattgttgcagctgaaacagattgctggacaaaaaaaagcctagatatagactgtataggaccaatgctagatataggctcttgcacaaataagaataccagaagctatgatgcagaagcacagaaattggtgagtcagtctaaaataagtcaactagatgcagaccaagtatcgttgttaggcaactctatagatagtgctattaaggcaatcagagcccagaaaacttaccctacaatgcacttgttggaaacaatattcttaatgaaaaattgcgattattacacaagtttcaaccataacagtggctattcacaagccaaatggcgattgattgcaaaaacaggacattttgacatatgctccagacatagcacccaccatttctgccaatgtataaatgatggaaccaaatgtcagaatggtgattgggatttcgctggtgaaatgaatgaaacttacaatagcaaaaatgatttttattcacatgacctgaatttgttttacacaatttttgaaaatgcattcccaggaacaactgaatccttattttatcaattgatccaaaagaaaaatactacaggggcctccaaggtcttggggaagttaataactaaatatggtaataataacatgtttgttggagtctggaaatttggacagtacttacttacattaccatatataaataatactgaattgagccagaataggaggctaacaatactggcaacacaagaactattaagtagatcgcactctggcaggcaggagtctatgtccaatgcaattcagggcagtattacaaaagaatgccataatgcaaagggtgttgggtgcataagtcctcggtttggtattccaattggtaaccttacagcatgtggtgactcacctaattataagatatataagactccagaaaaattgtataaatcaaataataaaggggaagtttggtgttcaaatgatgttcactgcctgaatgattttgagcctgcagatgaagaagttgtcaataaaattaagaaactcacttgcttcttaacagacgtctcagttgaagtagacatcttttcagtggctgcatctacatgtaaaatggcagacaaaggcgtctgtacagtaaatggtgctaaatggaatataatcaagtgtgatagtgggttatactattttacagaccatagagaaggccaagacacaggcaatgactttggtgagtattgtatatctcacagttgcaatactgagcgattccctatcaacccagacatattaaaagattgtacttgggaattccattccagaaagtctaaatatatttcaaccatcagtttagaatcattggaagaattcaggagggcaatggcagagaagctatcacacaccctaacaatttacaattttaaaccaacagctaaccttccccatattaggccaacttacaaattcattacagccaatggtgtcgaaaactctgacggtattgaatcagcatacattttgtctagcatccctgcattaggtggaattagtgttggttataatgttcaaaccaaagacaacttcccattgttggatataattgtatttattaaaagcgcagtcatcaggacaacatacaatcatatttatgataccgggcctactataggtataaacacacaacatgatgagcactgtacagggccgtgcccagctgtggtgccacataaagagaactggatgacattttctcaggaaagaacaagtagatggggatgtgaagaatttggttgtttggccatcaacacagggtgtgtttttggttcttgccaagatataatacatccagaaactaaagtataccgcaaagcagtagaagaggaagttgtcttaacagtgtgcatcaattttccaggcaacaattactgcactgaaataaatgccattgagcctaagataacagatgagatagagctccagttcaaaacagtcgatacaaaaaccttacccaaccttcttgcagtgcaaaatcacaagctttacagtggccagataaacgatttgggctctttttcacaaggttgtggaaatgtccaaaaaacaaatcactcaatcctaggcatgggtacagtcaaatttgattatgtctgtcatggcgctagtaggaaagatgtgatagtcaggaggtgctacaacaataattttgattcatgcaaattactgaaagaagaaacatcattaatatttgcagataatcatgagactctagaggtagcacacacaaagcatttgataggtgaattacagtttaagataatgttgggagatataagatacaaatcatttgctgaatcacctgagttggaaattgatgcaaaatgtgtcgggtgtccatcatgttttgaaagctactcctgcaactttcaaatagtgacaaatatagacactgtgtgctcagtcgaagggccatgcacactatttcataatcgaattattatatcagctaacaaacagtcatatgggcttaaaatgagttgccaaacaaagcctaaccaaaatgaagagttcattatctgtaaccggaaatacagtgtcttattcacaacaattgataaaaatgacaaaatagaagtgaacacaggggaccagacctcatatatttatgaaaaagacagcagatgtaagacttggttatgcagggttagagatgaggggatcagtgtcctatttgaaccgttgaaagcattctttggaagttattttagcataatattttatgttgtcgttggaattattgtccttttcttgattatatacatatttttgccaatgttcttcaaattaaaagatgttttgaaaagaaatgagtatttgtatcttcaagaactgaaacataaatga

SEQ ID NO: 4154 - RNA, 4305 nt, synthetic construct
  misc_feature 1..4305: note = derived and/or modified CDS sequence (wt) from CVV(856 clone 1)__EU583732.1__GP
  source 1..4305: mol_type = other RNA
atgctattcctgctcatactagcctttttagggttctcaacaagcaaccctattgcaactaggtgtttccatgggggccaattaatagcagagtcaaagtctgctacatctatatcagaattctgcctcaaggatgatgtctcaatgttaaaatctgaagtggtatacataaagaatgatactggattatttggtcataataaggtttttcgaagctggacaataaaagattggaaactctgcaatcctatacctactgcaggaggaacaataaatgtaattgaggttaacaaagatcttagtctaatgacaaaaacatacatatgtagtagagattgcactataaccatagacaaagaggaagctcagatcatcttccaaacggataagctaaatcattttgaagtgtctggcactacattaagttcagggtggtttaaaagcaaggcgtctgtcaccctggatagaacctgtgagcatgttaaggttacttgtggaaagaaatctctgcaattccatgcatgttttaaacaccacatgtcatgtgttaggttcttccacaataccatattacctggcaatatgatagcctcaatgtgtcagaatatagaattaataatcattttagggctaacattagccatattcatattaatggttattcttacaaaaacttatatatgttatttactgatgccaattttcatgccgatagcttatctttatggttgggcctacaataagagctgcaaaaagtgcaactgttgtggtttagcataccatccatttactaattgtgggtcacattgtgtttgtggcctgaaatttgaggcatcagataggatgagaatccatagggaatctggcttgtgtcaagggtacaagagtttacgaattgccagacttttgtgtaaatctaaagggtcatctttagttatatctggattattgtccatgttaatcttaagcttcgtaacacctatagaggggactataactagctacccagagagcagaaaatatacactagaagagataacagatgttgttgaagggctggtatctgaacagaatataaaggagtacattgttttctatacctcattgtttggaagtttaatactattattagcatttataatgtctataactttaagcaaaataacaagcatattagcaaaaagaaatgttatttattgcgaagaatgctcaatgtatcattcaaaaagaggcataaagtacaatggtgacttcacaaacaaatgcggcttttgcacatgcaatgaacaagaagatacggaaggattagtaatacataaagttagtaagagatgcacatataaataccagctaaagtgggctaaagtgctgatgatcacactagtcttgcttctaatagcgcaaaacactattctaattgttgcagctgaaacagattgctggataaaaaaaagcctagatatagactgtataggaccaatgctagatataggctcttgcacaaataagaataccagaagctatgatgcagaagcacagaaattggtgagccagtctaaaataagtcaactagatgcagaccaagtatcgttgttaggcaactctatagatagtgctattaaggcaatcagagcccagaaaacttaccctacaatgcacttgttggaaacaatattcttaatgaaaaattgcgattattacacgagtttcaaccataacagtggttattcacaagccaaatggagattgattgcaaaaacaggacattttgacatatgttccagacatagcacccaccatttctgccgatgtataaatgatgggaccaaatgtcagaatggtgattgggatttcgctggtgaaatgaatgaaacttacaatagcaaaaatgatttttattcacatgacctgaatttgttttacacaatttttgaaaatgcattcccaggaacaactgaatccttattttatcaattgatccaaaggaaaaatactacaggggcctccaaggtcttggggaagttaataactaaatatggtaataataacatgtttgttggagtctggaaatttggacagtacttacttacattaccatatataaataatactgaattgagccaaaataggaggctaacaatcctgacaacacaagaactattaagtagatcgcactctggcaggcaggagtctatgtctaatgcaattcagggcagtattacaaaagaatgccataatgcaaagggtgttgggtgcataagtcctcggtttggtattccaattggtaaccttacagcatgtggtgactcacctaattataagatatataagactccagaaaaattgtataaatcaaataataaaggggaagtttggtgttcaaatgatgttcactgcctgaatgattttgagcctgcagatgaagaagttgtcaataaaattaagaaactcacttgcttcttaacagacgtctcagttgaagtagacatcttttcagtggctgcatccacatgtaaaatggcagacaaaggtgtctgtacagtaaatggtgctaaatggaatataatcaaatgtgatagtgggttatactattttacagaccatagagaaggccaagacacaggcaatgactttggtgagtattgtatatctcacagttgcaatactgagcgattccctatcaacccagacatattaaaagattgtacttgggaattccattccagaaagtctaaatatatttcaaccatcagtttagaatcattggaagaattcaggagggcaatggcagagaagctatcacacaccctaacaatttacaattttaaaccaacagctaaccttcctcatattaggccaacttacaaattcattacagccaatggtgtcgaaaactctgacggtattgaatcagcatacatcttgtctagcatccctgcattaggtggaatcagtgttggttataatgttcaaaccaaagacaacttcccattgttggatataattgtatttattaaaagcgcagtcatcaggacaacatacaatcatatttatgataccgggcctactataggtataaacacacaacatgatgagcactgtacagggccgtgcccagctgtggtgccacataaagagaactggatgacattttctcaggaaagaacaagtagatgggggtgtgaggaatttggttgtttggccatcaacacagggtgtgtttttggttcttgccaagatataatacatccagaaactaaagtataccgcaaagcggtagaagaggaagttgtcttaacggtgtgcatcaattttccaggcaacaattactgcactgaaataaatgccattgagcctaagataacagatgagatagagctccagttcaaaacagtcgatacaaaaactttacccaaccttcttgcagtgcagaatcacaagctctacagtggccagataaacgatttgggctctttttcacaaggttgtggaaatgtccaaaaaacaaatcactcaatcctaggcatgggtacagtcaaatttgattatgtctgtcacggcgctagtaggaaagatgtgatagtcaggaggtgctacaacaataattttgattcatgcaaattactgaaagaagaaacatcattaatatttgcagataatcatgagactctagaggtagcacacacaaagcatttgataggtgaattacagtttaagataatgttaggagatataagatacaaatcatttgctgaatcacctgagttggaaattgatgcaaaatgtgtcgggtgtccatcatgttttgaaagctattcctgcaactttcaaatagtgacaaatatagacactgtgtgctcagtcgaagggccatgcacactatttcataatcgaattattatatcagctaacaaacagtcatatgggcttaaaatgagttgccaaacaaagcctaaccaaaatgaagagttcattatctgtaaccggaaatacagtgtcttattcacaacaattgataaaaatgacaaaatagaagtgaacacaggggaccagacctcatatatttatgaaaaagacagcagatgtaagacttggttatgcagggttagagatgaggggatcagtgtcctatttgaaccgttgaaagcattctttggaagttattttagcataatattttatgttgtcattggaattattgtccttttcttgattatatacatatttttgccaatgttcttcaaattaaaagatgttttgaaaagaaatgaatacttgtatcttcaggaactgaaacataaataa

SEQ ID NO: 4155 - RNA, 4305 nt, synthetic construct
  misc_feature 1..4305: note = derived and/or modified CDS sequence (wt) from CVV(856 clone 3)__EU583731.1__GP
  source 1..4305: mol_type = other RNA
atgctattcctgctcatactagcctttttagggttctcaacaagcaaccctattgcaactaggtgtttccatgggggccaattaatagcagagtcaaagtctgctacatctatatcagaattctgcctcaaggatgatgtctcaatgttaaaatctgaagtggtatacataaagaatgatactggattatttggtcataataaggtttttcgaagctggacaataaaagattggaaactctgcaatcctatacctactgcaggaggaacaataaatgtaattgaggttaacaaagatcttagtctaatgacaaaaacatacatatgtagtagagattgcactataaccatagacaaagaggaagctcagatcatcttccaaacggataagctaaatcattttgaagtgtctggcactacattaagttcagggtggtttaaaagcaaggcgtctgtcaccctggatagaacctgtgagcatgttaaggttacttgtggaaagaaatctctgcaattccatgcatgttttaaacaccacatgtcatgtgttaggttcttccacaataccatattacctggcaatatgatagcctcaatgtgtcagaatatagaattaataatcattttagggctaacattagccatattcatattaatggttattcttacaaaaacttatatatgttatttactgatgccaattttcatgccgatagcttatctttatggttgggcctacaataagagctgcaaaaagtgcaactgttgtggtttagcataccatccatttactaattgtgggtcacattgtgtttgtggcctgaaatttgaggcatcagataggatgagaatccatagggaatctggcttgtgtcaagggtacaagagtttacgaattgccagacttttgtgtaaatctaaagggtcatctttagttatatctggattattgtccatgttaatcttaagcttcgtaacacctatagaggggactataactagctacccagagagcagaaaatatacactagaagagataacagatgttgttgaagggctggtatctgaacagaatataaaggagtacattgttttctatacctcattgtttggaagtttaatactattattagcatttataatgtctataactttaagcaaaataacaagcatattagcaaaaagaaatgttatttattgcgaagaatgctcaatgtatcattcaaaaagaggcataaagtacaatggtgacttcacaaacaaatgcggcttttgcacatgcaatgaacaagaagatacggaaggattagtaatacataaagttagtaagagatgcacatataaataccagctaaagtgggctaaagtgctgatgatcacactagtcttgcttctaatagcgcaaaacactattctaattgttgcagctgaaacagattgctggataaaaaaaagcctagatatagactgtataggaccaatgctagatataggctcttgcacaaataagaataccagaagctatgatgcagaagcacagaaattggtgagccagtctaaaataagtcaactagatgcagaccaagtatcgttgttaggcaactctatagatagtgctattaaggcaatcagagcccagaaaacttaccctacaatgcacttgttggaaacaatattcttaatgaaaaattgcgattattacacgagtttcaaccataacagtggttattcacaagccaaatggagattgattgcaaaaacaggacattttgacatatgttccagacatagcacccaccatttctgccgatgtataaatgatgggaccaaatgtcagaatggtgattgggatttcgctggtgaaatgaatgaaacttacaatagcaaaaatgatttttattcacatgacctgaatttgttttacacaatttttgaaaatgcattcccaggaacaactgaatccttattttatcaattgatccaaaggaaaaatactacaggggcctccaaggtcttggggaagttaataactaaatatggtaataataacatgtttgttggagtctggaaatttggacagtacttacttacattaccatatataaataatactgaattgagccaaaataggaggctaacaatcctgacaacacacgaactattaagtagatcgcactctggcaggcaggagtctatgtctaatgcaattcagggcagtattacaaaagaatgccataatgcaaagggtgttgggtgcataagtcctcggtttggtattccaattggtaaccttacagcatgtggtgactcacctaattataagatatataagactccagaaaaattgtataaatcaaataataaaggggaagtttggtgttcaaatgatgttcactgcctgaatgattttgagcctgcagatgaagaagttgtcaataaaattaagaaactcacttgcttcttaacagacgtctcagttgaagtagacatcttttcagtggctgcatccacatgtaaaatggcagacaaaggtgtctgtacagtaaatggtgctaaatggaatataatcaaatgtgatagtgggttatactattttacagaccatagagaaggccaagacacaggcaatgactttggtgagtattgtatatctcacagttgcaatactgagcgattccctatcaacccagacatattaaaagattgtacttgggaattccattccagaaagtctaaatatatttcaaccatcagtttagaatcattggaagaattcaggagggcaatggcagagaagctatcacacaccctaacaatttacaattttaaaccaacagctaaccttcctcatattaggccaacttacaaattcattacagccaatggtgtcgaaaactctgacggtattgaatcagcatacatcttgtctagcatccctgcattaggtggaatcagtgttggttataatgttcaaaccaaagacaacttcccattgttggatataattgtatttattaaaagcgcagtcatcaggacaacatacaatcatatttatgataccgggcctactataggtataaacacacaacatgatgagcactgtacagggccgtgcccagctgtggtgccacataaagagaactggatgacattttctcaggaaagaacaagtagatgggggtgtgaggaatttggttgtttggccatcaacacagggtgtgtttttggttcttgccaagatataatacatccagaaactaaagtataccgcaaagcggtagaagaggaagttgtcttaacggtgtgcatcaattttccaggcaacaattactgcactgaaataaatgccattgagcctaagataacagatgagatagagctccagttcaaaacagtcgatacaaaaactttacccaaccttcttgcagtgcagaatcacaagctctacagtggccagataaacgatttgggctctttttcacaaggttgtggaaatgtccaaaaaacaaatcactcaatcctaggcatgggtacagtcaaatttgattatgtctgtcacggcgctagtaggaaagatgtgatagtcaggaggtgctacaacaataattttgattcatgcaaattactgaaagaagaaacatcattaatatttgcagataatcatgagactctagaggtagcacacacaaagcatttgataggtgaattacagtttaagataatgttaggagatataagatacaaatcatttgctgaatcacctgagttggaaattgatgcaaaatgtgtcgggtgtccatcatgttttgaaagctattcctgcaactttcaaatagtgacaaatatagacactgtgtgctcagtcgaagggccatgcacactatttcataatcgaattattatatcagctaacaaacagtcatatgggcttaaaatgagttgccaaacaaagcctaaccaaaatgaagagttcattatctgtaaccggaaatacagtgtcttattcacaacaattgataaaaatgacaaaatagaagtgaacacaggggaccagacctcatatatttatgaaaaagacagcagatgtaagacttggttatgcagggttagagatgaggggatcagtgtcctatttgaaccgttgaaagcattctttggaagttattttagcataatattttatgttgtcattggaattattgtccttttcttgattatatacatatttttgccaatgttcttcaaattaaaagatgttttgaaaagaaatgaatacttgtatcttcaggaactgaaacataaataa

SEQ ID NO: 4156 - RNA, 4305 nt, synthetic construct
  misc_feature 1..4305: note = derived and/or modified CDS sequence (wt) from CVV(CK102)__AF186242.1__GP
  source 1..4305: mol_type = other RNA
atgctattcctgctcatactagcctttttagggttctcaacaagcaaccctattgcaactaggtgtttccatgggggccaattaatagcagagtcaaagtctgctacatctatatcagaattctgcctcaaggatgatgtctcaatgttaaaatctgaagtggtatacataaagaatgatactggattatttggtcataataaagtttttcgaagctggacaataaaagattggaaactctgcaatcctatacctactgcaggaggaacaataaatgtaattgaggttaacaaagatcttagtctaatgacaaaaacatacatatgtagtagagattgcactataaccatagataaagaggaagctcagatcatcttccaaacagataagctaaatcattttgaagtgtctggcactacattaagttcaggatggtttaaaagcaaggcgtctgtcaccctggatagaacctgtgagcatgttaaggttacttgtggaaagaaatctctgcaattccatgcatgttttaagcaccacatgtcatgtgttaggttcttccacaataccatattacctggcaatatgataacctcaatgtgtcagaatatagaattaataatcatcttagggctaacattagccatattcatattaatggttattcttacaaaaacttatatatgttatttactgatgccaattttcatgccgatagcttatctttatggttgggcctacaataagagctgcaaaaagtgcaactgttgtggtttagcataccatccatttactaattgtgggtcacattgtgtttgtggcctgaaatttgaggcatcagataggatgagaatccatagagaatctggcttgtgtcaagggtacaagagtttacgaattgccagacttttgtgtaaatctaaagggtcatctttagttgtatctggattattgtccatgttaatcttaagcttcgtaacgcctatagaggggactataactagctacccagagagcagaaaatatacactagaagagataacagatgttgttgaaggactggtatctgagcagaatataaaggagtacattgttttctatacctcattgtttggaagtttaatactattattagcatttataatgtctataactttaagcaaaataacgagcatattagcaaaaagaaatgttatttattgcgaagaatgctcaatgtatcattcaaaaagaggcataaagtacaatggtgacttcacaaacaagtgcggcttttgcacatgcaatgaacaagaggatacggaaggattagtaatacataaagttagtaagagatgcacatataaataccagctaaagtgggctaaagtgctgatgatcacactagtcttgcttctaatagcgcaaaacactattctaattgttgcagctgaaacagattgctggacaaaaaaaagcctagatatagactgtataggaccaatgctagatataggctcttgcacaaataagaataccagaagctatgatacagaagcacagaaattggtgagccagtctaaaataagtcaactagatgcagaccaagtatcgttgttaggcaactctatagatagtgctattaaggcaatcagagcccagaaaacttaccctacaatgcacttgttggaaacaatattcttaatgaaaaattgcgattattacacgagtttcaaccataacagtggctattcacaagccaaatggcgattgattgcaaaaacaggacattttgacatatgctccagacatagcacccaccatttctgccgatgtataaatgatggaaccaaatgtcagaatggtgattgggatttcgctggtgaaatgaatgaaacttacaatagcaaaaatgatttttattcacatgacctgaatttgttttacacaatttttgaaaatgcattcccaggaacaactgaatccttattttatcaattgatccaaaagaaaaatactacaggggcctccaaggtcttggggaagttaataactaaatatggtaataataacatgtttgttggagtctggaaatttggacagtacttacttacattaccatatataaataatactgaattgagccagaataggaggctaacaatcctggcaacacaagaactattaagtagatcgcactctggcaggcaggagtctatgtccaatgcaattcagggcagtattacaaaagaatgccataatgcaaagggtgttgggtgcataagtcctcggtttggtattccaattggtaaccttacagcatgtggtgactcacctaattataagatatataagactccagaaaaattgtataaatcaaataataaaggggaagtttggtgttcaaatgatgttcactgcctgaatgattttgagcctgcagatgaagaagttgtcaataaaattaagaaactcacttgcttcttaacggacgtctcagttgaagtagacatcttttcagtggctgcatccacatgtaaaatggcagacaaaggcgtctgtacagtaaatggtgctaaatggaatataatcaagtgtgatagtgggttatactattttacagaccatagagaaggccaagacacaggcaatgactttggtgagtattgtatatctcacagttgcaatactgagcgattccctatcaacccagacatattaaaagattgtacttgggaattccattccagaaagtctaaatatatttcaaccatcagtttagaatcattggaagaattcaggagggcaatggcagagaagctatcacacaccctaacaatttacaattttaaaccaacagctaaccttcctcatattaggccaacttacaaattcattacagccaatggtgtcgaaaactctgacggtattgaatcagcatacatcttgtctagcatccctgcattaggtggaattagtgttggttataatgttcaaaccaaagacaacctcccattgttggatataattgtatttattaaaagcgcagtcatcaggacaacatacaatcatatttatgataccgggcctactataggtataaacacacaacatgatgagcactgtacagggccgtgcccagctgtggtgccacataaagagaactggatgacattttctcaggaaagaacaagtagatggggatgtgaagaatttggttgtttggccatcaacacagggtgtgtttttggttcttgccaagatataatacatccagaaactaaagtataccgcaaagcagtagaagaggaagttgtcttaacggtgtgcatcaattttccaggcaacaattactgcactgaaataaatgccattgagcctaagataacagatgagatagagctccagttcaaaacagtcgatacaaaaaccttacccaaccttcttgcagtgcagaatcacaagctttacagtggccagataaatgatttgggctctttttcacaaggttgtggaaatgtccaaaaaacaaatcactcaatcctaggcatgggtacagtcaaatttgattatgtctgtcacggcgctagtaggaaagatgtgatagtcaggaggtgctacaacaataattttgattcatgcaaattactgaaagaagaaacatcattaatatttgcagataatcatgagactctagaggtagcacacacaaagcatttgataggtgaattacagtttaagataatgttaggagatataagatacaaatcatttgctgaatcacctgagttggaaattgatgcaaaatgtgtcgggtgtccatcatgttttgaaagctactcctgcaactttcaaatagtgacaaatatagacactgtgtgctcagtcgaagggccatgcacactatttcataatcgaattattatatcagctaacaaacagtcatatgggcttaaaatgagttgccaaacaaagcctaaccaaaatgaagagttcattatctgtaaccggaaatacagtgtcttattcacaacaattgataaaaatgacaaaatagaagtgaacacaggggaccagacctcatatatttatgaaaaagacagcagatgtaagacttggttatgcagggttagagatgaggggatcagtgtcctatttgaaccgttgaaagcattctctggaagttattttagcataatattttatgttgtcgttggaattattgttcttttcttgattatatacatatttttgccaatgttcttcaaattaaaagatgttttgaaaagaaatgaatatttgtatcttcaggaactgaaacataaatga

SEQ ID NO: 4157 - RNA, 4305 nt, synthetic construct
  misc_feature 1..4305: note = derived and/or modified CDS sequence (wt) from CVV(CK-102)__KX100146.1__GP
  source 1..4305: mol_type = other RNA
atgctattcctgctcatactagcctttttagggttctcaacaagcaaccctattgcaactaggtgtttccatgggggccaattaatagcagagtcaaagtctgctacatctatatcagaattctgcctcaaggatgatgtctcaatgttaaaatctgaagtggtatacataaagaatgatactggattatttggtcataataaagtttttcgaagctggacaataaaagattggaaactctgcaatcctatacctactgcaggaggaacaataaatgtaattgaggttaacaaagatcttagtctaatgacaaaaacatacatatgtagtagagattgcactataaccatagataaagaggaagctcagatcatcttccaaacagataagctaaatcattttgaagtgtctggcactacattaagttcaggatggtttaaaagcaaggcgtctgtcaccctggatagaacctgtgagcatgttaaggttacttgtggaaagaaatctctgcaattccatgcatgttttaagcaccacatgtcatgtgttaggttcttccacaataccatattacctggcaatatgataacctcaatgtgtcagaatatagaattaataatcatcttagggctaacattagccatattcatattaatggttattcttacaaaaacttatatatgttatttactgatgccaattttcatgccgatagcttatctttatggttgggcctacaataagagctgcaaaaagtgcaactgttgtggtttagcataccatccatttactaattgtgggtcacattgtgtttgtggcctgaaatttgaggcatcagataggatgagaatccatagagaatctggcttgtgtcaagggtacaagagtttacgaattgccagacttttgtgtaaatctaaagggtcatctttagttgtatctggattattgtccatgttaatcttaagcttcgtaacgcctatagaggggactataactagctacccagagagcagaaaatatacactagaagagataacagatgttgttgaaggactggtatctgagcagaatataaaggagtacattgttttctatacctcattgtttggaagtttaatactattattagcatttataatgtctataactttaagcaaaataacaagcatattagcaaaaagaaatgttatttattgcgaagaatgctcaatgtatcattcaaaaagaggcataaagtacaatggtgacttcacaaacaagtgcggcttttgcacatgcaatgaacaagaggatacggaaggattagtaatacataaagttagtaagagatgcacatataaataccagctaaagtgggctaaagtgctgatgatcacactagtcttgcttctaatagcgcaaaacactattctaattgttgcagctgaaacagattgctggacaaaaaaaagcctagatatagactgtataggaccaatgctagatataggctcttgcacaaataagaataccagaagctatgatacagaagcacagaaattggtgagccagtctaaaataagtcaactagatgcagaccaagtatcgttgttaggcaactctatagatagtgctattaaggcaatcagagcccagaaaacttaccctacaatgcacttgttggaaacaatattcttaatgaaaaattgcgattattacacgagtttcaaccataacagtggctattcacaagccaaatggcgattgattgcaaaaacaggacattttgacatatgctccagacatagcacccaccatttctgccgatgtataaatgatggaaccaaatgtcagaatggtgattgggatttcgctggtgaaatgaatgaaacttacaatagcaaaaatgatttttattcacatgacctgaatttgttttacacaatttttgaaaatgcattcccaggaacaactgaatccttattttatcaattgatccaaaagaaaaatactacaggggcctccaaggtcttggggaagttaataactaaatatggtaataataacatgtttgttggagtctggaaatttggacagtacttacttacattaccatatataaataatactgaattgagccagaataggaggctaacaatcctggcaacacaagaactattaagtagatcgcactctggcaggcaggagtctatgtccaatgcaattcagggcagtattacaaaagaatgccataatgcaaagggtgttgagtgcataagtcctcggtttggtattccaattggtaaccttacagcatgtggtgactcacctaattataagatatataagactccagaaaaattgtataaatcaaataataaaggggaagtttggtgttcaaatgatgttcactgcctgaatgattttgagcctgcagatgaagaagttgtcaataaaattaagaaactcacttgcttcttaacggacgtctcagttgaagtagacatcttttcagtggctgcatccacatgtaaaatggcagacaaaggcgtctgtacagtaaatggtgctaaatggaatataatcaagtgtgatagtgggttatactattttacagaccatagagaaggccaagacacaggcaatgactttggtgagtattgtatatctcacagttgcaatactgagcgattccctatcaacccagacatattaaaagattgtacttgggaattccattccagaaagtctaaatatatttcaaccatcagtttagaatcattggaagaattcaggagggcaatggcagagaagctatcacacaccctaacaatttacaattttaaaccaacagctaaccttcctcatattaggccaacttacaaattcattacagccaatggtgtcgaaaactctgacggtattgaatcagcatacatcttgtctagcatccctgcattaggtggaattagtgttggttataatgttcaaaccaaagacaacctcccattgttggatataattgtatttattaaaagcgcagtcatcaggacaacatacaatcatatttatgataccgggcctactataggtataaacacacaacatgatgagcactgtacagggccgtgcccagctgtggtgccacataaagagaactggatgacattttctcaggaaagaacaagtagatggggatgtgaagaatttggttgtttggccatcaacacagggtgtgtttttggttcttgccaagatataatacatccagaaactaaagtataccgcaaagcagtagaagaggaagttgtcttaacggtgtgcatcaattttccaggcaacaattactgcactgaaataaatgccattgagcctaagataacagatgagatagagctccagttcaaaacagtcgatacaaaaaccttacccaaccttcttgcagtgcagaatcacaagctttacagtggccagataaatgatttgggctctttttcacaaggttgtggaaatgtccaaaaaacaaatcactcaatcctaggcatgggtacagtcaaatttgattatgtctgtcacggcgctagtaggaaagatgtgatagtcaggaggtgctacaacaataattttgattcatgcaaattactgaaagaagaaacatcattaatatttgcagataatcatgagactctagaggtagcacacacaaagcatttgataggtgaattacagtttaagataatgttaggagatataagatacaaatcatttgctgaatcacctgagttggaaattgatgcaaaatgtgtcgggtgtccatcatgttttgaaagctactcctgcaactttcaaatagtgacaaatatagacactgtgtgctcagtcgaagggccatgcacactatttcataatcgaattattatatcagctaacaaacagtcatatgggcttaaaatgagttgccaaacaaagcctaaccaaaatgaagagttcattatctgtaaccggaaatacagtgtcttattcacaacaattgataaaaatgacaaaatagaagtgaacacaggggaccagacctcatatatttatgaaaaagacagcagatgtaagacttggttatgcagggttagagatgaggggatcagtgtcctatttgaaccgttgaaagcattctttggaagttattttagcataatattttatgttgtcgttggaattattgttcttttcttgattatatacatatttttgccaatgttcttcaaattaaaagatgttttgaaaagaaatgaatatttgtatcttcaggaactgaaacataaatga

SEQ ID NO: 4158 - RNA, 4305 nt, synthetic construct
  misc_feature 1..4305: note = derived and/or modified CDS sequence (wt) from CVV(MI80-1-450)__AF186241.1__GP
  source 1..4305: mol_type = other RNA
atgctattcctgctcatactagcctttttagggttctcaacaagcaaccctattgcaactaggtgtttccatgggggccatttaatagcagagtcaaagtctgctacatctatatcagaattctgcctcaaggatgatgtctcaatgttaaaatctgaagtggtatacataaagaatgatactggattatttggtcataataaagtttttcgaagctggacaataaaagattggaaactctgcaatcctatacctactgcaggaggaacaataaatgtaattgaggttaacaaagatcttagtctaatgacaaagacatacatatgtagtagagattgcactataaccatagataaagaggaagctcagatcatcttccaaacagataagctaaatcattttgaagtgtctggcactacattaagttcaggatggtttaaaagcaaggcgtctgtcaccctggatagaacctgtgagcatgttaaggttacttgtggaaagaaatctctgcaattccatgcatgttttaaacaccacatgtcatgtgttaggttcttccacaatactatattacctggcaatatgataacctcaatgtgccagaatatagaattaataattattttagggctaacattggccatattcatattaatggttattcttacaaaaacttatatatgttatttactgatgccaattttcatgccgatagcttatctttatggttgggcctacaataagagctgcaaaaagtgcaactgttgtggtttagcataccatccatttactaattgtgggtcacattgtgtttgtggcctgaaatttgaggcatcagataggatgagaatccatagagaatctggcttgtgtcaagggtacaagagtttacgaattgccagacttttgtgtaaatctaaagggtcatctttagttatatctggattattgtccatgttaatcttaagcttcgtaacacctatagaggggactataactagctacccagagagcagaaaatatacactggaagagataacagatgttgttgaaggactggtatctgagcagaatataaaggagtacattgttttctatacctcattgtttggaagtttaatactattattagcatttataatgtctataactttaagcaaaataacaagcatattagcaaaaagaaatgttatttattgcgaagaatgctcaatgtatcattcaaaaagaggcataaagtacaatggtgacttcacaaacaaatgcggcttttgcacatgcaatgaacaagaggatacggaaggattagtaatacataaagttagtaagagatgcacatataaataccagctaaagtgggctaaagtgctgatgatcacactagtcttgcttttaatagcgcaaaacactattctaattgttgcagctgaaacagattgctggacaaaaaaaagcctagatatagactgtataggaccaatgctagatataggctcttgcacaaataagaataccagaagctatgatgcagaagcacagaaattggtgagccagtctaaaataagtcaactagatgcagaccaagtatcgttgttaggcaactctatagatagtgctattaaggcaatcagagcccagaaaacttaccctacaatgcacttgttggaaacaatattcttaatgaaaaattgcgattattacacgagtttcaaccataacagtggctattcacaagccaaatggcgattgattgcaaaaacaggacattttgacatatgctccagacatagcacccaccatttctgccgatgtataaatgatggaaccaaatgtcagaatggtaattgggatttcgctggtgaaatgaatgaaacttacaatagcaaaaatgatttttattcacatgatctgaatttgttttacacaatttttgaaaatgcattcccaggaacaactgagtccttattttatcaattgatccaaaagaaaaatactacaggggcctcccaagtcttggggaagttaataactaaatatggtaataataacatgttcgttggagtctggaaatttggacagtacttacttacattaccatatataaataatactgaattgagccagaataggaggctaacaatcctggcaacacaagaactattaagtagatcgcactctggcaggcaggagtctatgtccaatgcaattcagggcagtattacaaaagaatgccataatgcaaagggtgttgggtgtataagtcctcggtttggtattccaattggtaaccttacagcatgtggtgactcacctaattataagatatataagactccagaaaaattgtataaatcaaataataaaggggaagtttggtgttcaaatgatgttcactgcctgaatgattttgagcctgcagatgaagaagttgtcaataaaattaagaaactcacttgcttcttaacagacgtctcagttgaagtagacatcttttcagtggctgcatccacatgtaaaatggcagacaaaggcgtctgtacagtaaatggtgctaaatggaatataatcaagtgtgatagtgggttatactattttacagaccatagagaaggccaagacacaggcaatgactttggtgagtattgtatatctcacagttgcaatactgagcgattccctatcaacccagacatattaaaagattgtacttgggaattccattccagaaagtctaaatatatttcaaccatcagtttagaatcattggaagaattcaggagggcaatggcagagaagttatcacacaccctaacaatttacaattttaaaccaacagctaaccttcctcatattaggccaacttacaaattcattacagccaatggtgttgaaaactctgacggtattgaatcagcatacatcttgtctagcatccctgcattaggtggaattagtgttggttataatgttcaaaccaaagacaacttcccattgttggatataattgtatttattaaaagcgcagtcatcaggacaacatacaatcatatttatgataccgggcctactataggtataaacacacaacatgatgagcactgtacagggccgtgcccagctgtggtgccacataaagagaactggatgacattttctcaggaaagaacaagtagatggggatgtgaagaatttggttgcttggccatcaacacagggtgtgtttttggttcttgccaagatataatacatccagaaactaaagtataccgcaaagcagtagaagaggaagttgtcttaacggtgtgcatcaattttccaggcaacaattactgcactgaaataaatgccattgagcctaagataacagatgagatagagctccagttcaaaacagtcgatacaaaaaccttacccaaccttcttgcagtgcagaatcacaagctttacagtggccagataaacgatttgggctctttttcacaaggttgtggaaatgtccaaaaaacaaatcactcaatcctaggcatgggcacagtcaaatttgattatgtctgtcacggtgctagtaggaaagatgtgatagtcaggaggtgctacaacaataattttgattcatgcaaattactgaaagaagaaacatcattaatatttgcagataatcatgagactctagaggtagcacacacaaagcatttgataggtgaattacagtttaagataatgttaggagatataagatacaagtcatttgctgaatcacctgagttggaaattgatgcaaaatgtgtcgggtgcccatcatgttttgaaagctactcctgcaactttcaaatagtgacaaatatagacactgtgtgctcagtcgaagggccatgcacactatttcataatcgaattattatatcagctaacaaacagtcatatgggcttaaaatgagttgccaaacaaagcctaaccaaaatgaagagttcattatctgtaaccggaaatacagtgtcttattcacaacaattgataaaaatgacaaaatagaagtgaacacaggggaccagacctcatatatttatgaaaaggacagcagatgtaagacttggttatgcagggttagagatgaagggatcagtgtcctatttgaaccgttgaaagcattctttggaagttattttagcataatattttatgttgtcgttggaattattgtccttttcttgattatatacatatttttgccaatgttcttcaaattaaaagatgttttgaaaagaaatgaatatttgtatcttcaggaactgaaacataaatga

SEQ ID NO: 4159 - RNA, 4305 nt, synthetic construct
  misc_feature 1..4305: note = derived and/or modified CDS sequence (wt) from CVV(MI80-1-450)__KX100149.1__GP
  source 1..4305: mol_type = other RNA
atgctattcctgctcatactagcctttttagggttctcaacaagcaaccctattgcaactaggtgtttccatgggggccaattaatagcagagtcaaagtctgctacatctatatcagaattctgcctcaaggatgatgtctcaatgttaaaatctgaagtggtatacataaagaatgatactggattatttggtcataataaagtttttcgaagctggacaataaaagattggaaactctgcaatcctatacctactgcaggaggaacaataaatgtaattgaggttaacaaagatcttagtctaatgacaaagacatacatatgtagtagagattgcactataaccatagataaagaggaagctcagatcatcttccaaacagataagctaaatcattttgaagtgtctggcactacattaagttcaggatggtttaaaagcaaggcgtctgtcaccctggatagaacctgtgagcatgttaaggttacttgtggaaagaaatctctgcaattccatgcatgttttaaacaccacatgtcatgtgttaggttcttccacaatactatattacctggcaatatgataacctcaatgtgccagaatatagaattaataattattttagggctaacattggccatattcatattaatggttattcttacaaaaacttatatatgttatttactgatgccaattttcatgccgatagcttatctttatggttgggcctacaataagagctgcaaaaagtgcaactgttgtggtttagcataccatccatttactaattgtgggtcacattgtgtttgtggcctgaaatttgaggcatcagataggatgagaatccatagagaatctggcttgtgtcaagggtacaagagtttacgaattgccagacttttgtgtaaatctaaagggtcatctttagttatatctggattattgtccatgttaatcttaagcttcgtaacacctatagaggggactataactagctacccagagagcagaaaatatacactggaagagataacagatgttgttgaaggactggtatctgagcagaatataaaggagtacattgttttctatacctcattgtttggaagtttaatactattattagcatttataatgtctataactttaagcaaaataacaagcatattagcaaaaagaaatgttatttattgcgaagaatgctcaatgtatcattcaaaaagaggcataaagtacaatggtgacttcacaaacaaatgcggcttttgcacatgcaatgaacaagaggatacggaaggattagtaatacataaagttagtaagagatgcacatataaataccagctaaagtgggctaaagtgctgatgatcacactagtcttgcttttaatagcgcaaaacactattctaattgttgcagctgaaacagattgctggacaaaaaaaagcctagatatagactgtataggaccaatgctagatataggctcttgcacaaataagaataccagaagctatgatgcagaagcacagaaattggtgagccagtctaaaataagtcaactagatgcagaccaagtatcgttgttaggcaactctatagatagtgctattaaggcaatcagagcccagaaaacttaccctacaatgcacttgttggaaacaatattcttaatgaaaaattgcgattattacacgagtttcaaccataacagtggctattcacaagccaaatggcgattgattgcaaaaacaggacattttgacatatgctccagacatagcacccaccatttctgccgatgtataaatgatggaaccaaatgtcagaatggtaattgggatttcgctggtgaaatgaatgaaacttacaatagcaaaaatgatttttattcacatgatctgaatttgttttacacaatttttgaaaatgcattcccaggaacaactgagtccttattttatcaattgatccaaaagaaaaatactacaggggcctcccaagtcttggggaagttaataactaaatatggtaataataacatgttcgttggagtctggaaatttggacagtacttacttacattaccatatataaataatactgaattgagccagaataggaggctaacaatcctggcaacacaagaactattaagtagatcgcactctggcaggcaggagtctatgtccaatgcaattcagggcagtattacaaaagaatgccataatgcaaagggtgttgggtgtataagtcctcggtttggtattccaattggtaaccttacagcatgtggtgactcacctaattataagatatataagactccagaaaaattgtataaatcaaataataaaggggaagtttggtgttcaaatgatgttcactgcctgaatgattttgagcctgcagatgaagaagttgtcaataaaattaagaaactcacttgcttcttaacagacgtctcagttgaagtagacatcttttcagtggctgcatccacatgtaaaatggcagacaaaggcgtctgtacagtaaatggtgctaaatggaatataatcaagtgtgatagtgggttatactattttacagaccatagagaaggccaagacacaggcaatgactttggtgagtattgtatatctcacagttgcaatactgagcgattccctatcaacccagacatattaaaagattgtacttgggaattccattccagaaagtctaaatatatttcaaccatcagtttagaatcattggaagaattcaggagggcaatggcagagaagttatcacacaccctaacaatttacaattttaaaccaacagctaaccttcctcatattaggccaacttacaaattcattacagccaatggtgttgaaaactctgacggtattgaatcagcatacatcttgtctagcatccctgcattaggtggaattagtgttggttataatgttcaaaccaaagacaacttcccattgttggatataattgtatttattaaaagcgcagtcatcaggacaacatacaatcatatttatgataccgggcctactataggtataaacacacaacatgatgagcactgtacagggccgtgcccagctgtggtgccacataaagagaactggatgacattttctcaggaaagaacaagtagatggggatgtgaagaatttggttgcttggccatcaacacagggtgtgtttttggttcttgccaagatataatacatccagaaactaaagtataccgcaaagcagtagaagaggaagttgtcttaacggtgtgcatcaattttccaggcaacaattactgcactgaaataaatgccattgagcctaagataacagatgagatagagctccagttcaaaacagtcgatacaaaaaccttacccaaccttcttgcagtgcagaatcacaagctttacagtggccagataaacgatttgggctctttttcacaaggttgtggaaatgtccaaaaaacaaatcactcaatcctaggcatgggcacagtcaaatttgattatgtctgtcacggtgctagtaggaaagatgtgatagtcaggaggtgctacaacaataattttgattcatgcaaattactgaaagaagaaacatcattaatatttgcagataatcatgagactctagaggtagcacacacaaagcatttgataggtgaattacagtttaagataatgttaggagatataagatacaagtcatttgctgaatcacctgagttggaaattgatgcaaaatgtgtcgggtgcccatcatgttttgaaagctactcctgcaactttcaaatagtgacaaatatagacactgtgtgctcagtcgaagggccatgcacactatttcataatcgaattattatatcagctaacaaacagtcatatgggcttaaaatgagttgccaaacaaagcctaaccaaaatgaagagttcattatctgtaaccggaaatacagtgtcttattcacaacaattgataaaaatgacaaaatagaagtgaacacaggggaccagacctcatatatttatgaaaaggacagcagatgtaagacttggttatgcagggttagagatgaagggatcagtgtcctatttgaaccgttgaaagcattctttggaagttattttagcataatattttatgttgtcgttggaattattgtccttttcttgattatatacatatttttgccaatgttcttcaaattaaaagatgttttgaaaagaaatgaatatttgtatcttcaggaactgaaacataaatga

SEQ ID NO: 4160 - RNA, 4305 nt, synthetic construct
  misc_feature 1..4305: note = derived and/or modified CDS sequence (wt) from CVV(MNZ-92011)__KC436107.1__GP
  source 1..4305: mol_type = other RNA
atgctattcttgctcatactagcctttttagggttctcaacgagcaaccctattgcgactaggtgtttccatgggggccaattaatagcagagtcaaagtctgctacatctatatcagaattctgcctcaaggatgacgtctcaatgttaaaatctgaagtggtatatacaaagaatgatactgggctatttggtcataataaagtttttagaagctggacaataaaagattggaaactctgcaatcctatacctactgcaggaggaacaataaatgtaattgaggtcaataaagatcttagtctaatgacaaagacatacatatgtagtagagattgcaccataactatagataaagaggaagctcagattatcttccaaacagataagttaaatcattttgaagtgtctggtaccacattaaattcaggatggttcaaaagcaaagcatctgttaccctggatagaacctgtgaacatgttaaggttacttgtggaaaaaagtctctgcaattccatgcatgctttaagcaccacatgtcatgtgttaggttcttccacaataccatattacctggcaatatgataaactctatgtgccagaatatagaattaataattatcttagggctaacattagctatatttatattaatggttatgcttacaaagacttatatatgttacttattgatgccaattttcatgccaatagcttatctttatggttgggcatataacaaaagctgcaaaaagtgtaactgctgtggtctagcatatcatccatttactaattgtggctcacactgtgtttgtggcttaaaatttgaggcatcagataggatgaggatccatagagaatctggcttatgtcaagggtacaagagtttacgaattgccaggcttttgtgtaaatctaaagggtcatctctagttatatctggattattatccatgttaatcttaagctttgtaacgcctatagagggaactataactagctacccagaaagcaggaaatatacactggaagagataacagatgttgttgaaggattagtatctgagcagaatataaaggagtacattgttttctacacctcattgtttggaagtttaatattgttactagcatttataatgtccataactttaagcaaaataacaagcatactagcaagaagaaatgttatttattgtgaagaatgctcaatgtatcattcaaaaagaggcataaagtataacggtgactttacaaacaaatgcggcttttgcacatgcaatgaacaggaggatgcagaagggttagtaatacataaagttagtaagagatgcacatataaatatcaactaaagtgggctaaagtgctgatggtcacactggtcttgcttttaatagcacaaaacactattctaattgttgcagctggaacagattgctgggcaaaaaaaagcctagatatggactgtatagggccaatgttagacataggctcttgcacaaataagaataccagaaactatgatacagaagcacagaaattggtgagccaatctaaagtaagtcaactagatgcagaccaggcatcattattgggcaactctatagatagtgctattaaagcaataagagcccagaaaacttatcctacaatgcacttattggaaacaatattcttaatgaaaaattgtgattattacacaagttttaaccataatagtggctattcacaagctaaatggcgattaattgcaaaaacagggcactttgatatatgttctaggcatagcacccaccacttttgccgatgtataaatgatgggaccaaatgtcagaatggtgattgggattttgctggtgaaatgaatgaaacttataatagcaaaaatgatttttattcacatgatctgaacttgttttacacaatttttgaaaatgcattcccagggactactgaatccttattttaccagttaatccagaagaaaaatactgcaggagcctccaaaatcttgggaaagttaataaccaagtatggtaataataacatgtttgttggagtctggaaatttggacagtacttacttacattgccatatataaataatactgaattgagccagaataggaggcaaacaatcttggcaacacaagaatcattaagtagatcacactctggcaggcaagagtctatgtccagtgcaattcagggcagtgttacaaaagaatgccacaatgcaaaggatgttgggtgcataagccctcggtttggcattccaattggcaacctcacagcatgtggcgactcacctaattataagatatataaaactccagaaaagttgtataaatcaaataataaaggggaagtttggtgttcgaatgatgttcactgcctgaatgattttgagcctgcagatgaagaagttgtcaataaagttaaaaaactcacttgtttcttaacagacgtctcagtcaaaacagacatcttttcagtagctgcatctacatgtaagatggcagataaaggcatttgtacagtgaatgatgctaaatggaatataatcaagtgtgatagtggattatactattttacagaccatagagaaggtcaagacacaggcaatgactttggtgagtattgtatatctcacagttgcaacactgagcgattccctattaacccagacatattaaaagattgcacttgggagttccattccaggaagtctaaatatatttcaaccattagtttagaatcattggaagaattcaggagagcaatgacagagaagttatcacacaccctaacaatttacaattttaaaccaacagctaacctccctcatattaggccaacttataaattcatcacagcaaatggtgtcgaaaactctgatggtattgaatcggcatatatcttatctagtatccctgcattaggtgggattagtgttggttataatgttcaaaccaaagacaatttcccattattggatataattgtatttattaaaagtgcagtcatcaggacaacatacaaccatatttatgatactgggcctactataggcataaacacacaacatgatgagcactgcacaggaccatgcccggctgtggtgccacataaagaaaactggataacattctctcaggaaagaacaagcagatgggggtgtgaagagtttggttgcttggccatcaacacagggtgtgtttttggttcttgccaagatataatacatccagaaaccaaagtataccgtaaagcagtagaagaagaagttgtcttaacagtgtgcattaatttcccaggtaataattactgcacagagataaacgccgttgagcccaagataacagatgagatagagctccagttcaaaacagttgatacaaaaaccttgcccaaccttcttgcagtgcaaaatcacaaactttacagtggccagataaacgatttgggctctttttcacaaggttgtggaaatgtccaaaaaacaaatcactcaatcctaggcatgggtacagccaaatttgattatgtctgtcatggtgctagtagaaaagatgtgatagtcaggaggtgctataataataattttgattcatgtagattactgaaagaggaaacatcattgatatttgcagataatcatgagactctagaggtagcacacacaaagcatctgataggtgaattacagtttaagataatgttaggagatataagatacaaatcatttgctgaatcacctgagctggaaattgatgcaaaatgtgttgggtgtccatcatgttttgaaagttattcctgcaacttccaaatagtgacaaacatagacaccgtatgctcagttgaagggccatgcacactatttcataacagaatcattatatcagctaacaagcagtcatatggactcaaaatgagttgccaaacaaagcctaatcaaaatgaagagttcattatctgcaacaggaaatatagtgtcctattcacaacaattgataaaaatgataaaatagaagtgaatacaggggatcagacttcatatatttatgaaaaggatagcagatgtaagacttggttgtgcagggttagagatgaggggatcagtgtcctatttgaaccattaaaggcattctttggaagttactttagtataatattttatgttgtcgttggaattattgtcctttttttgattatatacatatttttgccaatgttcttcaaactaaaagatgttttgaaaagaaatgaatatttgtatcttcaagaactgaaacataaatga

SEQ ID NO: 4161 - RNA, 4305 nt, synthetic construct
  misc_feature 1..4305: note = derived and/or modified CDS sequence (wt) from CVV(MPB1-1551)__KX100143.1__GP
  source 1..4305: mol_type = other RNA
atgctattcctgctcatactagcctttttagggttctcaacaagcaaccctattgcaactaggtgtttccatgggggccaattaatagcagagtcaaagtctgctacatctatatcagaattctgcctcaaggatgatgtctcaatgttaaaatctgaagtggtatacataaagaatgatactggattatttggtcataataaagtttttagaagctggacaataaaagattggaaactctgcaaccctatacctactgcaggaggaacaataaatgtaattgaggttaacaaagatcttagtctaatgacaaagacatacatatgtagtagagattgcactataaccatagataaagaggaagctcagattatcttccaaacagataagctaaatcattttgaagtgtctggcactacattaagttcaggatggtttaaaagcaaggcgtctgtcaccctggatagaacctgtgagcatgttaaggttacttgtggaaagaaatctctgcaattccatgcatgttttaaacaccacatgtcatgtgttaggttcttccacaataccatattacctggcaatatgataacctcaatgtgccagaatatagaattaataattatcttagggctaacattagccatattcatattaatggttatgcttacaaaaacttatatatgttatttactgatgccaattttcatgccgatagcttatctttatggttgggcctacaataagagctgcaaaaagtgcaactgttgtggtttagcatatcatccatttactaattgtgggtcacattgtgtttgtggcctgaaatttgaggcatcagataggatgagaatccatagagaatctggcttgtgtcaagggtacaagagtttacgaattgccagacttttgtgtaaatctaaagggtcatctttagttatatctggattattgtccatgttaatcttaagcttcgtaacgcctatagaggggactataactagctacccagagagcagaaaatatacactggaagagataacagatgttgttgaaggactggtatctgagcagaatataaaggagtacattgttttctatacctcattgtttggaagtttaatactattattagcatttataatgtctataactttaagcaaaataacaagcatattagcaaaaagaaatgttatttattgtgaagaatgctcaatgtatcattcaaaaagaggcataaagtacaatggtgacttcacaaacaaatgcggcttttgcacatgcaatgaacaagaggatacagaaggattagtaatacataaagttagtaagagatgcacatataaataccagctaaagtgggctaaagtgctgatgatcacactagtcttgcttctaatagcgcaaaacactattctaattgttgcagctgaaacagattgctggacaaaaaaaagcctagatatagactgtataggaccaatgctagatataggctcttgcacaaataagaataccagaagctatgatgcagaagcacagaaattggtgagccagtctaaaataagtcaactagatgcagaccaagcatcgttgttaggcaactctatagatagtgctattaaggcaatcagagcccagaaaacttaccctacaatgcacttgttggaaacaatattcttaatgaaaaattgcgattattacacgagtttcaaccataacagtggctattcacaagccaaatggcgattgattgcaaaaacaggacactttgacatatgctccagacatagcacccaccatttctgccgatgtataaatgatggaaccaaatgtcagaatggtgattgggatttcgctggtgaaatgaatgaaacttacaatagcaaaaatgatttttattcacatgatctgaatttgttttacacaatttttgaaaatgcattcccaggaacaactgaatccttattttatcaattgatccaaaagaaaaacactacaggggcctccaaagtcttggggaagttaataactaaatatggtaataataacatgttcgttggagtctggaaatttggacagtacttacttacattaccatatataaataatactgaattgagccagaataggagactaacaatcctggcaacacaagaaatattaagtaggtcgcactctggcaggcaggagtctatgtccaatgcaattcagggcagtattacaaaagaatgccataatgcaaaaggtgttgggtgcataagtcctcggtttggtattccaattggtaaccttacagcatgtggtgactcacctaattataagatatataagactccagaaaaattgtataaatcaaataataaaggggaagtttggtgttcaaatgatgttcactgcctgaatgattttgagcctgcagatgaagaagttatcaataaaattaagaaactcacttgcttcttaacagacgtctcagttgaagtagacatcttttcagtggctgcatccacatgtaagatggcagacaaaggcgtctgtacagtaaatggtgctaaatggaatataatcaagtgtgatagtggattatactattttacagaccatagagaaggccaagacacaggcaatgactttggtgagtattgtatatctcacagttgcaatactgagcgattccctatcaacccagacacattaaaagattgtacttgggagttccattccagaaagtctaaatatatttcaaccatcagtttagaatcattggaagaattcaggagggcaatggcagagaagttatcacacaccctaacaatttacaattttaaaccaacagctaaccttcctcatattaggccaacctacaaattcattacagccaatggtgtcgaaaactctgacggtattgaatcagcatacatcttgtctagcatccctgcattaggtggaattagtgttggttataatgttcaaaccaaagacaacttcccattgttggatataattgtatttattaagagcgcagttatcaggacaacatacaatcatatttatgataccgggcctactataggtataaacacacaacatgatgagcactgtacagggccgtgcccagctgtggtgccacataaagagaactggatgacattttctcaggaaagaacaagtagatggggatgtgaagaatttggttgcttggccatcaacacagggtgtgttttcggttcttgtcaagatataatacatccagaaactaaagtataccgcaaagcagtagaagaggaagttgtcttaacggtgtgcatcaattttccaggcaatagttactgcactgaaataaatgccattgagcctaagataacagatgagatagagctccagttcaaaacagtcgatacaaaaaccttacccaaccttcttgcagtgcagaatcacaagctttacagtggccagataaacgatttgggctctttttcacaaggttgtggaaatgtccaaaaaacaaatcactcaatcctaggcatgggtacagtcaaatttgattatgtctgtcacggcgctagtaggaaagatgtgatagtcaggaggtgctacaacaataattttgattcatgcaaattactgaaagaagaaacatcattaatatttgcagataatcatgagactctagaggtagcacacacaaagcatctgataggtgaattacagtttaagataatgttaggagatataagatacaaatcatttgctgaatcacctgagttggaaattgatgcaaaatgtgtcgggtgtccatcatgttttgaaagctactcctgcaactttcaaatagtgacaaatatagacactgtgtgctcagtcgaagggccatgcacactatttcataatcgaattattatatcagctaacaaacagtcatatgggcttaaaatgagttgccaaacaaagcctaaccaaaatgaagagttcattatctgtaacaggaaatacagtgtcttattcacaacaattgataaaaatgacaaaatagaagtgaacacaggggaccagacctcatatatttatgaaaaggacagcagatgtaagacttggttgtgcagggttagagatgaggggatcagtgtcctatttgaaccattgaaagcattctttggaagttattttagcataatattttatgttgtcgttggaattattgtccttttcttgattatatacatatttttgccaatgttcttcaaattaaaagatgttttgaaaagaaatgaatatttgtatcttcaggaactgaaacataaatga

SEQ ID NO: 4162 - RNA, 4305 nt, synthetic construct
  misc_feature 1..4305: note = derived and/or modified CDS sequence (wt) from CVV(W308-67)__KX100140.1__GP
  source 1..4305: mol_type = other RNA
atgctattcctgctcatactagcctttttagggttctcaacaagcaaccctattgcaactaggtgtttccatgggggccaattaatagcagagtcaaagtctgctacatctatatcagaattctgcctcaaggatgatgtctcaatgttaaaatctgaagtggtatacataaagaatgatactggattatttggtcataataaagtttttagaagctggacaataaaagattggaaactctgcaaccctatacctactgcaggaggaacaataaatgtaattgaggttaacaaagatcttagtctaatgacaaagacatacatatgtagtagagattgcactataaccatagataaagaggaagctcagattatcttccaaacagataagctaaatcattttgaagtgtctggcactacattaagttcaggatggtttaaaagcaaggcgtctgtcaccctggatagaacctgtgagcatgttaaggttacttgtggaaagaaatctctgcaattccatgcatgttttaaacaccacatgtcatgtgttaggttcttccacaataccatattacctggcaatatgataacctcaatgtgccagaatatagaattaataattatcttagggctaacattagccatattcatattaatggttacgcttacaaaaacttatatatgttatttactgatgccaattttcatgccgatagcttatctttatggttgggcctacaataagagctgcaaaaagtgcaactgttgtggtttagcataccatccatttactaattgtgggtcacattgtgtttgtggcctgaaatttgaggcatcagataggatgagaatccatagagaatctggcttgtgtcaagggtacaagagtttacgaattgccagacttttgtgtaaatctaaagggtcatctttagttatatctggattattgtccatgttaatcttaagcttcgtaacgcctatagaggggactataactagctacccagagagcagaaaatatacactggaagagataacagatgttgttgaaggactggtatctgagcagaatataaaggagtacattgttttctatacctcattgtttggaagtttaatactattattagcatttataatgtctataactttaagcaaaataacaagcatattagcaaaaagaaatgttatttattgtgaagaatgctcaatgtatcattcaaaaagaggcataaagtacaatggtgacttcacaaacaaatgcggcttttgcacatgcaatgaacaagaggatacagaaggattagtaatacataaagttagtaagagatgcacatataaataccagctaaagtgggctaaagtgctgatgatcacgctagtcttgcttctaatagcgcaaaacactattctaattgttgcagctgaaacagattgctggacaaaaaaaagcctagatatagactgtataggaccaatgctagatataggctcttgcacaaataagaataccagaagctatgatgcagaagcacagaaattggtgagccagtctaaaataagtcaactagatgcagaccaagcatcgttgttaggcaactctatagatagtgctattaaggcaatcagagcccagaaaacttaccctacaatgcacttgttggaaacaatattcttaatgaaaaattgcgattattacacgagtttcaaccataacagtggctattcacaagccaaatggcgattgattgcaaaaacaggacactttgacatatgctccagacatagcacccaccatttctgccgatgtataaatgatgaaaccaaatgtcagaatggtgattgggatttcgctggtgaaatgaatgaaacttacaaaagcaaaaatgatttttattcacatgatctgaatttgttttacacaatttttgaaaatgcattcccaggaacaactgaatccttattttatcaattgatccaaaagaaaaatactacaggggcctccaaagtcttggggaagttaataactaaatatggtaataataacatgttcgttggagtctggaaatttggacagtacttacttacattaccatatataaataatactgaattgagccagaataggagactaacaatcctggcaacacaagaaatattaagtaggtcgtactctggcaggcaggagtctatgtccaatgcaattcagggcagtattacaaaagaatgccataatgcaaaaggtgttgggtgcataagtcctcggtttggtattccaattggtaaccttacagcatgtggtgactcacctaattataagatatataagactccagaaaaattgtataaatcaaataataaaggggaagtttggtgttcaaatgatgttcactgcctgaatgattttgagcctgcagatgaagaagttatcaataaaattaagaaactcacttgcttcttaacagacgtctcagttgaagtagacatcttttcagtggctgcatccacatgtaagatggcagacaaaggcgtctgtacagtaaatggtgctaaatggaatataatcaagtgtgatagtggattatactattttacagaccatagagaaggccaagacacaggcaatgactttggtgagtattgtatatctcacagttgcaatactgagcgattccctatcaacccagacacattaaaagattgtacttgggagttccattccagaaagtctaaatatatttcaaccatcagtttagaatcattggaagaattcaggagggcaatggcagagaagttatcacacaccctaacaatttacaattttaaaccaacagctaaccttcctcatattaggccaacctacaaattcattacagccaatggtgtcgaaaactctgacggtattgaatcagcatacatcttgtctagcatccctgcattaggtggaattagtgttggttacaatgttcaaaccaaagacaacttcccattgttggatataattgtatttattaagagcgcagtcatcaggacaacatacaatcatatttatgataccgggcctactataggtataaacacacaacatgatgagcactgtacagggccgtgcccagctgtggtgccacataaagagaactggatgacattttctcaggaaagaacaagtagatggggatgtgaagaatttggttgcttggccatcaacacagggtgtgttttcggttcttgccaagatataatacatccagaaactaaagtataccgcaaagcagtagaagaggaagttgtcttaacggtgtgcatcaattttccaggcaataattactgcactgaaataaatgccattgagcctaagataacagatgagatagagctccagttcaaaacagtcgatacaaaaaccttacccaaccttcttgcagtgcagaatcacaagctttacagtggccagataaacgatttgggctctttttcacaaggttgtggaaatgtccaaaaaacaaatcactcaatcctaggcatgggtacagtcaaatttgattatgtctgtcacggcgctagtaggaaagatgtgatagtcaggaggtgctacaacaataattttgattcatgcaaattactgaaagaagaaacatcattaatatttgcagataatcatgagactctagaggtagcacacacaaagcatctgataggtgaattacagtttaagataatgttaggagatataagatacaaatcatttgctgaatcacctgagttggaaattgatgcaaaatgtgtcgggtgtccatcatgttttgaaagctactcctgctactttcaaatagtgacaaatatagacactgtgtgctcagtcgaagggccatgcacactatttcataatcgaattattatatcagctaacaaacagtcatatgggcttaaaatgagttgccaaacaaagcctaaccaaaatgaagagttcattatctgtaacaggaaatacagtgtcttattcacaacaattgataaaaatgacaaaatagaagtgaacacaggggaccagacctcatatatttatgaaaaggacagcagatgtaagacttggttgtgcagggttagagatgaggggatcagtgtcctatttgaaccattgaaagcattctttggaagttattttagcataatattttatgttgtcgttggaattattgtccttttcttgattatatacatatttttgccaatgttcttcaaattaaaagatgttttgaaaagaaatgaatatttgtatcttcaggaactgaaacataaatga

SEQ ID NO: 4163 - RNA, 4305 nt, synthetic construct
  misc_feature 1..4305: note = derived and/or modified CDS sequence (wt) from CVV(W728-67)__KX100137.1__GP
  source 1..4305: mol_type = other RNA
atgctattcctgctcatactagcctttttaggattctcaacaagcaaccctattgcaactaggtgtttccatgggggccaattaatagcagagtcaaagtctgctacatctatatcagaattctgcctcaaggatgatgtctcaatgttgaaatctgaagtggtatacataaagaatgatactggactatttggtcataataaagtttttagaagctggacaataaaagattggaaactctgcaaccctatacctactgcagggggaacaataaatgtaattgaggttaacaaagatcttagtttaatgacaaagacatacatatgtagtagagattgcactataaccatagataaagaggaagctcagattatcttccaaacagataagctaaatcattttgaagtgtctggcactacattaagttcaggatggtttaaaagcaaggcgtctgtcaccctagatagaacctgtgagcatgttaaggttacttgtggaaagaaatctctgcaattccatgcatgttttaaacaccacatgtcatgtgttagattcttccacaataccatattacctggcaatatgataacctcaatgtgccagaatatagaattaataattatcttagggctaacattagccatattcatattaatggttatgcttacaaaaacttatatatgttatttactgatgccaattttcatgccgatagcttatctttatggttgggcctacaataagagctgcaaaaagtgcaactgttgtggtttagcataccatccatttactaattgtgggtcacattgtgtttgtggcctgaaatttgaggcatcagatagaatgagaatccatagagaatctggcttgtgtcaagggtacaagagtttacgaattgccagacttttgtgtaaatctaaagggtcatctttagttatatctggattactgtccatgttaatcttaagcttcgtaacgcctatagaggggactataactagctacccagagagcagaaaatatacactggaagagataacagatgttgttgaaggactggtatctgagcagaatataaaggagtacattgttttctatacctcattgtttggaagtttaatactattattagcatttataatgtctataactttaagcaaaataacaagcatattagcaaaaagaaatgttatttattgcgaagaatgctcaatgtatcattcaaaaagaggcataaagtacaatggtgacttcacaaacaaatgcggcttttgcacatgcaatgaacaagaggatacagaaggattagtaatacataaagttagtaagagatgcacatataaataccagctaaagtgggctaaagtgctgatgatcacactagtcttgcttctaatagcgcaaaacactattctaattgttgcagctgaaacagattgctggacgaaaaaaagcctagatatagactgtataggaccaatgctagatataggctcttgcacaaataagaataccagaagctatgatgcagaagcacagaaattggtgagccagtctaaaataagtcaactagatgcagaccaagcatcgttgttaggcaactctatagatagtgctattaaggcaatcagagcccagaaaacttaccctacaatgcatttgttggaaacaatattcttaatgaaaaattgcgattattacacgagtttcaaccataacagtggctattcacaagccaaatggcgattgattgcaaaaacaggacactttgacatatgctccagacatagcacccaccatttctgccgatgtataaatgatggaaccaaatgtcagaatggtgattgggatttcgctggtgaaatgaatgaaacttacaatagcaaaaatgatttttattcacatgatctgaatttgttttacacaatttttgaaaatgcattcccaggaacaactgaatccttattttatcaattgatccaaaagaaaaatactacaggggcctccaaaatcttggggaagttaataactaaatatggtaataataacatggtcgttggagtctggaaatttggacagtacttacttacattaccatatataaataatactgaattgagccagaataggagactaacaatcctggcaacacaagaactattaagtaggtcgcactctggcaggcaggagtctatgtccaatgcaattcagggcagtattacaaaagaatgccataatgcaaaaggtgttgggtgcataagtcctcggtttggtattccaattggtaaccttacagcatgtggtgactcacctaattataagatatataagactccagaaaaattgtataaatcaaataataaaggggaagtttggtgttcaaatgatgttcactgcctgaatgattttgagcctgcagatgaagaagttgtcaataaaattaagaaactcacttgcttcttaacagacgtctcagttgaagtagacatcttttcagtggctgcatccacatgtaagatggcagacaaaggcgtctgtacagtaaatggtgctaaatggaatataatcaagtgtgatagtggattatactattttacagaccatagagaaggccaagacacaggcaatgactttggtgagtattgtatatctcacagttgcaatactgagcgattccctatcaacccagacacattaaaagattgtacttgggagttccattccagaaagtctaaatatatttcaaccatcagtttggaatcattggaagaattcaggagggcaatggcagagaagttatcacacaccctgacaatttacaattttaaaccaacagctaaccttcctcatattaggccaacctacaaattcattacagccaatggtgtcgaaaactctgacggtattgaatcagcatacatcttgtctagcatccctgcattaggtggaattagtgttggttataatgttcaaaccaaagacaacttcccattattggatataattgtatttattaaaagcgcagtcatcaggacaacatacaatcatatttatgataccgggcctactataggtataaacacacaacatgatgagcactgtacggggccgtgcccagctgtggtgccacataaagagaattggatgacattttctcaggaaagaacaagcagatggggatgtgaagaatttggttgcttggccatcaacacagggtgtgtttttggttcttgccaagatataatacatccagaaactaaagtataccgcaaagcagtagaagaggaagttgtcttaacggtgtgcatcaattttccaggcaataattactgcactgaaataaatgccattgagcctaagataacagatgagatagaactccagttcaaaacagtcgatacaaaaaccttacccaaccttcttgcagtgcagaatcacaagctttacagtggccagataaacgatttgggctctttttcacaaggttgtggaaatgtccaaaaaacaaatcactcaatcctaggcatgggtacagtcaaatttgattatgtctgtcacggcgctagtaggaaagatgtgatagtcaggaggtgctacaacaataattttgattcatgcaaattactgaaagaagaaacatcattaatatttgcagataatcatgagactctagaggtagcacacacaaagcatctgataggtgaattacagtttaagataatgttaggagatataagatacaaatcatttgctgaatcacctgagttggaaattgatgcaaaatgtgtcgggtgtccatcatgttttgaaagctactcctgcaactttcaaatagtgacaaatatagacactgtgtgctcagtcgaagggccatgcacactatttcataatcgaattattatatcagctaacaaacagtcatatgggcttaaaatgagttgccaaacaaagcctaaccaaaatgaagagttcattatctgtaacaggaaatacagtgtcttattcacaacaattgataaaaatgacaaaatagaagtgaacacaggggaccagacctcatatatttatgaaaaggacagcagatgtaagacttggttgtgcagggttagagatgaggggatcagtgtcctatttgaaccattgaaagcattctttggaagttattttagcataatattttatgttgtcgttggaattattgtccttttcttgattatatacatatttttgccaatgttcttcaaattaaaagatgttttgaaaagaaatgaatatttgtatcttcaggaactgaaacataaatga

SEQ ID NO: 4164 - RNA, 4305 nt, synthetic construct
  misc_feature 1..4305: note = derived and/or modified CDS sequence (wt) from CVV(WI-03BS7669)__KX100152.1__GP
  source 1..4305: mol_type = other RNA
atgctattcctgctcatactagcctttttagggttctcaacaagcaaccctattgcaactaggtgtttccatgggggccaattaatagcagagtcaaagtctgctacatctatatcagaattctgcctcaaggatgatgtctcaatgttaaaatctgaagtggtatacataaagaatgatactggattgtttggtcataataaagttttccgaagctggacaataaaagattggaaactctgcaatcctatacctactgcaggaggaacaataaatgtgattgaggttaacaaagatcttagtctaatgacaaaaacatacatatgtagtagagattgcactataaccatagataaagaggaagctcagatcatcttccaaacagataagctaaatcattttgaagtgtctggcactacattaagttcaggatggtttaaaagcaaggcgtctgtcaccttggatagaacctgtgagcatgttaaagttacttgtgggaagaaatctctgcaattccatgcatgttttaaacaccacatgtcatgtgttaggttcttccacaataccatattacctggcaatatgataacctcgatgtgtcagaatatagaattaataatcatcttagggctaacattagccatattcatattaatggttattcttacaaaaacttatatatgttatttactgatgccaattttcatgccgatagcttatctttatggttgggcctacaataaaagctgcaaaaagtgcaactgttgtggtttagcataccatccatttactaattgtgggtcacattgtgtttgtggcctgaaatttgaggcatcagataggatgagaatccatagagaatctggcttgtgtcaagggtacaagagtttacgaattgccagacttttgtgtaaatctaaagggtcatctttagttatatctggattattgtctatgttaatcttaagctttgtaacgcctatagaggggactataactagctacccagagagcagaaaatatacactagaagagataacagatgttgttgaaggactggtatctgagcagaatataaaggagtacattgttttctatacctcattgtttgggagtttaatactattattagcatttataatgtctataactttaagcaaaataacaagcatattagcaaaaagaaatgttatttattgcgaagaatgctcaatgtatcattcaaaaagaggcataaagtacaatggtgacttcacaaacaaatgcggcttttgcacatgcaatgaacaagaggatacggaaggattagtaatacataaagttagtaagaggtgcacatataaataccagctaaagtgggctaaagtgctgatgatcacactagtcttgcttctaatagcgcaaaacactattctaattgttgcagctgaaacagattgctggataaaaaaaagcctagatatagactgtataggaccaatgctagatataggctcttgcacgaataagaataccagaagctacgatacagaagcacagaaattggtgagccaatctaaaataagtcaactagatgcagaccaagtatcgttgttaggcaactctatagatagtgctattaaggcaatcagagcccagaaaacttactctacaatgcacttgttggaaacaatattcttaatgaaaaattgcgattattatacgagtttcaaccataacagtggctattcacaagccaaatggcggttgattgcaaaaacaggacattttgacatatgctccagacatagcacccaccatttctgccgatgtataaatgatggaaccaaatgccagaacggtgattgggatttcgctggtgaaatgaatgaaacttacaatagcaaaaatgatttttattcacatgacctgaatttgttttatacaatttttgaaaatgcattcccaggaacaactgaatccttattttatcaattgatccaaaagaaaaatactacaggggcctccaaggtcttggggaagttaataactaaatatggtaataacaacatgtttgttggagtctggaaatttggacagtacttacttacattaccatatataaataatactgaattgagccagaataggaggctaacaatcctgacaacacaagaactattaagtagatcacactctggcaggcaggagtctatgtccaatgcaattcagggcagtattacaaaagaatgccataatgcaaagggtgttgggtgcataagtcctcggtttggtattccaattggtaaccttacagcatgtggtgactcacctaattataagatatataagactccagaaaaattgtataaatcaaataataaaggggaagtttggtgttcaaatgatgttcactgcttgaatgattttgagcctgcagatgaagaagttgtcaataaaattaagaaactcacttgcttcttaacagatgtctcagttgaagtagacatcttttcagtggctgcatccacatgtaaaatggcagacaaaggcgtctgtacagtaaatggtgctaaatggaatataatcaagtgtgatagtgggttatactattttacagaccatagagaaggccaagacacaggcaatgactttggtgagtattgtatatctcacagttgcaatactgagcgattccctatcaacccagacatattaaaagattgtacttgggaattccattccagaaagtctaaatatatttcaaccatcagtttagaatcattggaagaattcaggagggcaatggcagagaagctatcacacaccctaacaatttacaattttaaaccaacagctaaccttcctcatattaggccaacttacaaattcattacagccaatggtgtcgaaaactctgacggtattgaatcagcatacatcttgtctagtatccctgcattaggtggaattagtgttggttataatgttcaaaccaaagacaacttcccattgttggatataattgtatttattaaaagcgcagtcatcaggacaacatacaatcatatttatgataccgggcctactataggtataaacacacaacatgatgagcactgtacagggccgtgcccagctgtggtgccacataaagaaaactggatgacattttctcaagagagaacaagtagatggggatgtgaagaatttggttgtttggccatcaacacagggtgtgtttttggttcttgccaggatataatacatccagaaactaaagtataccgcaaagcagtagaagaggaagttgtcttaacggtgtgcatcaattttccaggcaacaattactgcactgaaataaatgccattgagcctaagataacagatgagatagagctccagttcaaaacagtcgatacaaaaaccttacccaaccttcttgcagtgcagaatcacaagctttacagtggccagataaacgatttgggctctttttcacaaggttgtggaaatgttcaaaaaacaaatcactcaatcctaggcatgggtacagtcaaatttgattatgtctgtcacggagctagtaggaaagatgtgatagtcaggaggtgctacaacaataattttgattcatgcaaattactgaaagaagaaacatcattaatatttgcagataatcatgagactctagaggtagcacacacaaagcatttaataggtgaattacagtttaagataatgttaggagatataagatacaaatcatttgctgaatcacctgagttggaaattgatgcaaagtgtgtcgggtgtccatcatgttttgaaagctactcctgcaactttcaaatagtgacaaatatagacactgtgtgctcagtcgaagggccatgcacactatttcataatcgaattattatatcagctaacaaacagtcatatgggcttaaaatgagttgccaaacaaagcctaaccaaaatgaggagttcattatctgtaaccggaaatacagtgtcttattcacaacaattgataaaaatgacaaaatagaagtgaacacaggggaccagacctcatatatttatgaaaaagacagcagatgtaagacttggttatgcagggttagagatgaggggatcagtgtcctatttgaaccgttgaaagcattctttggaagttattttagcataatattttatgttgtcgttggaattattgtccttttcttgattatatacatatttttaccaatgttcttcaaattaaaagatgttctgaaaagaaatgaatatttgtatcttcaggaactgaaacataaatga

SEQ ID NO: 4165 - RNA, 4317 nt, synthetic construct
  misc_feature 1..4317: note = derived and/or modified CDS sequence (wt) from CHLV(CHLV-Mex07)__JN808310.1__GP
  source 1..4317: mol_type = other RNA
atggaaccttcaataaagttgttcctaatacttgcaattgctgcagctgctgtccacagcctacctgcatccagatgttttagcgaaggcatcgttataaaggaaaaacaagactctaaagcagtcagtgagttttgtttgaaggatgatgtatcaatgataaaatctcatgttgtatattctaaaaatgaatctggaatatttgcaaacagccaaattttaaggaaatggataataaaagactggaaactctgcagccccctaccaacagccggaggccagataaatgttattgaaattaatcatgatttaacattatcaacaaaaacctatgtgtgcactacagattgtaccataggcattgacaaggaaaatgcacagataacatttcaaaccaacaaattaaattattttgaggtctctggaaccacaattagctcaggatggttcaaaagtaagacaagtgtgtcacttgaccaaacatgtgagcatctaaaggtttcatgcgggaaaaaatctatgcaattccatgcatgctttaagcaacatatgtcatgcattagatatctacataggacagcattgccaggttatatggctgcttcaatttgcagtaatatagagttaattattatgaccacattaacactggcaatattcatcctactgtgtattataaccaaaacttacatttgttatctacttatgccactattcatgcctattgcttacatatatggttggttatataacaagagttgcaaaaagtgcaactgttgtgggttatcttatcacccatttactaattgcggctcttattgtgtctgcggggctaaattcgaaacatcagatagaatgcggatacatagagaatctggcttatgccaaggttacaaaagccttagagttgcccggaaattatgtaaatccaaaggctcatcactagtgatatcaatcaccctctctgtattcatattctcatttattacaccaatagggggtgctattataaatgataaattatcagaagaaaagtacagcataaatcaaatgatggatgctatcgtagaccttgaaaacttctctcataatgtttcaggcacacaacaagttatttcagtaatattcttattaatatcctgtttgtttttgttattaacataccacctcaataaaattatacagcacttagctaggtttggcttattattttgtgaagaatgttccatgtatcactcaaaaaaagatataaaatataatggggatttcacaaacaaatgtggcttctgtacatgtggtcaaccagaagacccagaaggcttaaaccttcatatactgtcacaaaactgcacatataagcagcaatttaaatgggtgaaaataattattagtatattactatctctaataattatagaaaatagtatgatactggcagcagcagagacagattgcttctctgaaaagcaaatttcagaattctgcctaggaccattgctgtcaatttcaagctgtgaagataagaattctaggacatttaaaggtgaagcacaaaaactagtagcactgaagaaaataacttccgatgaagcaatgttgattgaatcaatgggtgccaacgtggagggtgcattggaaatgatacaagctcaaaagtccccggactctatgtatactatggagtatgtgttcctaaatacatattgtgattattactctctttttgagcacaacagcggttattcacaagtaaaatggcgttatatccttaagacacatcaatttgatgcatgtgcaaggcattctaacagccacttttgtagatgtatgagtgatgggatgcattgtcccagctcggattgggatatagcagatgaactagataacacatatataacaaaaccaaatttctttaagcatgattacaatctattattagatgtaataactgcagcatttccaggaacaggtgctgtttttgtaattgatgcttgtaagaaagcaaatgctacagcaatcaagactttctctaataatattatagctagatttccatataacaacttactaaaaggagtaatgaaattcctgcagtatataagtaagcatccatcttttaaaaagtatcaaccagatacacggcactatgacctaatcccagtagcacccactgcaagaggtaggtctctaggaaggtcaaatagttacaataatgcacagattggttccccaacaaaagattgccaaatgctgaaagaagttggttgcctaagcccaaaatttggtctgcctctagaaagtattatatcttgtggttcatcacctaactacaaactatataaaaaaccccaaaaatattacaaatcaaacaacaaagaaaacacttggtgcagcaaagatgtacattgcctccatgactttgaaccaataacagaggatgttttagaaaaagtaaaagtcatgacatgttgggagatagaaccaggaactattgaagacatcttcaccattgcatcagagacctgcaaaatcaatgatcgtggcgtatgtgaagtgaatgcagcaaaatggaagattgtgaagtgtgagacaggtctctactattacactgaccatagagagggtgatgatactgggtcagatttagggcactactgcctgacgcataagtgtgcagggggaagatatcctatcaatcctgaaattttacaaaactgtgtttgggaatttcattcgcagaagtcgcagtatatcaatcaagttgatcttgagcaaatagaagaatacaaaaaggccctaacagagaagctaactcatactttaaatcattataattttttacctactaagaatctcccacatatcagccctaattataaatatgtaaccctgaatggccaagaaacctctgatggcatagaaaactcttacatagtgtcagagatacctgcaattgcaggtacatcaattggcctcaaagtacaaacaaaaactaatgacgacatatttgacctgattatatatgtaaagagagctgatattattgcaagctataatcatatttatgacacagggccaactattggccacaatgtagaacatgaggagttatgcacaggccaatgtcctcaacatataccagctaaagccaattggctcacattttctcaggaaagaacaagtagatgggggtgtgaagaatttggctgcttggctataaacacaggctgtgtgtatggctcctgccaggatattataaaaccagtggcaaaagtttacaggaaatccacagaagaaaaagttgaacttgagttgtgtatagtattaccagataagaatttttgtactactctaaatgcattagagcctaagattacagaagagatagagctacaattcaaaactatagatcaaatgagccttcctaatatagttctactgagagaccataagctatttaagggccaaattaatgatttagggacctttgggcaaaactgtggcaatgttcaaaaaactaaccaaagtatcttgggagccggtacagttagatttgattacctatgccatagtgcatccagaaaagatataatcatacggaggtgctacaataataactatgattcatgtaatcatttacaacttgcagaatctttaatttttctggacaatcatgaaacactagaggtcaggaaaccaaaccatattttaggaaccctgtcaatgaaattaatgctaggcgattttcaatataaaacatttgctaaggacatagagcttgattttactggtagatgtgttgggtgtatcggttgttttgaagggtttgtctgcgagatgcatattacgacaactgtagaagcaacctgtaatctagaggcttcatgccaattctttcataaccaactgcatattaaaccagatgtactgaagtactatacaaagatgacatgccaaactgatgagtatataccatcaaagatcaaaatatgcaataaagaatacaaaatcactgttggaaaagtccaaaaaaatgataaaattgaaatagataatagtgatcagaccagttatataaaagaaaaagatgagaggtgtaaaacttggctctgccgagttagggatgaagggatatcagtaatctttgagccattgctaaatatattcggcaactatggaaggattgcagttgcagtcattagtgcaatattggcattgatcatactagtatacatcttaatgccaatatgtatgagaataagagatatactcaagactaatgagagggagtttctaattgaatcaaaatacaagtag

SEQ ID NO: 4166 - RNA, 4305 nt, synthetic construct
  misc_feature 1..4305: note = derived and/or modified CDS sequence (wt) from FSV(86MSP18)__KX100131.1__GP
  source 1..4305: mol_type = other RNA
atgctatccttgctcatactagcccttttagggctctcgacaagcaaccctattgcaactagatgtttccatgggggtcaattaatagcagagtcaaagtctgctacatctatatcagaattctgcctcaaggatgatgtctcaatgttaaaatctgaagtaatatacacaaagaatgacactggattatttggtcataataaagtctttagaagctggacaataaaagattggaagctctgcaaccctatacctactgcaggaggaacaataaatgtaattgaggtcaataaagatcttagtctaatgacaaagacatacatatgtagtagagattgtactataaccatagataaagaggaggctcagattattttccagacagataagctaaatcattttgaagtatccggcactacattaagttcaggatggtttaaaagcaaggcatctgttaccctggatagaacctgtgagcatgttaaagttacttgtggaaagaaatctctacaattccatgcatgctttaaacaccacatgtcgtgtgttaggttcttccacaataccatattacctggcaatatgataacctcaatgtgccagaatatagaattaataattattttaggattaacattagccatattcatattaatggttatgattacaaagacttatatatgttatctactgatgccaattttcatgccgatagcttatctttatggttgggcctacaacaagagctgcaaaaagtgcaactgttgtggtctagcataccatccatttactaattgtgggtcacattgcgtttgcggcttgaaatttgaggcatcagataggatgaggatccatagagagtctggcttgtgtcaagggtacaagagcttacgaattgccagacttttatgtaaatctaaagggtcatctctagttatatctggattgttgtctatgttaatcttaagcttcgttacacctatagaggggactataactaattacccggacagcaggaaatacacattggaagagataacagatgttgttgaaggattgatatctgagcagaatataaaggagtacattgttttctacacctcattgtttggaagtttaatactgttattagcatttataatgtctataactttgagcaaaataacaagcatactagcaagaagaaatgtcatttactgcgaagaatgctcaatgtatcattcaaaaagaggcataaagtataacggtgacttcacaaataaatgtggcttttgcacatgtaatgaacaggaggatgcggaaggagtggtgatacacaaagttagtaagagatgcacatataaataccaactaaagtgggctaaagtgctgatgatcacactggtcttgcttctaatagcacaaaatactattctaattgttgcagctgaaacagattgctgggcaaaaaaaagcctagatataaactgtataggaccaatgctaaatataggctcttgcacaaataaaaataccagaagctatgatacagaagcacagaaattagtgagccagtctaaagtaagtcaattagatgcagaccaagcatcactattaggcagttctatagatagtgctattaaggcaatcagagcccagaaaacctatcctgcgatgcacttattggaaacaatattcttaatgaaaaattgtgattattacacgagtttcaaccataacagtggctattcacaagcaaaatggcgattgattgcaaaaacaggacacttcgatatatgctccagacatagcacccaccatttttgccgatgtataaatgacggaaccaaatgccagaatggtgattgggattttgctggtgaaatgaatgaaacttataatagcaaaaacgatttttatttgcatgatctgaatttgttttatacaatctttgaaaatgcattcccaggaacaactgaatctttattttaccaattaatccaaaagagaaatactataggggcctccaaagtcttagggaagttaataactaaatatggtgataataacatgtttgttggagtctggaaatttggacagtatttgcttacattaccatacataaataacactgaattgagccagaataggaggcagacaatcttggcagcacaggaactatcaagtagatcacaccctggcaggcaggagtctatgtccagtgcaattcagggcagcgttacaaaagaatgccataatgcaaaagatgttgggtgcataagccctcggtttggtattccaattggtaaccttacagcatgtggtgactcacccaattataagatatataagactccagaaaagttgtataaatcaaataataaaggggaagtttggtgttcgaatgatgttcactgcctgaatgactttgaacctgcagatgaagaagttgtcaacaaagttaaaaaactcacttgtttcttaacagatgtctcggttaaaacagacatcttttcagtggctgcatccacatgtaagatggcagataaaggcgtttgtacagtgaatgatgctaaatggaatataatcaaatgtgatagtggattgtactacttcacagaccatagagaaggccaggacacaggcaacgattttggcgagtattgtatatctcacagttgcaatactgagcgattccctatcaatccagacatattaaaagattgcacctgggaattccactccagaaagtctaaatatatttcaactatcagtttagaatcattggaagaattcaggagggcaatgacagaaaagctatcacacaccttaacaatttacaattttaaaccgacagctaatcttcctcatattagaccaacctacaaattcattacagcaaatggtgtcgaaaattctgacggcattgaatcagcatacatcttgtctagtatccctgcattaggtggaattagcgttggctataatgtccaaaccaaagacaatttcccattgttggatataattgtgttcgttaaaagtgcagtcatcaggacaacatacaatcatatttatgatactggacctactataggtataaacacacaacatgatgagcactgtacagggccatgcccagctgtggtgccacacaaagaaaactggataacattttctcaggaaagaacaagtaggtgggggtgtgaagaatttggttgcttggccatcaacactgggtgtgtttttggttcttgccaagatataatacatccagaaaccaaagtatatcgtaaagcagtagaagaggaagttgtcttaacagtgtgcattaattttccaggcaataattactgcactgaaataaatgccattgagccaaaaataacagatgagatagagctccagttcaaaacagtcgatacaaaaaccttacctaatcttcttgcagtgcagaaccacaagctttacagtggccagataaacgatttgggatctttttcacaaggttgtggaaatgtccaaaaaacaaatcattcaatcctaggcatgggtactgctaaatttgattatgtctgccatggcgctagtaggaaagatgtaatagtcaggaggtgctacaacaataattttgattcatgcaaattactaaaagaagaaacatcactggtatttgcagataatcatgagactctggaggtagcacacacgaagcatctgataggtgaattacagtttaagataatgttaggagatataagatacaaatcatttgctgaatcgcctgagttggagattgatgcaaaatgtgtcggatgtccatcgtgttttgaaagctactcctgcaattttcaaatagtgacaaatatagacactgtgtgctcagttgaagggccatgtacactatttcataatcggatcattatatcagccagcaagcaatcatatggacttaaaatgagttgccaaacaaagcctagccaaaatgaagagttcattatctgcaacaggaaatacagtgttttatttacaacaattgataaaaatgacaaaattgaagtgaatacaggggaccagacttcatatatttatgaaaaggacagcagatgtaagacttggttatgtaaggttagagatgaagggatcagtgtcctatttgaaccattgaaagcattctttggaagttactttagcataatattttatgttgtcgttggaattattgtcctttttttggttatatacatatttctgccaatgtttttcaaattaaaagatgttttgaaaaaaaatgaatatttgtatcttcaggaactgaaacacagataa

SEQ ID NO: 4167 - RNA, 4314 nt, synthetic construct
  misc_feature 1..4314: note = derived and/or modified CDS sequence (wt) from GERV__M21951.1__GP
  source 1..4314: mol_type = other RNA
atggctatctcaacatcactgttgattgttgcccttctaatcaagttgtgtttggtcaacactgctccaccaatctcaaaatgcttccaagatgggattctgatagcagaactaaagagctcatctggaatatcagaattttgtataaaggatgatatatctatcctgaaatcagaaatcacttactcaaaaaatgacacaggcatattcatgcatagtaaggtatttagacattggactgtagcagactggaaacaatgcaaccatacttctgctggtggtagcactaatgtgctagaagttgataaaaatttaaatttagttgcgaaaaactatatgtgcacaaggccatgtgtcataacaattgataaggagaatgctcaacttttgttccagacagagcaattgaatcaatttgaagtaacaggcacaactataagcactggctggtttaaatcaaaaacatcggtctcactagacaacacatgtgaacatataaaggtaacttgtggaaaaaagagcctacaatttcatgcatgcttcaaacaacatatgtcttgtgttcgcttcttgcataggagtgttttacctgggtacatggcaagttccatatgtcaaaatatagagctcataattattattattttaacgctggcaatatttatattcatgtgcattattacaagaacatatatttgttacttgatgctccccttatttgcccccattgcatatctatacggttggctgtacaacaggagctgcaaaaaatgcatatgttgtgggcttgcttatcacccattcacaaattgtggctcatattgtgtctgcggttctaggtttgaaacatctgatagaatgcgactacatagggaatcggggttgtgtcaaggattcaaatcactcagagtcgccagatcactatgcaaatctaagggctcttctcttgttatttctatactgacagctatgttaatattgtcatttataacaccactcgaagcaatgaccacgaactaccctgatgataaaaaatttacacttaaagaagtaaatgatattgtccttggcagagatatggagcaagagttaaaatcttcgatattgattttaatgtccatatgtggaatagggattatactgatattcttcggcttaactgtactcttggagattgtactagagctaattgcaaagaggagcacaatattttgtaaagaatgcaacttaatacacgacaagaaatcaatgacatacaggggcgattttactaataaatgcggtttttgcccatgtggagaattagaggacccagaggggttagtgattcacactacaaggaaatcatgtacatattatatcaagataaggaatcttaaactaataatgctaatcttctcaattgtaattttgatgcaaaatgcaactatgcttgtagttgctggtgagaactgctggacaaatacagagattaaagctgactgtgttgggcctttgatagggccatcagcatgcacaaacaaaggctcaaaaacatacaagacagtcgcacaagaattagtgactgcaagcaaaattacacaactagatgctgataaatatgtcttgctaggagatactatagaaagtgccctggatgctataacaagccaaaaacattactcggcaatgcacctattagagacaatgttcttgatgaagcattgtgattactacaaagtgtatgaacacaatagtggctactcacaaacaaagtggagactaattgcaatagcaaatagtttcgatatatgtactaatacaccaacaccaaacttttgtaaatgcttgtcagattccagttgctcaacaactacgctaaactttgccacatcaatgaatgccacatatacgagcaaggtagaattctttaaccatgacttcacacttttcctggacatttttgaggctgcattcccaggtagtgctactgcattcctttttaaaaagattaaagaaaagaacccataccaggcatttgaaatgatggggaaaatcgctaataaatatccaaacaataagctattggttgttattctaaaatatggtcaatatatggttggcctgagccatgcatctacatatcaattgaaacaagaatgggttgccaaatcactgagcttaactagagcacagagaactggcctaaaaatgtccatggctaacgctgaaccaggtcctgccactaaagaatgttcagatgcaaagacaattgcttgcttgaccccaaagttccaagtagaagtcaataatctcatgagctgtggtgcatcaccaaatttcaaaatttatgttaaaacaggtgaattgtacaaggctcatgataggaattctgtatggtgtttaaatgatatgcattgtctaaccccttacacaccagcaaatgcagaaataattacgaccatgaaaaaaatggactgttggcaggacaacccgaaacaacctacagatgaatatgctatccctaagaggagctgccagatgaaagacaggggcttatgcaactcaggtgcagacaaatggaagataataaaatgtgacaatcataaactcttctatacagatgcactagagagacgtgatccagctagcatagtgggttccaatcactgcttctcagaaaaatgccaaatagagaggtacccaatcaacccaactagcttaacaaactgcgagtggttgtacagggctgttaggcccgaatacattaaaaaactctctttgcaaactattgaggaatataaaaaagctattgcagataaactaacacatacactgcaactataccattttgccccattattagagaacctgccacacataaaaccaacgtataagtatatcacagcacaaggaacatatacagcagatggtatagagggtgctagtatcacaacttcgatacctgccttgagcggcactagtgtaggattcaaaataaatgctaaggatggaactgaccttctagacattgttgtttacataaaggcttcagttgtcaaaagtatttacaaccatatatatgacacaggtccaacaatcaatataaattcaaaacatgatgagctatgcactggtcaatgcccaaaaaagatacctgctgacccaaattggcttacattttctcaggagagaactagcagatggggctgcgaggaatttggctgcctggctataaatactggatgtgtttatgggtcatgtcaggatgtgattaggacagaaacaaaagtatacaggaaagcaaatgaggaaactgtcatgctaacagtgtgcataacttatcctggccacacattttgtactgatgtaaatgcccatgaaccaaaaataacagatgaattagaattacagttcaagacaattgatatcaagagtttaccgaacctagtagcagtcactaatcataaattgtatactggacaaattaacgatttaggtacatttggacaaatgtgtggcaatgtacaaaagaccaacacaagccacactggtgcaggaacaccaaagtttgactacacttgttatagtgcaagcagaaaagatatcataatcaggagatgttataataataattatgactcatgtaggcttttaaatcaagagagtgatctcttattcgacgacaatcatgaaactttggttgtatataataacaagaggctgaatggagaattagctctcaagttattgcttggagatattcaatacaaactttatacagaaaacatggagctagagttggaagctaagtgtgttggttgtgtagggtgctttgagagttatcaatgcaatttgcagataacatcaagcctagacgaaactgcgctatatctggtccctgtgagccactttcatgataggattcaaattaaaactacaaagaaagattacgctatgaaaatatcgtgcactagagacccaggagataaagcatcattcagagtgtgtgggaagagttatgactttaattttcatacagtaccaaagaatgacaaaatagaagttaatgttggggatgagacatcatatatcaaagaaaaagacaataggtgtgggagatggttatgtagagttcgagatgagggattgagtgttatatttgaaccattaaacaatttctttgggaattacctcaatatgtttttatatatattgggtggtatcatactactatttctggccctctatatactgatgcccatgtgtgctagattgagggatgagctaaagagaaatgaaaggctacatcagatggaaatgaagaagagataa

SEQ ID NO: 4168 - RNA, 4260 nt, synthetic construct
  misc_feature 1..4260: note = derived and/or modified CDS sequence (wt) from IACOV(BeAn314206)__JN572066.1__GP
  source 1..4260: mol_type = other RNA
atgagggttattgcattgtttcacttagtgatggttattacagccaatccagtatttcacagatgcttccaaggggggcaattaattttggagaaaaaatcacatgtgtctatgtctgaattttgcctgaaagatgatgtctcaatggttaaatcagttgtagaatatgaaaagacaaacaattctatagtagggacaaataaagtttatagacaatgggttgtttcagactggaagctttgccaccctattaaagcagaaggtgggggaatcaatataatagaagtagaaaaggatttaactatcaaatctaatacatatatatgtacaacagactgtacaataactgttgataaagaaaatgcacaaataatatttcaaacatcaaaattaaatcattttgaagttacaggaactacattaagtactggatggtttaagacaaaagcagcagtgacattagatcaaacatgtgaacatataagggtttcttgtggtaaaaaatctatacaatttcatgcatgttttagacaacatatgacatgtgtgagattcttacacagaagccttctaccaggatctatggccaattctatctgccaaaatgtagaattaataataataattgtgttaacattattaatctttattgttttaaatataatagcaaagacttacatttgctatctaatgttgccaatatttatgcctattgcttatatatatggctggatatataatcgtagctgtaaaaaatgtgttaattgtgggttagcatatcatccatttagtaattgtggatcacattgtgtatgcggagctatatttcaaacatctgataggatgcgtatgcatagagaaagtggcttatgttctggtttcaaatctctacgtgttgcaagagttttatgtaaatccaaatcatcttcattggttattgccatattaagctcactattaatcttatcatttgtaaccccaatagaaggattggatttagaagaaaagaaatatagcttatctgatctgccagatatttacacaaaagaattgaacacattatcagaaaaaattgctataaatttttatatatcaatcacaaatatgttaataacaataattcttttaattgtagcattttgttcacactgtattacaaataagatagtaaaatataaagcctttttatgtacagaatgtgatatgtatcatacatataaaaatattaggtacaatggtgatttctgcaataaatgtgggagctgcacatgtggaacaatggaggacccgaattacacaactatgcataaggtaagtgatctttgcctagcagaacctaagagaattattcaaaaaaagctaatgattatcttaatcatatttgtaattattgaaaatggagcctgtttagcatctgcagaagaaaaatgtttcaaagaacatgattacaatattgaatgtattggacctctgataacaatgagaccatgtacaaaaaagacaatccaagaagttgctagaacattggtgactgacaaacaaatagctcaagaagacacagagaaaatagaattattaccagattcaattgtacaagcttggaatatgatagataatcagttaaattatgatcagatgtttctgatggaatatgcctttctaaagagagaatgctctttctttgaggaatttgagcataatagtggagtaaatcaaattatgtggagaacaatagcaaaaactggacattttgacatttgtgcaatcagatctagtcaaagattttgcaaatgtatgtcagagtcagtttactgtaaagatgcaaattgggatatagctaatgaaatgaatgatacatattcctttaagccattattctaccgacatgatgtaaaattatatagtaagatatttaaggcagcatttcaaggaacaacactgaaaacttatgaaaaattcttgaatgccaaaaacaaaacagaattaataaatatgctgaaaaagttagggaaaaggtttccttataacaacttacttatggggtttttaaaatttggtgaactgctatttgatttaactctgtttgatgcattgcctaaggataaaacatctagaacttcatcaaccacagcaaaacgagagtatgaaaacctgcaagatgcaaaagtcggagagccaactagtgaatgtaaagatatgaaattattacaatgcataagcccaagatatcaggtatcagtagggagtgttattaaatgtggagatacagagaaaaagatatatgacttccatactccagtttacaaacttgcaactgatgaaacaaagtggtgtagatttgacaaacattgcttgcatgaatgggtacctattgacaatgcaagattagaaatgttaaagaagttaaattgctggtacacagatccaacagaaatggttgatatatataccacatctagaaagtcttgcagaatgataaataagggtacatgcaacataaaaaatgcaccaatgacagtaatgcaatgtgatgatgatcttattttttatacagatcacaggtcaagtgctgatacccaaggagatataggagaatattgtctatcacaaaattgtgatgtaagcagatatcctataaatgtaatggatggaatgacctgcacatgggaatataatacagttaagcctaaatacctatcaaaaacagaactaaaaactcttgaagaatataaacgaacattgcaagacaagctaagccataatttagaagtctatcattttcatatgactgcaaatttccctcacataaaacctgtgtataagtatataactgcaggtggtgttgaaacaagtgatggaatagaaggagcatttatattagttgacctacctgctttatctggaacatctgtcgggctcacagtattatctaaagatgatgtaccattgatggatgttataatatatataaaatctgcagtgataaaagccacatataatcatatatatgatacaggacctacaattggaataaatgttaaacacgaagaattgtgcacaggaccttgccctcaaaacatacctcatcaagagcagtggttaacattttcacaggaaaggactagccgatgggggtgtgaagaatttgggtgcttggcagttggagaaggatgtgtgtatggatcttgtcaagacattataaagaaagaaactcgagtatataaaaaagtgagtgaagaaataaatgaaatcacattttgcataatatttcagacaaatacatattgtcagacaatgaatgcaatagagcctcaaattacaccttcactagaagttcaacttgaaggattagacactaagatattgccaaatatattagcactgcaaaatcacaagctttactctggtcaaataaatgatttaggatcgtttggtcttgcttgtgggaatgttcaacaagtaaacaaaacaatatacggtgcagggcaaccaaaatttgattatttgtgtcatggagcaaagcgtaaagacataattgttcgcaagtgctataacaataactttggctcttgcaaattgctaacaattgaagataatttaatagtggaagataattataatacaataaatgttataaatacaaaacatttaattggtacagttaaatctaaacttaatttaggagacataagatataaattattcaataaaaaacctgagttcgagctagaagcacattgtgtaggttgtgtgggatgttttgcaaattataattgtgaaataaaaattgaaagtacaatagatatgacatgcccaatctctgggccgtgtgagttcttccataataacatcttcatacaagctgaacatacaaagtatgccatgaagatgatctgtaagaagcaaccagatcaaacaacagaatttactatatgtgataaaaagtatcattttatcattgatacagttgaaaaacatgatcaaattgaaatagatgtcggggatcagacaagttatattctggaaaaagacaacagatgtgggacatggatgtgtaaggttttagatgaaggactaagtgtaatttttgagccattgaaattattgttaggaaattacttccatatggccatagttattataataggtttaattgcactagcagtaattatatatatcttgttgccaatgttcatgaaattaagagacactctaaaggcaaatgagattgcttaccaaaaagaaatgaaaataaaataa

SEQ ID NO: 4169 - RNA, 4305 nt, synthetic construct
  misc_feature 1..4305: note = derived and/or modified CDS sequence (wt) from ILEV(KO/2)__AY859372.1__GP
  source 1..4305: mol_type = other RNA
atgctatttcccataattttactgatgatacagctggtatcttcaacaccattgtcaacaaggtgtttccatgagggaactttggtcaaggagaagatatcaactacatccatctcagaattctgtctcaaagatgatgtctcaatgattaaatcagagataacataccaaaaaaatgatacaggggtatatggccatagtaaaatttatagaaattggatagttaaagaatggaaagcatgcaacccagtgccttcagcaggaggaagtattaatgtcatagaagtgaatgaagatatgagtttggcaacaaaaaattatatctgcaccagagattgtgtgataacagttgacaaggaagatgctcaaatagttttccaaacagataatttgaaccattttgaagtgtcagggactacattaagttctggctggtttaaaacaaaagcatctgttacattagatagaacatgcgaacatattaaagtttcttgtggcaaaaaaacagtacaattccatgcgtgcttcagaaatcatatgtcatgtgtaagatttttccacaatactattctgcctggatacatggcaacatcaatatgtcaaaatatagagctaataattataattgtattgactatagcaatctttattatgttagttatcttgacgaaaacttatatatgttatttattaatgccactctttatgcctattgcatactgttatggctgggcatataataaaagctgtaaaaagtgtaattgctgtggccttgcatatcacccatttactaattgtgggtcattctgtgtatgtggtttgaagtttgaagcatcagatagaatgcgaatacatagagaatctggcctttgccaaggttataagagtctaagagtagcacgaaggctgtgcaaatcaaaaggctcatcttttgttatatctatccttctgtcattgtttattttatcatttgttacaccaattgaaggtacaatgactaattatcctgaggaaaggaaatatacactagaggaaatagcagatgttatagaaggtttctaccaagaagctaagataaaagaatatattgttttttatagctcgatttttggctcatttattttaatttcctcaatgctgatattgtataaacttcaaaacataacatattttctgagcaaattcaacgtgatgtattgttcagaatgcagcatgtatcatagcaagaaaaatataaaatatctgggtgattttactaataaatgtggcttctgcacttgtggtgaattggaagatgctgaaggattaagtatacataaagtgacaaaaagatgtacatatgcatatcagatgacatggactaagataatactagcaacattgttaattctattaattggtcaaaacacgctgctggttgtatctgcacaagcagattgctgggagaaaacagaaatcacaatagactgtataggcccaatatttgcacccaatacatgtattaaacaagaagaaaaaacatatgcaaaagaagcacaaacacttgttgatcagaataaaatatcacaagcagacgcaaaacaagttgacatgttaggggcaacaattgacgatgccatcaaggcaatcaggtcacagaaaacatacacaacaatgcatatgctggaagccatattcctgagtaaatactgtgattattacagtctatttgaacataatagtggatattctcaaggaaaatggagactgattgcaaaaacagagagttttgacatttgtagtagacacactactcatcatttttgtagatgcatgagtgatgagacaaagtgtaagaatggtgattgggactttgctggagaaatgaattcaacttatcacagtaagagcaacttcctactacatgacttaagattattttacaaaatatatagtgcagcatttccaggattatcagaagcaatgctttataaatttttatcagaaaaagatacaacaaacgcaataaaattattggaaaaattattcacaaaatatagctacaataatttattggtagggatattaagatttggaaaatttttatttagcatgtcaattttcaatactactgaattgggtggtgctcaaaaagcaatgatattgagacctactgatgaactaagaaccacatattctggtaagcaagaatctttatcaaattcagttgttggcgaacaaacatcggattgtgtaaacatgaaaaaaatatcctgcattagtcctagatttaatattcctttatcaagtatgatagcatgtggaaaccaacctaattaccaaatctataaagaaccttctaaatattataaatctaataataagcccaacacttggtgcaataaagatatacactgcttaaatgattttgagtcaattgaccaatcagcccttgatagattaaaaacaatgacatgcttcctaatagatcctatcacaactgaagatgtatattctattgctattcatagttgtaaagtcaaagataaaggacagtgtacaataagagacaaaaaatggaatattataaaatgtgacagtgaactattgtattatactgaccacagagaaggagaagacacagggaatgaaattggccattattgtctaagtcataaatgtggaacagacagataccctataaatccagaaattattaaagattgtatctgggaattcagatcgagaaaatcagaatatataaatagagtagacttggagagcttggaagaattcaaaagagctttatcagataagttgacacacactttaaccatttataactttaaaccaactgctaatttacctcatataaagccaatttataaatatattactgctctgggagtagaaaattctgatggcctcgaggctgcatatatattaacaagtataccagcattaggaggaacaagtattggttataacattatgacgaaagacaatttcccggtaatggatgttataatctatgttaagagtgctgtaatacaaacaacttacaatcatatatatgatacaggaccgaccataggaataaattcaaaacatgatgaaaaatgcacagggtcatgtcctcaaaatataacacatgaccaaaattggttaacattttcacaagaaagggcaagcagatggggttgtgaagaatttgggtgtctagcaataaatacaggttgtgtatttggctcttgtcaagacatgataagatcagacacaaaggtttataaaaaggcattagaagaaacagtagttttaactgtttgcataaactaccctggtaacacattttgcactgaggtcaattctgtagagacaaaaatgacagatgatgttgaattacaatttaaaacagttgatactaagactttacctaacctccttgcagttactaatcataaattatacagtggccaaataaatgacttagggtcattcagtcaaatgtgtgggaatgttcagaagaccaattcaactgtaatgggtgctggtacagtgaaatttgattacatatgtcatggtgcaagtaggaaagacataattataagaaggtgttatatgaataattacgcatcatgttctttattaaaggaagaaaaagatttgatctttgcagataatcatgaaacaataacagtatctaattcaaaacatcttgtgggagaattgcaaattaaattgatgttaggtgatattcggtataaactatttgcagagagaccagagttagaggtggatgcaaaatgtgtaggatgtccttcatgttttgagagttattcctgtaatttccaaatagtcacaaatatagatactgtatgcacccttgaaggcccttgcactattttccataacagaattattatcagttctacaaagcaatcttatggtattaagatgagttgccccacaaaaccaaatcacatagaaaaattcaaaatctgcaatcatgaatatgatattctattcgatacagtggcaaaaaatgataaaatagagattgatacaggagatcaaacattattcgtgagggagaaagacaccaggtgtaagacttggttatgtagagtaaaagatgaaggtataagtgttatctttgagcctttaagagctttctttggaagttacttcagtattattttttatattattcttgctgcaatattaatatttgtgggtgtttatatatttttaccaatgtttatgagattaagagatgttcttaaaaggaatgaacatttatatttgcaagagataaaacataaataa

SEQ ID NO: 4170 - RNA, 4305 nt, synthetic construct
  misc_feature 1..4305: note = derived and/or modified CDS sequence (wt) from ILEV(R5964)__KF234074.1__GP
  source 1..4305: mol_type = other RNA
atgctatttcccataattttactgatgatacagctggtatcttcaacaccattgtcaacaaggtgtttccatgagggaactttggtcaaggagaagatatcaactacatccatctcagaattctgtctcaaagatgatgtctcaatgattaaatcagagataacataccaaaaaaatgatacaggggtatatggccatagtaaaatttatagaaattggatagttaaagaatggaaagcatgcaacccagtgccttcagcaggaggaagtattaatgtcatagaagtgaatgaagatatgagtttggcaacaaaaaattatatctgcaccagagattgtgtgataacagttgacaaggaagatgctcaaataattttccaaacagataatttgaaccattttgaagtgtcagggactacattaagttctggctggtttaaaacaaaagcatctgttacattagatagaacatgcgaacatattaaagtttcttgtggcaaaaaaacagtacaattccatgcgtgcttcagaaatcatatgtcatgtgtaagatttttccacaatactattctgcctggatacatggcaacatcaatatgtcaaaatatagagctaataattataattgtattgactatagcaatctttattatgttagttatcttgacgaaaacttatatatgttatttattaatgccactctttatgcctattgcatactgttatggctgggcatataataaaagctgtaaaaagtgtaattgctgtggccttgcatatcacccatttactaattgtgggtcattctgtgtatgtggtttgaagtttgaagcatcagatagaatgcgaatacatagagaatctggcctttgccaaggttataagagtctaagagtagcacgaaggctgtgcaaatcaaaaggctcatcttttgttatatctatccttctgtcattgtttattttatcatttgttacaccaattgaaggtacaatgactaattatcctgaggaaaggaaatatacactagaggaaatagcagatgttatagaaggtttctaccaagaagctaagataaaagaatatattgttttttatagctcgatttttggctcatttattttaatttcctcaatgctgatattgtataaacttcaaaacataacatattttctgagcaaattcaacgtgatgtattgttcagaatgcagcatgtatcatagcaagaaaaatataaaatatctgggtgattttactaataaatgtggcttctgcacttgtggtgaattggaagatgctgaaggattaagtatacataaagtgacaaaaagatgtacatatgcatatcagatgacatggactaagataatactagcaacattgttaattctattaattggtcaaaacacgctgctggttgtatctgcacaagcagattgctgggagaaaacagaaatcacaatagactgtataggcccaatatttgcacccaatacatgtattaaacaagaagaaaaaacatatgcaaaagaagcacaaacacttgttgatcagaataaaatatcacaagcagacgcagaacaagttgacatgttaggggcaacaattgacgatgccatcaaggcaatcaggtcacagaaaacatacacaacaatgcatatgctggaagccatattcctgagtaaatactgtgattattacagtctatttgaacataatagtggatattctcaaggaaaatggagactgattgcaaaaacagagagttttgacatttgtagtagacacactactcatcatttttgtagatgcatgagtgatgagacaaagtgtaagaatggtgattgggactttgctggagaaatgaattcaacttatcacagtaagagcaacttcctactacatgacttaagattattttacaaaatatatagtgcagcatttccaggattatcagaagcaatgctttataaatttttatcagaaaaagatacaacaaacgcaataaaattattggaaaaattattcacaaaatatagctacaataatttattggtagggatattaagatttggaaaatttttatttagcatgtcaattttcaatactactgaattgggtggtgctcaaaaagcaatgatattgagacctactgatgaactaagaaccacatattctggtaagcaagaatctttatcaaattcagttgttggcgaacaaacatcggattgtgtaaacatgaaaaaaatatcctgcattagtcctagatttaatattcctttatcaagtatgatagcatgtggaaaccaacctaattaccaaatctataaagaaccttctaaatattataaatctaataataagcccaacacttggtgcaataaagatatacactgcttaaatgattttgagtcaattgaccaatcagcccttgatagattaaaaacaatgacatgcttcctaatagatcctatcacaactgaagatgtatattctattgctattcatagttgtaaagtcaaagataaaggacagtgtacaataagagacaaaaaatggaatattataaaatgtgacagtgaactattgtattatactgaccacagagaaggagaagacacagggaatgaaattggccattattgtctaagtcataaatgtggaacagacagataccctataaatccagaaattattaaagattgtatctgggaattcagatcgagaaaatcagaatatataaatagagtagacttggagagcttggaagaattcaaaagagctttatcagataagttgacacacactttaaccatttataactttaaaccaactgctaatttacctcatataaagccaatttataaatatattactgctctgggagtagaaaattctgatggcctcgaggctgcatatatattaacaagtataccagcattaggaggaacaagtattggttataacattatgacgaaagacaatttcccggtaatggatgttataatctatgttaagagtgctgtaatacaaacaacttacaatcatatatatgatacaggaccgaccataggaataaattcaaaacatgatgaaaaatgcacagggtcatgtcctcaaaatataacacatgaccaaaattggttaacattttcacaagaaaggacaagcagatggggttgtgaagaatttgggtgtctagcaataaatacaggttgtgtatttggctcttgtcaagacatgataagatcagacacaaaggtttataaaaaggcattagaagaaacagtagttttaactgtttgcataaactaccctggtaacacattttgcactgaggtcaattctgtagagacaaaaatgacagatgatgttgaattacaatttaaaacagttgatactaagactttacctaacctccttgcagttactaatcataaattatacagtggccaaataaatgacttagggtcattcagtcaaatgtgtgggaatgttcagaagaccaattcaactgtaatgggtgctggtacagtgaaatttgattacatatgtcatggtgcaagtaggaaagacataattataagaaggtgttatatgaataattacgcatcatgttctttattaaaggaagaaaaagatttgatctttgcagataatcatgaaacaataacagtatctaattcaaaacatcttgtgggagaattgcaaattaaattgatgttaggtgatattcggtataaactatttgcagagagaccagagttagaggtggatgcaaaatgtgtaggatgtccttcatgttttgagagttattcctgtaatttccaaatagtcacaaatatagatactgtatgcacccttgaaggcccttgcactattttccataacagaattattatcagttctacaaagcaatcttatggtattaagatgagttgccccacaaaaccaaatcacatagaaaaattcaaaatctgcaatcatgaatatgatattctattcgatacagtggcaaaaaatgataaaatagagattgatacaggagatcaaacattattcgtgagggagaaagacaccaggtgtaagacttggttatgtagagtaaaagatgaaggtataagtgttatctttgagcctttaagagctttctttggaagttacttcagtattattttttatattattcttgctgcaatattaatatttgtgggtgtttatatatttttaccaatgtttatgagattaagagatgttcttaaaaggaatgaacatttatatttgcaagagataaaacataaataa

SEQ ID NO: 4171 - RNA, 4305 nt, synthetic construct
  misc_feature 1..4305: note = derived and/or modified CDS sequence (wt) from MAGV__AY286443.1__GP
  source 1..4305: mol_type = other RNA
atggagttacttataattatcttgctgttagggagcgcagccagtagccctatatccactagatgttttcatggagggcaacttattgcagaatcaaaatctgcaacctctatatcagagttctgcttaaaggatgatgtttcaatgatcaaatcagaagtcacttatataaaaaatgatacaggtatatatggccacaataaagtgttcaggagttggaccataaaagattggaaattgtgcaaccctatcccaacagcaggaggcagtatcaatgtaattgaagtaaattcagacctgagcttagcaacaagggcctatgtttgtagcagagattgtactataaccattgataaagaagatgcccagataatattccaaactgataaattaaaccattttgaagtctctggaacaaccttgagttcaggttggtttaagactaaggcctcagtcactctggacagaacatgtgaacatattaaagtcacttgtgggaagaaatctctacagtttcacgcctgttttaaacaccacatgtcatgcataagattcttccatcacactatactacctggaacaatggtgtcatccatgtgccaaaatattgaattaataataataattggactcaccttagtcatatttatacttatggttatcttaaccaaaacatacatatgctacctgttaatgccagtatttatgccagttgcatacatatatggctgggcatataataagagctgcaagaaatgtaattgctgtggcttagcttatcatccatttacaaactgtggctcccattgtgtctgtgggctcaaattcgaagcttcagatagaatgcgactacatagggagtcaggattgtgccaaggctacaaaagtctcaggatagcgaggatgctatgtaaatctaagggctcatcccttgttatctcaggattactttcgatgctattattgagctttataacacctatagaaggcacgttaaccaactacccaaatgaaaaacaatacacactggaagagattgcagatgttgttgaagggataataacagagcagcatcttaaagaatatgtggtcttttatacctcattatttggggggctaatattattattaactcttatactgtctataacaataaacaaggtaacagatcttctcgcaagcactaatgttatttattgtgaagaatgttcaatgtatcattcaaaaaaaggaataaagtataatggagatttcactaataaatgtggattttgcacctgcagtgagcaagaagatgtagagggagttattatacataaagtaagcaggaaatgcacatataaatatcaacttaaatgggtaagagtaataatgattatactagctttgcttttgacaattcagaacacagtcttaattgttgctgctgaagtagattgctggacaaaaaaatctatagaaattgattgcattggccctttacttaatataggctcatgcactgataaatcaagtaggacatatgaaacagaagttaacaaattagtaagacaatctaaggttacacatgctgatgctgaacaaatatctatcttgggaagcactttagataatgcaattaaagccgtaaggtcacaaaagacatatgagactatgcatttcctagagactgtattcttaatgaaaaattgtgactattataacagctttgagcataacagtggttattcacaaacaaaatggaggcttatagctaaaacaagccactttgatatctgttcacggcatagcacccatcacttttgcaggtgtgtaaatgaagggacaaaatgccagaatggagattgggactttgctggagagatgaacgacacctacaatagcaagaatgatttctacctccatgatttagatcttttctatacactccttgaaaatgcattccccggcacaacagaatctttattctaccagctccttcagaagaaaaacacaactggtgcatcgaaattattaggaaaattaataacaaaatatggaaataacaacatgtttgttgagatatggaaatttggtcagtatcttctcaagctgccatacataaatgatacagaattgagtactgataggaaatcaactataataaaatcacaacaggtgttgagcaggtctcaaacagggaggcaagaatccttatctagtgcaactccaggcactgcaacaaaggagtgttcaaatgcaaaagatataggttgcattagcccaaggtttggcattcctataggaaacctcactgcatgtggtgattctccaaattataaagtatataaaaccccagagaaaatctataagtcaaataatagaggagaagtttggtgttcagatgatgtccactgcttaacagactttgaacctgcagaagaggaggtggtcaatagaataaaacaaatgacttgtttcttaacagatgtaacaacaaaaactgatgtattttctgttgctatatcaacgtgcaaaatggttgataagggtgtatgtacagtcaatgatgctaaatggaacatcctcaagtgtaatagtgggttatattatttcactgatcacagaggtgggcaagacacaggtaatgattttggagaatactgtatctctcacagttgcaacactgaaagattccccatcaatccagatgtcctgaaggactgcatctgggaataccactccaggaaatccaaatatatctctacagtaagtttagaatcattagatgaatttagaagagctatgtcagataagctatcacacaccttgatgatttataattttaaacctacagccaatctcccccatataaagccaacttataaatttataaccgctaatggtatagagaattcagatgggatagattcagcatacatattatctagcataccagccttgggtggaatgagcgttggctataacattcagacaaaagataatttcccattattagatattatagttttcatcaagagtgctattattaaaacaacctacaatcatatatatgacacaggtccgacaatagggataaatactcaacatgatgaacactgcactggaccatgccctacattaataccccataaagagaactggttaacattctcccaagaaaggacaagcaggtggggttgtgaagaatttggctgcctggcaattaatactgggtgtgtttttggctcatgccaggacattattcatcccgaggctaaagtatacaggaaagctatcgaggaggaagtagtcttaactgtctgtataacattcccagggaatacatactgcacagagataaatgcaatagagccaaaaataacagatgaaatagaactacagtttaagacagtagatactaaaacattaccaaatttgctaatggttcagaatcataaattatatagtgggcagattaatgatcttggttccttttcccagggatgtggcaatgtgcaaaagactaatcagtctgtaattggagctggaactgcaaaatttgattatgtctgtcatggagctagtaggaaagacgttatagtaaggcgctgttacaacaataattatgaatcctgcaagctattaaaagaggaaacctctcttatatttgcagataatcatgaaacattagaagtagcgaatacaaagcatctaataggagaactgcaattcaaaattatgttgggagacattagatacaagtcatttgctgaatcaccagaattagaagtagatgcaaaatgtgtaggctgtccttcatgttttgaaagctattcttgcaatttccagattgttacaaatattgatactgtttgttctgttgatgggccttgtacactcttccataacagactgataataagtgcaacaaagcaatcttatggttttaaaatgagttgtccaaggaagcctgaaccaacagaagaattccagatatgtaaccgtaagtacaatgtcctttttactacaattgataaaaatgataaaattgaaatcaacacaggagaccagacttcttatatctatgaaaaagacaacagatgtaagacatggctttgtagagttagggatgagggaatcagtgttatttttgagcctttaaaggcattttttggcagttactttagcatcatattttatgttgttgtaggtataattgtattattcttgactatttatattttcttacccatgttcttcaagttaagagatatattaaaaagaaatgagtatctgtacctacaggaattgaagcacaaataa

SEQ ID NO: 4172 - RNA, 4305 nt, synthetic construct
  misc_feature 1..4305: note = derived and/or modified CDS sequence (wt) from MAGV(ts8)__AY286444.1__GP
  source 1..4305: mol_type = other RNA
atggagttacttataattatcttgctgttagggagcgcagccagtagccctatatccactagatgttttcatggagggcaacttattgcagaatcaaaatctgcaacctctatatcagagttctgcttaaaggatgatgtttcaatgatcaaatcagaagtcacttatataaaaaatgatacaggtatatatggccacaataaagtgttcaggagttggaccataaaagattggaaattgtgcaaccctatcccaacagcaggaggcagtatcaatgtaattgaagtaaattcagacctgagcttagcaacaagggcctatgtttgtagcagagattgtactataaccattgataaagaagatgcccagataatattccaaactgataaattaaaccattttgaagtctctggaacaaccttgagttcaggttggtttaagactaaggcctcagtcactctggacagaacatgtgaacatattaaagtcacttgtgggaagaaatctctacagtttcacgcctgttttaaacaccacatgtcatgcataagattcttccatcacactatactacctggaacaatggtgtcatccatgtgccaaaatattgaattaataataataattggactcaccttagtcatatttatacttatggttatcttaaccaaaacatacatatgctacctgttaatgccagtatttatgccagttgcatacatatatggctgggcatataataagagctgcaagaaatgtaattgctgtggcttagcttatcatccatttacaaactgtggctcccattgtgtctgtgggctcaaattcgaagcttcagatagaatgcgactacatagggagtcaggattgtgccaaggctacaaaagtctcaggatagcgaggatgctatgtaaatctaagggctcatcccttgttatctcaggattactttcgatgctattattgagctttataacacctatagaaggcacgttaaccaactacccaaatgaaaaacaatacacactggaagagattgcagatgttgttgaagggataataacagagcagcatcttaaagaatatgtggtcttttatacctcattatttggggggctaatattattattaactcttatactgtctataacaataaacaaggtaacagatcttctcgcaagcactaatgttatttattgtgaagaatgttcaatgtatcattcaaaaaaaggaataaagtataatggagatttcactaataaatgtggattttgcacctgcagtgagcaagaagatgtagagggagttattatacataaagtaagcaggaaatgcacatataaatatcaacttaaatgggtaagagtaataatgattatactagctttgcttttgacaattcagaacacagtcttaattgttgctgctgaagtagattgctggacaaaaaaatctatagaaattgattgcattggccctttacttaatataggctcatgcactgataaatcaagtaggacatatgaaacagaagttaacaaattagtaagacaatctaaggttacacatgctgatgctgaacaaatatctatcttgggaagcactttagataatgcaattaaagccgtaaggtcacaaaagacatatgagactatgcatttcctagagactgtattcttaatgaaaaattgtgactattataacagctttgagcataacagtggttattcacaaacaaaatggaggcttatagctaaaacaagccactttgatatctgttcacggcatagcacccatcacttttgcaggtgtgtaaatgaagggacaaaatgccagaatggagattgggactttgctggagagatgaacgacacctacaatagcaagaatgatttctacctccatgatttagatcttttctatacactccttgaaaatgcattccccggcacaacagaatctttattctaccagctccttcagaagaaaaacacaactggtgcatcgaaattattaggaaaattaataacaaaatatggaaataacaacatgtttgttgagatatggaaatttggtcagtatcttctcaagctgccatacataaatgatacagaattgagtactgataggaaatcaactataataaaatcacaacaggtgttgagcaggtctcaaacagggaggcaagaatccttatctagtgcaactccaggcactgcaacaaaggagtgttcaaatgcaaaagatataggttgcattagcccaaggtttggcattcctataggaaacctcactgcatgtggtgattctccaaattataaagtatataaaaccccagagaaaatctataagtcaaataatagaggagaagtttggtgttcagatgatgtccactgcttaacagactttgaacctgcagaagaggaggtggtcaatagaataaaacaaatgacttgtttcttaacagatgtaacaacaaaaactgatgtattttctgttgctatatcaacgtgcaaaatggttgataagggtgtatgtacagtcaatgatgctaaatggaacatcctcaagtgtaatagtgggttatattatttcactgatcacagagatgggcaagacacaggtaatgattttggagaatactgtatctctcacagttgcaacactgaaagattccccatcaatccagatgtcctgaaggactgcatctgggaataccactccaggaaatccaaatatatctctacagtaagtttagaatcattagatgaatttagaagagctatgtcagataagctatcacacaccttgatgatttataattttaaacctacagccaatctcccccatataaagccaacttataaatttataaccgctaatggtatagagaattcagatgggatagattcagcatacatattatctagcataccagccttgggtggaatgagcgttggctataacattcagacaaaagataatttcccattattagatattatagttttcatcaagagtgctattattaaaacaacctacaatcatatatatgacacaggtccgacaatagggataaatactcaacatgatgaacactgcactggaccatgccctacattaatactccataaagagaactggttaacattctcccaagaaaggacaagcaggtggggttgtgaagaatttggctgcctggcaattaatactgggtgtgtttttggctcatgccaggacattattcatcccgaggctaaagtatacaggaaagctatcgaggaggaagtagtcttaactgtctgtataacattcccagggaatacatactgcacagagataaatgcaatagagccaaaaataacagatgaaatagaactacagtttaagacagtagatactaaaacattaccaaatttgctaatggttcagaatcataaattatatagtgggcagattgatgatcttggttccttttcccagggatgtggcaatgtgcaaaagactaatcagtctgtaattggagctggaactgcaaaatttgattatgtctgtcatggagctagtaggaaagacgttatagtaaggcgctgttacaacaataattatgaatcctgcaagctattaaaagaggaaacctctcttatatttgcagataatcatgaaacattagaagtagcgaatacaaagcatctaataggagaactgcaattcaaaattatgttgggagacattagatacaagtcatttgctgaatcaccagaattagaagtagatgcaaaatgtgtaggctgtccttcatgttttgaaagctattcttgcaatttccagattgttacaaatattgatactgtttgttctgttgatgggccttgtacactcttccataacagactgataataagtgcaacaaagcaatcttatggttttaaaatgagttgtccaaggaagcctgaaccaacagaagaattccagatatgtaaccgtaagtacaatgtcctttttactacaattgataaaaatgataaaattgaaatcaacacaggagaccagacttcttatatctatgaaaaagacaacagatgtaagacatggctttgtagagttagggatgagggaatcagtgttatttttgagcctttaaaggcattttttggcagttactttagcatcatattttatgttgttgtaggtataattgtattattcttgactatttatattttcttacccatgttcttcaagttaagagatatattaaaaagaaatgagtatctgtacctacaggaattgaagcacaaataa

SEQ ID NO: 4173 - RNA, 4311 nt, synthetic construct
  misc_feature 1..4311: note = derived and/or modified CDS sequence (wt) from MAGV(AG83-1746)__KX100113.1__GP
  source 1..4311: mol_type = other RNA
atgaagatgattcttctaataataatactatgtgtgaaccttgctgctgccaatccagtagcaacaagatgtttccatggaggtcaattaatagcagagacaagatctgcaacatcgatttcagaattctgtttaaaggatgacgtttctatgataaaatcggagataacctatacaaaaaatgatactggcatcttcggccatagcaaaatatacaagagttggttaataaaagattggaagctttgcaatccagtaccaactgcaggtggaagtataaatgttatagaagtgaactctgatttgagtttaactacaaaggcatatgtttgtagcagagattgtactataacaatagacaaagaggaggctcagattatattccaaacagacaagctcaaccattttgaggtatctggcacaaccctgagttcaggttggttcaaaacaaaagcttctgtaacattggatagaacttgtgagcatataaaagtaacttgtggcaaaaaaacattgcagttccatgcctgttttagacaccacatgtcgtgtgtaagatttttccacaacacaatattacccggtactatggtcaattcaatgtgtcaaaatatagaactaattataatattaggcttaacattaatcatatttacattaatggttatactgacaaagacctatatctgttatattctaatgccattatttatgcctattgcatatgcttatggatgggcatacaataaaagctgcaaaaaatgcaattgctgtggtctagcataccacccatttactaattgcggatcccattgtgtctgtggcttaaagtttgaagcttcagataggatgaggatacatagagaatctggcctctgccaaggctataaaagcttaaggatagcacgattattatgtaaatccaaaggctcatcattaataatttctaccctactatctatgctacttctaagttttattacaccaattgagggaacaatgacaaattacccagaaacaaggcaatactctcttgaagagattgctgatgttgttgaggggcttttatcagaacaaaatattaaagaatatgttgttttctatacatcattattcgggagcttaatattactattggcattcattttatcaatcactctgacaaaagtaactaatgctctagccaaaacaaatgtaatttactgtgaagaatgctcaatgtaccatgcaaaaaaaggcataaagtacaatggtgatttcacaaacaaatgcggattttgcacttgtgatgaacaagaagatgaagaaggcataataatacataaagtaagtaagaaatgcacatatagatatcaactacagtgggctaagatcattatgataatattagttatgttgttgatgatgcaaaatacaatactcattgttgctgccgaaacagactgctggactaagaattcactagagttagattgtatcgggcctctactcaccatcagtgattgctcaaacaaagagagtaaaaattatgaagaagaagcagcaaaacttgttagccaatccaaaataacacaggcagatgcagaacaggtcacaatattaggcaatacaatagatacagcactcaaagcaatcagatcacaaaaaacatatcaaactatgcacttattggaatcagtgtttttgatgaagaattgtgattattatagcagttttgaacacaatagtggatattctcaggcaaaatggagattaattgcaaagacaagtcactttgacatatgttctagacatagcatgcaccatttttgcagatgtgtcgcagatggcaccaaatgccagaatggcaattgggattttgctggagagatgaataatacatacagtactaaaaatgacttttaccttcatgatttgaatttatttttcaccttacatgagacagcctttccaggtacaactgaatctttattttatcagctgattgcaaaaaagaacactacaggtgcttctaagctgcttgggaaattaattacaaaatatggtaacaacaagttgttcgttgggatatggaaatttggccaatatttattgactttaccatatgtaaatacaacagagttatccaagactaggaaagagacaatattgaaaccacatcagattttgacaagatctcagggaggaagaccagaatctatgtctagtgctgaggtgggtcaaacagctaaagaatgtgctaatgcaaagaatgttggttgtattagtcctaggtttggggtccctattggtaatctaactgcttgcggaaatagccctaattataaaatatataaaacacctaacaagatctataagtcaaacaacaggggtgaggtgtggtgttcagaagatgttcattgcctggccgattttgaacctgctgacacagaagtagtcaacaaagttaagaagatgacatgcttcttgtctgatgtgaacactagagcagatatcttctctattgcaatttctgcatgcagaatggttgataaaggagtgtgtactgttaatggtgcaaaatggaatatattgaagtgtgagagtggtctttattattttactgatcatagggaaggacaagacactggaaatgattttggagaatactgcatctctcatagttgcaatacagagaggtacccaatcaacccagacatattaaaagagtgtatatgggagtatcactctaggaaatcaaaatacatctcaactatcaacttagaatccctagaggaatttaaaagggcaatgtccgataaattatctcacactttgatggtttataactttaaaccgactgcaaacttaccacacataaaaccaagttataagtttattactgcaaatggtattgaaaactcagatggcttagaatcagcatatatactttcaagtattccagctataggaggaatgagtataggttataatatccaaacaaaagacaatttccccttactagatttaatagtctttgttaaaagtgcagtgataaaaacaacatataaccatatttatgatactggtcctacaataggaattaatacaaaccatgatgaacactgcacagggccctgccctacaataataccacataaagagaattggctaacattctcacaagaaagaacaagcaggtggggttgtgaggaatttggatgtctagcaatcaatactgggtgtgtatttggatcatgtcaagatgtaatacatcctgagacaaagatctatcggaaagctgttgaagaggaagttgttctaactgtttgtataaattttccaggcaatacattctgtacagaaataaatgcaattgagcctaaaattacagatgagatagaacttcagtttaaaactgttgatacaaaaacattaccaaatttgctagcagttcagaatcataagttatatagtggtcagataaatgatttaggatcattttcccaaggatgtggaaatgttcaaaaaacaaatcagtcaatacttggtgctgggacagtaaagtttgattatgtgtgccatggtgcaagcaggaaagatataatagttcgtagatgttacactaacaattatgattcatgcaaactactcaaagaagagagatccctgatatttgctgataaccatgaaactttagaagttgcaaacactaggcatttgattggagaattgcaattcaagattatgttaggagatattcgatataaggcctttgcagaaaagcctgagctggaaattgatgcaaaatgtgttggatgcccatcatgtttcgaaagctattcatgtagtttccaaatagtgactagcatagatacagtctgctctgttgagggaccttgtaccttgtttcataatagaattattatcacagctgcaaaacaatcatatggagtcaaaatgagttgcaagacaaagccaggaccagttgaagaatttagaatatgtaatcggaattatagagtaagttttgctactattgataaaaatgataaaattgagataaacacaggggatcaaacttcttacatagttgagaaagatagcagatgtaaaacatggttatgcagagtcagagatgaagggatcagtgttatctttgagcctctaaaagcattctttggtagttactttagtgtagccttctatattatcataggaattgctgctttattcctcataatatatattttcctacccatgtttttcaaacttagagatgttttgaaaaagaatgagtatttatatttgcaagaattaaaacataagtaa

SEQ ID NO: 4174 - RNA, 4305 nt, synthetic construct
  misc_feature 1..4305: note = derived and/or modified CDS sequence (wt) from MAGV(BeAr 7272)__KX100104.1__GP
  source 1..4305: mol_type = other RNA
atggagttacttataattatcttgctgttagggagcgcagccagtagccctatatccactagatgttttcatggagggcaacttattgcagaatcaaaatctgcaacctctatatcagagttctgcttaaaggatgatgtttcaatgatcaaatcagaagtcacttatataaaaaatgatacaggtatatatggccacaataaagtgttcaggagttggaccataaaagattggaaattgtgcaaccctatcccaacagcaggaggcagtatcaatgtaattgaagtaaattcagacctgagcttagcaacaagggcctatgtttgtagcagagattgtactataaccattgataaagaagatgcccagataatattccaaactgataaattaaaccattttgaagtctctggaacaaccttgagttcaggttggtttaagactaaggcctcagtcactctggacagaacatgtgaacatattaaagtcacttgtgggaagaaatctctacagtttcacgcctgttttaaacaccacatgtcatgcataagattcttccatcacactatactacctggaacaatggtgtcatccatgtgccaaaatattgaattaataataataattggactcaccttagtcatatttatacttatggttatcttaaccaaaacatacatatgctacctgttaatgccagtatttatgccagttgcatacatatatggctgggcatataataagagctgcaagaaatgtaattgctgtggcttagcttatcatccatttacaaactgtggctcccattgtgtctgtgggctcaaattcgaagcttcagatagaatgcgactacatagggagtcaggattgtgccaaggctacaaaagtctcaggatagcgaggatgctatgtaaatctaagggctcatcccttgttatctcaggattactttcgatgctattattgagctttataacacctatagaaggcacgttaaccaactacccaaatgaaaaacaatacacactggaagagattgcagatgttgttgaagggataataacagagcagcatcttaaagaatatgtggtcttttatacctcattatttggggggctaatattattattaactcttatactgtctataacaataaacaaggtaacagatcttctcgcaagcactaatgttatttattgtgaagaatgttcaatgtatcattcaaaaaaaggaataaagtataatggagatttcactaataaatgtggattttgcacctgcagtgagcaagaagatgtagagggagttattatacataaagtaagcaggaaatgcacatataaatatcaacttaaatgggtaagagtaataatgattatactagctttgcttttgacaattcagaacacagtcttaattgttgctgctgaagtagattgctggacaaaaaaatctatagaaattgattgcattggccctttacttaatataggctcatgcactgataaatcaagtaggacatatgaaacagaagttaacaaattagtaagacaatctaaggttacacatgctgatgctgaacaaatatctatcttgggaagcactttagataatgcaattaaagccgtaaggtcacaaaagacatatgagactatgcatttcctagagactgtattcttaatgaaaaattgtgactattataacagctttgagcataacagtggttattcacaaacaaaatggaggcttatagctaaaacaagccactttgatatctgttcacggcatagcacccatcacttttgcaggtgtgtaaatgaagggacaaaatgccagaatggagattgggactttgctggagagatgaacgacacctacaatagcaagaatgatttctacctccatgatttagatcttttctatacactccttgaaaatgcattccccggcacaacagaatctttattctaccagctccttcagaagaaaaacacaactggtgcatcgaaattattaggaaaattaataacaaaatatggaaataacaacatgtttgttgagatatggaaatttggtcagtatcttctcaagctgccatacataaatgatacagaattgagtactgataggaaatcaactataataaaatcacaacaggtgttgagcaggtctcaaacagggaggcaagaatccttatctagtgcaactccaggcactgcaacaaaggagtgttcaaatgcaaaagatataggttgcattagcccaaggtttggcattcctataggaaacctcactgcatgtggtgattctccaaattataaagtatataaaaccccagagaaaatctataagtcaaataatagaggagaagtttggtgttcagatgatgtccactgcttaacagactttgaacctgcagaagaggaggtggtcaatagaataaaacaaatgacttgtttcttaacagatgtaacaacaaaaactgatgtattttctgttgctatatcaacgtgcaaaatggttgataagggtgtatgtacagtcaatgatgctaaatggaacatcctcaagtgtaatagtgggttatattatttcactgatcacagagatgggcaagacacaggtaatgattttggagaatactgtatctctcacagttgcaacactgaaagattccccatcaatccagatgtcctgaaggactgcatctgggaataccactccaggaaatccaaatatatctctacagtaagtttagaatcattagatgaatttagaagagctatgtcagataagctatcacacaccttgatgatttataattttaaacctacagccaatctcccccatataaagccaacttataaatttataaccgctaatggtatagagaattcagatgggatagattcagcatacatattatctagcataccagccttgggtggaatgagcgttggctataacattcagacaaaagataatttcccattattagatattatagttttcatcaagagtgctattattaaaacaacctacaatcatatatatgacacaggtccgacaatagggataaatactcaacatgatgaacactgcactggaccatgccctacattaataccccataaagagaactggttaacattctcccaagaaaggacaagcaggtggggttgtgaagaatttggctgcctggcaattaatactgggtgtgtttttggctcatgccaggacattattcatcccgaggctaaagtatacaggaaagctatcgaggaggaagtagtcttaactgtctgtataacattcccagggaatacatactgcacagagataaatgcaatagagccaaaaataacagatgaaatagaactacagtttaagacagtagatactaaaacattaccaaatttgctaatggttcagaatcataaattatatagtgggcagattaatgatcttggttccttttcccagggatgtggcaatgtgcaaaagactaatcagtctgtaattggagctggaactgcaaaatttgattatgtctgtcatggagctagtaggaaagacgttatagtaaggcgctgttacaacaataattatgaatcctgcaagctattaaaagaggaaacctctcttatatttgcagataatcatgaaacattagaagtagcgaatacaaagcatctaataggagaactgcaattcaaaattatgttgggagacattagatacaagtcatttgctgaatcaccagaattagaagtagatgcaaaatgtgtaggctgtccttcatgttttgaaagctattcttgcaatttccagattgttacaaatattgatactgtttgttctgttgatgggccttgtacactcttccataacagactgataataagtgcaacaaagcaatcttatggttttaaaatgagttgtccaaggaagcctgaaccaacagaagaattccagatatgtaaccgtaagtacaatgtcctttttactacaattgataaaaatgataaaattgaaatcaacacaggagaccagacttcttatatctatgaaaaagacaacagatgtaagacatggctttgtagagttagggatgagggaatcagtgttatttttgagcctttaaaggcattttttggcagttactttagcatcatattttatgttgttgtaggtataattgtattattcttgactatttatattttcttacccatgttcttcaagttaagagatatattaaaaagaaatgagtatctgtacctacaggaattgaagcacaaataa

SEQ ID NO: 4175 - RNA, 4311 nt, synthetic construct
  misc_feature 1..4311: note = derived and/or modified CDS sequence (wt) from MAGV(CbaAr 426)__KX100110.1__GP
  source 1..4311: mol_type = other RNA
atgaagatgattcttctaataataatactatgtgtgaaccttgctgctgccaatccagtagcaacaagatgtttccatggaggtcaattaatagcagagacaagatctgcaacatcgatttcagagttctgtttaaaggatgacgtttctatgataaaatcggagataacctatacaaaaaatgatactggcatcttcggccatagcaaaatatacaagagttggttaataaaagattggaagctttgcaacccagtaccaactgcaggtggaagtataaatgttatagaagtgaactctgatttgagtttaactacaaaggcatatgtttgtagcagagattgtactataacaatagacaaagaggaggctcagattatattccaaacagacaaactcaaccattttgaggtatctggcacaaccctgagttcaggttggttcaaaacaaaagcttctgtaacattggatagaacttgtgagcatataaaagtaacttgtggcaaaaaaacattgcagtttcatgcttgttttagacaccacatgtcatgtgtaagatttttccacaacacaatattacccggtactatggtcaattcaatgtgtcaaaatatagaactaattataatattaggcttaacattaatcatatttacattaatggttatactgacaaagacctatatctgttatattctaatgccactatttatgcctattgcatatgcttatgggtgggcatacaacaaaagttgcaaaaaatgcaattgctgtggtctagcatatcacccatttactaattgcggatcccattgtgtctgtggcttaaagtttgaagcttcagataggatgaggatacacagagagtctggcctctgccaaggctataaaagcttaagaatagcacgattattatgtaaatccaaaggctcatccttaataatttccaccctactatctatgctacttctaagttttatcacaccaattgagggaacaatgacaaattacccagaaacaaggcaatactctcttgaagagattgctgatgttgttgaggggcttttatcagagcaaaatattaaagaatatgttgttttctatacatcattattcgggagcttaatattactattggcattcattttatcaatcactctgacaaaagtaactaatgctctagccagaacaaatgtaatttactgtgaagaatgctcaatgtaccatgcaaagaaaggcataaagtataatggtgatttcacaaacaaatgtggattttgcacttgtgatgaacaggaagatgaagagggcataataatacataaagtaagtaaaaaatgcacatatagatatcaactacagtgggctaagatcattatgataatattagttatgttgttgatgatgcaaaatacaatacttattgttgctgccgaaacagactgttggactaagaattcactagagttagattgtattgggcctctactcaccatcagtgattgctcaaacaaagagagtaaaaattatgaagaagaagcagcaaaacttgttagtcaatccaaaataacacaggcagatgcagaacaggttacaatattaggcaacacaatagatacagcactcaaagcaatcagatcacaaaaaacatatcaaactatgcatttattggaatcagtgtttttgatgaagaattgtgattattatagcagttttgaacacaatagtggatactctcaggcaaaatggagattaattgcaaagacaagtcactttgacatatgttctagacatagcatgcaccatttctgcagatgtgtcgcagatggcaccaaatgccaaaacggtgattgggattttgctggagagatgaataatacatacagtactaaaaatgacttttaccttcatgacttgaatttatttttcaccttacatgagacagcctttccaggtacaactgaatccttattttatcagctgattgcaaaaaagaacactacaggtgcttctaagctgcttgggaaattaattacaaaatatggtaacagcaagctgttcgttgggatatggaaattcggccaatatttattgactttaccatatgtaaatacaacagagttatccaagactaggagagagacaatattgaaaacacatcagatcttgacaagatctcagggaggaagatcagaatctatgtctagtgctgaggtgggtcaaatagctaaagaatgtgctaatgcaaagaatgttggttgcattagtcctaggtttgggatccctattggtaatctaactgcttgcggaaatagccctaattataaaatatataaaacacctaacaagatctataagtcaaacaacagaggtgaggtgtggtgttcagaagatgttcattgcctggccgattttgaacctgctgacacagaagtagtcaacaaagttaagaagatgacatgcttcttgtctgatgtgaacactagagcagatattttctctattgcaatttctgcatgcagaatggttgataaaggagtgtgtactgttaatggtgcaaaatggaatatattgaagtgtgagagtggtctttattattttactgatcatagggaaggacaagacactggaaatgattttggagaatattgcatctctcatagttgcaatacagagaggtacccaatcaacccagacatattaaaagagtgtatatgggaatatcactctaggaaatcaaaatatatctcaactatcaacttagaatccctagaggaatttaaaagggcaatgtccgataaattatctcacactttgatggtttataactttaaaccgactgcaaacttaccacacataaaaccaagttataagtttattactgcaaatggtattgaaaactcagatggcttagaatcagcatatatactttcaagtattccagctataggaggaatgagtataggttataatatccaaacaaaagacaatttccccttactagatttaatagtctttgttaaaagtgcagtgataaaaacaacatacaaccatatttatgatactggtcccacaataggaattaatacaaatcatgatgaacactgcacagggccctgtcctacgataataccacataaagagaattggctaacattctcacaagaaagaacaagtaggtggggttgtgaggaatttggatgtctagcaatcaatactgggtgtgtatttggatcatgtcaagatgtaatacatcccgagacaaagatctatcggaaagctgttgaagaggaggttgttctaactgtttgtataaattttccaggcaatacattctgtacagagataaatgcaattgagcctaaaattacagatgagatagaacttcagtttaaaaccgttgatacaaaaacattaccaaatttgctagcagttcagaatcataagttatatagtggtcagataaatgatttagggtcattttcccaaggatgtgggaatgttcaaaaaacaaatcagtcaatacttggtgctgggacagtaaagtttgattatgtgtgccatggtgcaagcaggaaagatataatagttcgtagatgctacaccaacaattatgattcatgcaaactactcaaagaagagagatccctgatatttgctgataaccatgaaactttagaagttgcaaacactaggcatttgattggagaattgcaattcaagattatgttaggagatattcgatataaggcctttgcagaaaagcctgagctggaaattgatgcaaaatgtgttggatgcccatcatgtttcgaaagctattcatgtaatttccaaatagtgactagcatagatacagtctgctctgttgagggaccttgtaccttgtttcataatagaattattatcacagctgcaaaacaatcatatggagttaaaatgagttgcaagacaaagccaggaccagttgaagaattcacaatatgtaatcggaattatagagtaagttttgctactattgataaaaatgataaaattgagataaacacaggggatcaaacttcttacatagttgagaaagatagcagatgtaaaacatggttatgcagagtcagagatgaagggatcagtgtcatctttgagcctctaaaagcattctttggtagttactttagtatagccttctatattatcataggaattgctgctttattcctcataatatatattttcctacccatgtttttcaaacttagagatgttttgaaaaagaatgagtatttatatttgcaagaattaaaacataagtaa

SEQ ID NO: 4176 - RNA, 4305 nt, synthetic construct
  misc_feature 1..4305: note = derived and/or modified CDS sequence (wt) from MAGV(CoAr 3363)__KX100107.1__GP
  source 1..4305: mol_type = other RNA
atgttatccttgctcatactagcttttttagggctctcgacaagcaaccctattgcaactaggtgtttccatgggggccaattaatagcagaatcaaagtctgctacatctatatcagaattctgcctcaaggatgatgtctcaatgttaaaatctgaggtagtatacacaaagaatgatactggattatttggtcataataaagtttttagaagctggacaataaaagattggaaactctgcaaccctatacctactgcaggaggaacaataaatgtaattgaggtcaataaagatcttagtctaatgacaaagacatacatatgtagtagagattgcactataactatagataaagaggaagctcagattatctttcaaacagataagttaaatcattttgaagtatctggcactacattaagttcaggatggtttaaaagcaaggcgtctgttaccctggatagaacctgcgagcatgttaaggttacttgtggaaagaagtctctgcaattccatgcatgctttaaacaccacatgtcatgtgtcaggttcttccacaataccatattacctggcaacatgataacctcaatgtgccagaatatagaattaataattatcttagggctaacattagccatatttatattaatggttatgcttacaaagacttatatatgttatttattgatgccaattttcatgccgatagcttatctttatggttgggcctacaacaagagctgcaaaaagtgtaactgttgtggtctagcataccatccatttactaattgtgggtcacattgtgtttgtggcttgaaatttgaggcatcagataggatgaggatccatagagaatctggcttgtgtcaagggtacaagagtttacgaattgctagacttttgtgtaaatctaaagggtcatctctagttatatctgggttgttgtctatgttgatcctaagcttcgtaacgcctatagaagggactataactagctacccagaaagtaggaaatatacactagaagagataacagatgttgttgaaggattggtgtctgaacagaatataaaggagtacattgttttctacacctcattgtttggaagtttaatactattattagcatttataatgtctataactttgagcaaaataacaagcatactagcaagaagaaatgttatttattgcgaagaatgctcaatgtatcattcaaaaagaggcataaagtataacggtgatttcacaaacaaatgcggcttttgcacatgcaatgaacaggaggatgcagaaggattagtgatacataaagttagtaagagatgcacatataaatgccaactaaagtgggctaaagtgctgatgatcacactggtcttacttctaatagcacaaaacactattctaattgttgcagctaaaacagattgctggacaaaaaaaagcctagatatagactgtataggaccaatgctagatataggctcttgcacaaataagaacaccagaagctatgatacagaagcacagaaattggtgacccagtctaaagtaagtcaactagatgcagaccaagcatcgctgttgggcagctctatagatagtgctattaaggcaatcagaacccagaaaacttatcctacgatgcacttgttggaaacaatattcttaatgaaaaattgtgattattacacgagtttcaaccataacagtggttattcacaagctagatggcgattgattgcaaaaacaggacacttcgacatatgttccagacatagcacccaccatttttgccgatgtataagtgatgggaccaaatgtcagaatggtgattgggattttgctggtgaaatgaatgaaccttacaatagcaaaaatgatttttatttgcatgatctgaatttgttttacacaatctttgaaaatgcattcccagggacaactgaatccttattttaccagttgatccaaaagagggatactacaggggcctccaaagtcttggggaagttaataactaaatatggtaataataacatgttcgttggagtctggaaatttggacaatacttgcttacattaccatatataaataatactgaattgagccagaataggaagcaaacaatcctggcaacacaagaaccattaagtaggtcacaccctggcaggcaggagtctatgtctagtgcaattcagggcagtgttacaaaagaatgccataatgcaaaagatgttgggtgcataagccctcggtttggtatcccaattggcaaccttacagcatgtggtgactcacctaattataagatatataagactccagaaaagttgtataaatcaaataataaaggggaagtttggtgttcgaatgatgtccactgcctgaatgattttgagcctgcagatgaagaagttgtcaataaagttaaaaaactcacttgcttcttaacagatgttttagttaaaacagacatcttttcagtggctgcatccacatgtaagatggcagataaaggcatctgtacagtgaatgatgctaaatggaatataatcaagtgtgatagtggattatattattttacagaccatagagaaggccaggacacaggcaatgactttggtgagtattgtatatctcacagttgcaatactgagcgattccctatcaacccagatatattaaaagattgcacttgggagttccattccagaaagtctaaatatatttcaaccattagtttagaatcattggaagaattcaggagggcaatggcagaaaagctatcacacaccctaacaatttacaattttaaaccaacagctaatcttcctcatattaggccaacctataaattcattacagcaaatggtgttgaaaactctgacggtattgaatcagcatacatcttgtctagcatccctgcattaagtggaattagcgttggttataatgtccagaccaaagacaacttcccattgttggatataattgtgttcattaaaagtgcagtcatcaggacaacatacaatcatatttatgatactgggcctactataggtataaacacacaacatgatgagcactgtacagggccatgcccagctgtggtgccacataaggaaaactggataacattttctcaagaaagaacaagtagatgggggtgtgaagaatttggttgcctggccatcaacacagggtgtgtttttggttcttgccaagatataatacatccagaaaccaaagtataccgtaaagcagtagaagaggaagttgtcttaacagtatgcattaatttcccaggcaataattactgcactgaaataaatgccattgagccaaaaataacggatgagatagagctccagttcaaaacagtcgatacaaaaaccttacccaatcttcttgcagtgcagaaccataagctttatagtggccagataaacgatttaggctctttttcacaaggttgtggaaatgtccaaaaaacaaatcactctatcctaggtatgggtacagccaaatttgattatgtttgtcatggcgctagtaggaaagatgtgatagtcagaaggtgctacaacaataattttgattcatgcaaattactaaaagaagaaacatcattgatatttgcagataatcatgagactctggaggtagcacacacaaaacatctgataggtgaattacagtttaagataatgttaggagatataagatacaaatcatttgctgaatcgcctgagttggaaattgatgcaaaatgtgtcgggtgtccatcatgttttgaaagctactcctgcaactttcaaatagtgacaaatatagacactgtatgctcagtcgaagggccatgcacactatttcataatcggattattatatcagccaacaagcagtcatatggacttaaaatgagctgccaaacaaagcctaatcagaatgaagagttcattatctgcaacaggaaatacagcgtcctatttacaacaattgataaaaatgacaaaatagaagtgaatacaggggaccagacttcatatatttatgaaaaagacagcagatgtaaaacttggttatgcagggtcagagatgaggggatcagcgtcctatttgaaccattaaaagcattttttggaagttactttagcataatattttatgttgtcattggaattattgtccttttcttgattgtatatatctttctgccaatgttcttcaaactaaaagatgttctgaaaaaaaatgagtacttgtatcttcaggagctgaagcataaatga

SEQ ID NO: 4177 - RNA, 4305 nt, synthetic construct
  misc_feature 1..4305: note = derived and/or modified CDS sequence (wt) from MAGV(OBS 6657)__KX100116.1__GP
  source 1..4305: mol_type = other RNA
atggagttacttataattatcttgctgttagggagtgcagctagtagccctgtatccactaggtgttttcatggagggcaacttatcgcagaatcaaagtctgcaacctctatatcagaattctgtttaaaggatgatgtttcaatgatcaaatcagaggttacttatacaaagaatgatacaggtatatatggtcataataaagtgttccggagttggactatcaaagattggaaattgtgcaaccctatcccaacagcaggaggcagtatcaatgtaattgaagtgaattcagacctgagcctagcaacaaaggcctatgtttgtagtagagactgcactataactatcgacaaagaggatgcccagataatatttcaaactgataaactgaaccattttgaggtctctgggacaactttaagttcaggttggtttaagactaaagcctcagtcactctggacaggacgtgcgaacacattaaagtcacctgtgggaaaaaatctctacaatttcatgcatgttttaaacatcacatgtcatgcataaggttcttccatcatactatactacctgggacaatggtatcatctatgtgccaaaatattgaattaataataataattggactcaccttagtcttgtttatacttatggttatattaactaaaacatacatatgctatctattgatgccaatatttatgccaattgcatacatatatggctgggcatacaataagagttgtaaaaaatgtaattgttgtggcttagcttaccatccatttacaaactgtggatctcattgtgtctgtgggctcaaatttgaagcttcagatagaatgagaatacatagagagtcagggctgtgccaaggctataaaagtcttaggatagcaagaatgctatgtaaatctaagggctcatcccttgttatctcaggactactctcaatgcttttattaagctttataacacctatagaaggcacattaactaactacccaaatgaaagacaatacacactggaagagattgcagatgttgttgagggaatactaacagaacaacatctcaaagaatatgtggtcttttatacctcattatttggggggctaatattattattaactcttatactgtctataacaataaacaaagtaacagatcttcttgcaagcactaatgtcatttactgcgaagaatgttcaatgtaccattcaaagaaaggaataaagtataatggagatttcactaacaaatgtggcttttgcacttgcagtgaacaagaagacatagagggggttgttatacataaagtgagtaggaaatgcacatataaataccaacttaagtgggtaagagtaataatgattatattggctctacttttaacactccagaacacagttttaattgttgctgctgaagtagattgctggacaaaaaaatctatagaaattgattgcataggccctttactcaatattggcacatgcactgacaagtcaagtaggacatatgaaacagaggttaacaaattagtaagacaatctaaagttacacaggctgatgctgaacaagtatctattctgggaagcactctagacagtgccatcaaagccataaggtcacaaaaaacatatgaaaccatgcattttctagagactgtgttcttgatgaaaaattgtgactattatagcagctttgagcacaatagcggttattcacaaacaaaatggaggcttatagcaaaaacaagccactttgatatctgctcacggcatagtgcccaccatttttgcagatgtgtaaatgaagggacaaaatgccaaaatggagattgggattttgctagagaaatgaatgacacttacaatagtaagaatgatttctatctccatgatttggatcttttttatacgctctttgaaaatgcattccctggtactacagaatctttattctaccagcttcttcagaagaaaaacacaactggtgcatcaaaactattagggaagttaataacaaaatatggtaataataacttgtttgttgggatatggaaatttggtcagtaccttcttaagctgccatacataaatgatacagaattaagtaccgataggaaatcaactataatgaaatcacaacagatgttaagcaggtctcaaacagggaggcaagaatccctgtctagtgcaaccccaggcactgcaacaaaggagtgctcaaatgcaaaagacataggttgtattagcccaaggtttggcattcctataggaaaccttactgcatgtggtgattctccaaattataaaatatacaagacaccagagaaaatctataaatcaaataataaaggagaagtttggtgttcagatgatgttcactgcttagcagactttgaacctgcagaagaagaggtagtcaatagaataaaacagatgacttgttttttaacagatgtaacaacaaagactgatgtattttctgttgctatatcaacatgcaaaatggctgataagggtgtgtgtacagtcaatgatgctaaatggaacatcctcaagtgtaatagtggattatattatttcactgaccacagagatgggcaagatacaggtaatgattttggagaatactgtatctctcatagttgcaacactgaaaggttccccatcaacccagatgtcttgaaagattgtatttgggaataccactccagaaaatccaagtatatctctacaataagtctagaatcattagatgagtttagaagggctatgtcagataagctatcacacaccttaatgatttacaattttaaacctacagccaatctcccccatataaagccaacttacaaatttataactgccaatggtatagagaactcagatgggatagactccgcatatatattatctagcataccggctctgggtgggatgagtgtcggctataatgttcagacaaaagacaatttcccattattagatattatagtattcattaaaagtgctattattaaaacaacctacaatcatatatatgacacaggtccaacaatagggataaacacccaacatgatgagcattgcactggaccatgccctacattgatacctcataaagaaaactggctaacattctctcaggaaaggacaagtagatggggttgtgaagaatttggctgcttggcgattaacactgggtgtgtctttggctcatgccaggacattattcatcctgaagccaaagtttacaggaaagctattgaggaggaggtggttttaactgtctgtataacattcccagggaatacatactgcacagagataaatgcaatagagcctaagataacagatgaaatagaattacagttcaaaacagtagatactaaaacattgccaaacttgctaatggttcagaatcataaattatatagtggtcagattaatgatcttggttccttttcccagggatgtggcaatgtgcaaaaaactaatcagtctgtaattggaactggaactgcaaaatttgactatgtctgtcatggagctagtaggaaagatgttatagtaaggcgctgttacaacaacaattatgaatcttgcaagctattgaaagaggaaagctctctcatatttgcagataaccatgaaacattagaagtagcaaatacaaagcatctgataggagaattacaattcaaaattatgctaggagacattagatataaatcatttgctgaatcaccagaattagaagtagatgcaaaatgtgtaggctgtccttcatgctttgaaagctattcttgcaatttccagattgttacaaatattgatactgtttgttctgttgatggtccttgtacgcttttccataacagactaattataagtgctgcaaagcaatcttatggtttgaaaatgagttgttcaaggaggcctgagcaaacagaagaattccagatatgtaatcgtaagtacagtgtccttttcactacaattgataaaaacgataagattgaaattaacacaggagaccagacttcttatatctatgaaaaggacaacagatgtaagacatggctttgtagagttagagatgagggtattagtgttatttttgagcctttaaaggcattttttggcagttactttagcatcatattctatgtgattgtaggcattattgtattattcttgattatttatattttcttgcccatgttcttcaagttaagagatatattaaaaagaaatgaatatctgtacctacaggaattaaagcacaaataa

SEQ ID NO: 4178 - RNA, 4302 nt, synthetic construct
  misc_feature 1..4302: note = derived and/or modified CDS sequence (wt) from NORV(0234)__EU004188.1__GP
  source 1..4302: mol_type = other RNA
atgatttggtttatcctgctattagcaattgcgccatcatttggtacccctattgcaactagatgctttcatgggggccaacttattgcagaggcaaaatcacaaacatctatttcagaattttgcttgaaagatgatgtttcaatgataaaatcggaagtcacttacacaaaaaatgacacaggcatttttgggcatagtaaggtttatagaagctggactatcaaagattggaaactatgtaatccagtgccaacagttggaggtagtataaatgtcatagaagtgacagcagacctaagtctgtcaacaaaagcatatgtatgcagtcgggattgtacaatcacaatagataaggaaggagctcagattgtattccagacagacaagcttaatcattttgaagtatctggaacaaccttaagttcagggtggtttaaaaccaaagcttcagtcacattagatcggacctgcgaacatatcaaagtgacctgtggaaagaaaactctccaatttcatgcttgctttaaacatcatatgtcatgcattcgctttttccataacactatcttacctggatcaatggtcgcctcaatgtgccagaacatagaattgattattattttaggactaacattgataatttttatattaatggccatactaaccaaaacatatatatgttaccttttaatgcctatttttatgccaattgcatatgcatatggttgggcatataataaaagttgtaagaagtgccactgctgtggcttggcataccacccctttaccaattgtggatcacattgtgtttgtggtctaaaatttgaggcctcagacagaatgaggatacatcgagagtctggattatgtcaaggatacaaaagcttgagagtggccagattgttatgcaaatcaaaaggttcttccttagttatatcaatactactttctatgctcattctaagctttgtaacaccaatagagggaacactgaccaattacccagagtcaaggcgatacacattagaggaaattgcagatgttgttgagggtataatagcagaacaagatctaaaggagtatattgtattttatacttcattatttgggagtttaattctattattagcattcatattatctgttacattaacaaaagttctagatttactggctaaaacaaatgtaatctactgtgaagaatgctccatgtatcatccaagaaaaggaataaaatacaatggggattttacaaataagtgtgggttttgtacttgtgatgaacaagaagatgtagaaggtgtaattatacataaagtgagtaaaaagtgtacttaccggtatcaagttaagtgggcaaagataatcatgattattgtagttatactattaatggcacaaaatactattttaattgttgctgcagaaacagattgctggacaaaaaaatcattagaactggattgtattggcccactattaaatataggatcctgctcaggcaaggaagctaggacttatgaaacagaagtaaaaaaacttgtcagtcagtctaaagtaacacatatagatgctgaacacatttccattctgggagcaactatagatagtgccataaaatctataagagcacagaaaacatatgcaaccatgcatctattagagactgtctttctgatgaaaaattgtgattattacacagtttttgagcataatagtggttattcacaagcaaaatggaggttgatagctaagacaaatcattttgatatctgttctagacatagtgcacatcatttttgtagatgcattaatgatgagacaaagtgtcaaaatggcaattgggactttgcaggtgaaatgaataacacatatagtactaagaaggacttctaccgacatgacctagatcttttttacacaatatttgaaaatgctttcccaggatctactgaatctctcttttatcatttattacaaacaaagaatactacaggagcctcaagaatattagaaaaattatcaaccaaatttggcaacaacaacatgtttgttggaatctggaagtttggacaatatctgctaacattgccatatgtgaatgagacagaattgagcccttctaggcaatcaactatattaaccaatagcaattctctcagtagatcaacaggcaggcaggaatcattatctagtgctatcccaggaccaaacacaaaggaatgctctaatgcaagagacgtcgggtgtataagcccgcgatttggtattcccataggaaatttgacagcatgtggcgaatcacctagttataaaatatacaaaactccagaaaaattatataaatctaacaataaaggtgagatatggtgttctgatgatgttcattgtttaaagaattttgagccagctactgaagagatagtaaatagaattaaacaaatgacatgtttcttaacagatgtctcaacaaaaacagatatattctctatagccacatcaacatgcagaatggtagacaaaggtgtctgcactgtcaatgatgcaaaatggaatatacttaaatgtgatagtgggctcttttattttactgatcaaagggaaggccaagatacaggcaatgattttggagaatattgtatttctcatagttgtaacacagaacgattccccataaatcctgatattctaaaagactgcacttgggaatatcattcacgaaaatctaaatatatatctactattagtctagaatcactagatgaatttaggagagccatgtcagataagctatctcatacattaatgatttataatttcaaacctacagctaacctcccccacataaagccaacatacaaatttataacagctaatggaattgaaaactctgatgggttggactcagcttatattgtatctagtattccagcattaggtggtatgagtgttggctacaatgtccaaacaaaagataatttcccattgcttgacatcatagtttttataaagagtgcagttattagaacaacctataatcatatatatgacacagggcctactattgggataaatacacaacatgacgagcattgcacaggggcttgcccaacacaaataccacataaagacaattggctcactttctcccaggagaggactagtaggtggggttgtgaagaatttggctgcctagctattaatactggatgtgtttttggatcttgccaagatattatacatcctgaaaccaaggtatataggaaggcaatggaagaagaggtaatattgacagtatgtgtcacgttcccaggcaatacttattgtactgaaataaatgcaatagaacccaagattacagatgagatagaactacagttcaaaactgtagatactaaaacattacctaatatattggctgttcagaaccacaaattatacagtggtcaaatcaatgatctgggatctttttcgcaaggctgtggcaatgtgcaaaagacaaaccaatccatacttggaactggaacagcaaaatttgactatgtttgtcatggagccagtcgcaaagatattatagtcagacgttgctataacaataatcatgactcttgcaagttattaaaagaagaaacctcattgatctttgcagataatcatgaaacattagtggtcgctaatacaaagcatttaataggagaactccaattcaaaataatgcttggtgatatcagatacaaatcttttgcagagtccccagaacttgaaattgatgcaaagtgtgtaggatgtccatcatgttttgaaagttattcctgtaatttccagattattacaaatattgacactgtgtgttctgtaagtggcccatgcacattattccataacagattaattataactgcaacaaaacagtcatatgggattaaaatgagttgtccaacaaaacctgaaggcacagaaacattcgaaatatgtaacaaacaatataaaatattttttacaacaatagataagaatgacaaaatagagataaacacaggagatcaaacttcatacatctatgagaaggacaataggtgtaaaacctggttatgtagagtacgggacgaaggaattagcgtgctctttgaaccattaagagcattctttgggagttactttagtataatattttatgctgtcgtaggaattattatcttatttttagcagtatatatattcctacctatgatcttcaaacttagggacatgctcaagaagaatgaatacctatacttacaggagtcgaaacataaatga

SEQ ID NO: 4179 - RNA, 4305 nt, synthetic construct
  misc_feature 1..4305: note = derived and/or modified CDS sequence (wt) from PLAV(75V3066)__KX100122.1__GP
  source 1..4305: mol_type = other RNA
atgctattcctgctcatactagcctttttagggttctcaacaagcaaccctattgcaactaggtgtttccatgggggccaattaatagcagagtcaaagtctgctacatctatatcagaattctgcctcaaggatgatgtctcaatgttaaaatctgaagtggtatacataaagaatgatactggattatttggccataataaagtttttagaagctggacaataaaagattggaaactctgcaaccctatacctactgcaggaggaacaataaatgtaattgaggttaacaaagatcttagtctaatgacaaagacatacatatgtagtagagattgcactataaccatagataaagaggaagctcaaattatcttccaaacagataagctaaatcattttgaagtgtctggcactacattaagttcaggatggtttaaaagcaaggcgtctgtcaccctggatagaacctgtgagcatgttaaggttacttgtggaaagaaatctctgcaattccatgcatgttttaaacaccacatgtcatgtgttaggttcttccacaataccatattacctggcaatatgataacctcaatgtgccagaatatagaattaataattatcttagggctaacactagccatattcatattaatggttatgcttacaaaaacttatatatgttatttactgatgccaattttcatgccgatagcttatctttatggttgggcctacaataagagctgcaaaaagtgcaactgttgtggtttagcatatcatccatttactaattgtgggtcacattgtgtttgtggcctgaaatttgaggcatcagataggatgagaatccatagagaatctggcttgtgtcaagggtacaagagtttacgaattgccagacttttgtgtaaatctaaagggtcatctttagttatatctggattattgtccatgttaatcttaagctttgtaacgcctatagaggggactataactagctacccagagagcagaaaatatacactggaagagataacagatgttgttgaaggactggtatctgagcagaatataaaggagtacattgttttctatacctcattgtttggaagtttaatactattattagcatttataatgtctataactttaagcaaaataacaagcatattagcaaaaagaaatgttatttattgtgaagaatgctcaatgtatcattcaaaaagaggcataaaatacaatggtgacttcacaaacaaatgcggcttttgcacatgcaatgagcaagaggatacagaaggattagtaatacataaagttagtaagagatgcacatataagtaccagctaaagtgggctaaagtgctgatgatcacactagtcttgcttctaatagcgcaaaacactattctaattgttgcagctgaaacagattgctggacaaaaaaaagcctagacatagactgtataggaccaatgctagatataggctcttgcacaaataagaataccagaagctatgatgcagaagcacagaaattggtaagccagtctaaaataagtcaactagatgcagaccaagtatcgttgttaggcaactctatagatagtgctattaaggcaatcagagcccagaaaacttaccctacaatgcatttgttggaaacaatattcttaatgaaaaattgcgattattacacgaatttcaaccataacagtggctattcacaagccaaatggcgattgattgcaaaaacagggcactttgacatatgctccagacatagcacccaccatttctgccgatgtataaatgatggaaccaaatgtcagaatggtgattgggatttcgctggtgaaatgaatgaaacttacaatagcaaaaatgatttttattcacatgatctgaatttgttttacacaatttttgaaaatgcattcccaggaacaactgaatccttattttatcaattgatccaaaagaaaaatactacaggggcctccaaagtcttggggaagttaataactaaatatggtaataataacatgtttgttggagtctggaaatttggacagtacttacttacattaccatatataaataatactgaattgagccagaataggagactaacaatcctggcaacacaagaaatattaagtaggtcgcactctggcaggcaggagtctatgtccaatgcaattcagggcagtattacaaaagaatgccataatgcaaaaggtgttgggtgcataagtcctcggtttggtattccaattggtaaccttacagcatgtggtgactcacctaattataagatatataagactccagaaaaattgtataaatcaaataataaaggggaagtttggtgttcaaatgatgttcactgcctgaatgattttgagcctgcagatgaagaagttatcaataaaattaagaaactcacttgcttcttaacagacgtctcagttgaagtagacatcttttcagtggctgcatccacatgtaagatggcagacaaaggtgtctgtacagtaaatggtgctaaatggaatataatcaagtgtgatagtggattatactattttacagaccatagagaaggccaagacacaggcaatgactttggtgagtattgtatatctcacagttgcaatactgagcgattccctatcaacccagacacattaaaagattgtacttgggagttccattccagaaaatctaaatatatttcaaccatcagtttagaatcattggaagaattcaggagggcaatggcagagaagttatcacacaccctaacaatttacaattttaaaccaacagctaaccttcctcatattaggccaacctacaaattcattacagccaatggtgtcgaaaactctgacggtattgaatcagcatacatcttgtctagcatccctgcattaggtggaattagtgttggttataatgttcaaaccaaagacaacttcccattgttggatataattgtatttattaagagcgcagttatcaggacaacatacaatcatatttatgataccgggcctactataggtataaacacacaacatgatgagcactgtacagggccgtgcccagctgtggtgccacataaagagaactggatgacattttctcaggaaagaacaagtagatggggatgtgaagaatttggttgcttggccatcaacacagggtgtgttttcggttcttgccaagatataatacatccagaaactaaagtataccgcaaagcagtagaagaggaagttgtcttaacggtgtgcatcaattttccaggcaatagttactgcactgaaataaatgccattgagcctaagataacagatgagatagagctccagttcaaaacagtcgatacaaaaaccttacccaaccttctcgcagtgcagaatcacaagctttacagtggccagataaacgatttgggctctttttcacaaggttgtggaaatgtccaaaaaacaaatcactcaatcctaggcatgggtacagtcaaatttgattatgtctgtcacggcgctagtaggaaagatgtgacagtcaggaggtgctacaacaataattttgattcatgcaaattactgaaagaagaaacatcattaatatttgcagataatcatgagactctagaggtagcacacacaaagcatctgataggtgaattacagtttaagataatgctaggagatataagatacaaatcatttgctgaatcacctgagttggaaattgatgcaaaatgtgtcgggtgtccatcatgttttgaaagctactcctgcaactttcaaatagtgacaaatatagacactgtgtgctcagtcgaagggccatgcacactatttcataatcgaattattatatcagctaacaaacagtcttatgggcttaaaatgagttgccaaacaaagcctaaccaaaatgaagagttcattatctgtaacaggaaatacagtgtcttattcacaacaattgataaaaatgacaaaatagaagtgaacacaggggaccagacctcatatatttatgaaaaggacagcagatgtaagacttggttgtgcagggttagagatgaggggatcagtgtcctatttgaaccattgaaagcattctttggaagttattttagcataatattttatgttgtcgttggaattattgtccttttcttgattgtatacatatttttgccaatgttcttcaaattaaaagatgttttgaaaagaaatgaatatttgtatcttcaggaactgaaacataaataa

SEQ ID NO: 4180 - RNA, 4305 nt, synthetic construct
  misc_feature 1..4305: note = derived and/or modified CDS sequence (wt) from PLAV(75V5758)__KX100128.1__GP
  source 1..4305: mol_type = other RNA
atggagctacttataattatcttgttgttagggagtgcagctagtagccctgtgtccactaggtgtttccatggagggcaacttattgcagaatcaagatctgcaacctctatatcagaattttgcttaaaggatgatgtttcaatgatcaaatcagaagtcacttatacaaaaaatgatacaggtatatatggccataataaagtgttcagaagctggaccatcaaagattggaaattatgcaatcctattccaactgcaggaggcagtatcaatgtaattgaggtgaattcagacctgagcttagcaacgaaggcttatgtctgcagtagggactgtactataactattgacaaggaagatgcccagataatattccaaactgataaactgaaccattttgaagtatctggaacaactctgagttcaggttggtttaagactaaagcctcagtcaccctagacaggacatgcgaacatattaaggtcacctgtgggaaaaaatctctacagtttcatgcctgttttaagcaccacatgtcgtgcataaggttctttcatcatactatattgcctggaacaatggtatcatctatgtgccaaaatattgaattaataataataattggacttaccctagctatatttatactcatggttatcttaactaaaacatacatatgttatctcttgatgccagtatttatgccaattgcatacatatacggctgggcatacaataagagttgtaaaaaatgtaattgttgtggcttagcttatcatccatttacaaactgtggatctcactgtgtctgtgggctcaaatttgaagcttcagatagaatgagaatacatagggagtcagggctatgccagggctataaaagtctcaggatagcaagaatgctatgcaaatccaaggggtcatctcttgttatctcaggattactttcgatgctattattaagctttataacacctatagaaggcacattaaccaactacccaaatgagaaacagtacacactggaagaaattgcagatgttgtagaagggataatgacagagcaacatcttaaagaatatgtggtcttttatacctcattatttggggggctaatattattattaactctaatactatctataacaataaacaaagtaacagatctccttgcgagcactaatgttatttactgcgaagaatgttcgatgtatcattcaaaaaaaggaataaaatataatggggatttcaccaataaatgtggcttttgcacctgcagtgagcaagaagatgtagagggagttgtcatacataaagtaagcaggaaatgcacatataaatatcagctcaagtgggtaagggtaataatgattatactagctctgcttttaacaatccagaacacagtcttaattgttgctgcagaagtagattgttggacaaagaaatctatagaaattgattgcattggccctttactcaatataggctcatgtactgacaagtcaggcaaaacatatgagacagaagttaacaaattagtaagacaatctaaagtcacacaggctgatgctgaacaaatatctgttttggggaacactctagatagtgccattaaagctataaggtcacaaaaaacatatgagaccatgcactttctagagactgtgttcttgatgaaaaattgtgactattacagcagctttgagcataatagtggctattcacaaacaaaatggaggctcatagctaaaacaagccactttgatatttgctcgcggcatagtgcccatcatttttgtagatgtgtaaatgaagggacaaaatgccaaaatggagattgggattttgctggagagatgaataacacttacaatagtaagaatgatttttatctccatgatttagaccttttctatacactctttgaaaatgcattccctggcacaactgaatctctgttctaccagcttcttcagaagaaaaacacaaccggtgcatcgaaactgctagggaaattaataacaaaatatggcaataacaacatgtttgttggaatatggaaatttggtcaatatcttcttaagctgccatatataaatgatacagaattgagtgccgacaggaaatcaactataatgaaatcacaacaggtgttgagtagatcccaaacagggaggcaagaatccctgtctagtgcaactccaggcactgcaacaaaggagtgttcaaatgcaaaagatataggttgcattagcccaagatttggcattcctataggaaaccttactgcatgtggtgattctccaaattataaaatatacaagaccccagagaaaatctataaatcaaataacaaaggggaagtttggtgttcagatgatgttcactgcttggcagattttgaacctgcagaagaggaggttgttaatagaataaaacagatgacttgttttttgacagatgtgacaacaaagactgatgtattttctattgctgtttcaacatgcaaaatggttgataagggtgtgtgcacagtcaatgatgctaaatggaacatcctcaagtgtaatagtgggttatattatttcactgaccacagagatgggcaagacacaggtaatgattttggagaatactgtatttcccacagctgtaatactgaaagattccccatcaatccagatgtcttgaaggattgtatctgggaataccactccaggaaatccaaatatatctctacaataagcctagaatcattagatgagtttagaagggctatgtcagataagctatcacataccttaatgatttataattttaagcctacagccaatctcccccacataaagccagcttataaatttataactgctaatggtatagagaattcagatggaatagattcagcatatatattatctagtataccagctctgggtgggatgagtgtcggatataatgttcagacaaaagataacttcccattattagatatcatagttttcatcaagagtgctattattaaaacaacctacaatcatatatatgacacaggtccgacaataggaataaatacccaacatgatgaacattgcactgggccatgccctacattaatacctcataaggagaactggctaacattttctcaagaaaggacaagtagatggggttgcgaagaatttggttgcttggcaattaacactgggtgtgtctttggctcatgccaggatattattcatcctgaagctaaagtttacaggaaagctatagaggaggaggtagttttaactgtctgcataacattcccagggaatacatactgtacagaaataaatgcaatagagcccaaaataacagatgaaatagaattacagtttaaaacagtagatactaaaacattaccaaatttgctaatggttcataatcataaattatatagtggccagattaatgatcttggttctttttcccaggggtgcggcaatgtgcaaaagactaatcagtctgtaatcggggccgggactgtaaaatttgattatgtttgtcatggagccagtaggaaagatgttatagtgagacgctgttacaacaataattatgagtcttgtaagctgttgaaagaagaaacctcccttatatttgcagacaaccatgaaacgttagaagtagcaaatacaaagcatctgataggagaattacagtttaaaattatgttgggagacattagatacaagtcatttgctgaatcaccagaattagaagtagatgcaaaatgtgtgggctgcccttcatgctttgaaagctattcttgcaatttccagattgttacaaatattgatactgtttgttctgttaatgggccttgtacacttttccataacagattaattataagtgctacaaagcaatcttatggtctgaaaatgagttgttcaaggaagcctgaaccaacagaagaattccagatatgtaatcgtaagtatagtgtccttttcactacaattgacaaaaatgataaaattgaaatcaatacaggagaccaaacttcttatatctatgaaaaggataacagatgtaagacatggctttgcagagttagagatgagggaatcagtgttatttttgaacctttaaaggcatttttcggtagttactttagcatcatattttatgtgattgtaggtataattgtattattcttaattgtttatatttttttgcccatgttctttaagttaagagatatattaaaaagaaatgaatatctatacctgcaagaattaaagcacaaatag

SEQ ID NO: 4181 - RNA, 4317 nt, synthetic construct
  misc_feature 1..4317: note = derived and/or modified CDS sequence (wt) from POTV(89-3380)__EU004189.1__GP
  source 1..4317: mol_type = other RNA
atggaacctccaatgaagttgttcctaatacttgcaactgctgtagctgctgtctacagcctacctgcatccagatgttttagtgatggaatcattataaaggaaaaacaagactctaaagcagtcagtgaattttgtttgaaggatgatgtctcaatgataaaatctcatgttgtatattctaaaaatgaatctggaatatttgcaaacagccaaattttaaggaaatggataataaaagactggaaactctgcagccctctaccaacagctggaggccagataaatgtcattgaaattaatcatgatttaacattatcaacaaaaacctatgtgtgcactacagattgtacaataggcattgacaaggaaaatgcacagataacatttcagaccaacaaattaaattattttgaggtctctggaaccacaattagctcaggatggttcaaaagtaagacaagtgtgtcacttgaccaaacatgtgagcatctaaaggtttcatgcggaaaaaaatccatgcaattccatgcatgctttaagcaacatatgtcatgcattagatatctacataagacagcactgccaggttatatggctgcttcaatttgcagtaatatagagttaattattatgaccacattaacactggcaatattcatcctactgtgtattataaccaaaacttacatttgttatctacttatgccactattcatgcctattgcttatatatatggttggttgtataacaagagttgcaaaaagtgcaactgttgtggattatcctatcacccattcactaattgtggctcttattgtgtttgcggagctaagttcgagacatcagatagaatgcggatacatagagaatctggcttatgccaaggttataaaagcctcagagttgcccggaaattatgtaaatccaaaggctcatcattagtgatatcagttaccctctctgtatttatattctcatttattacaccaatagggggtgttattataaatgataaactatcagaagaaaagtacagcataaatcaaatgatggatgctatagtagatcttgaaaacttctctcataatgtttcaggcacacaacaagttatttcagtaatattcttattaatatcctgtttgtttttgctgttaacataccgcctcaataaaatcatacagcacttagctaggtctggcttattattttgtgaggaatgttccatgtatcactcaaaaaaagatataaaatataatggggatttcacaaacaaatgtggcttctgtacatgtggtcaaccagaagacccagaaggcttaaaccttcatatactgtcacaaaactgtacatataagcagcaatttaaatgggtaaaaataattattagtatactactatctctaataatcatagagagtagtatgatactggcagcagcagagacagattgcttctctgaaaagcaaatttcagaattctgcctaggaccattgctgtctatttcaagctgtgaagataagaattctagaacatttaaaggtgaagcacaaaaattagtagcactgaagaaaataacttctgatgaagcaatgttgattgaatcaatgggtgccaaagtggaagatgcattgaaaatgatacaagctcaaaaatccccggactctatgtatactatggagtatgtgttcctaaatacatattgtgattattactctctttttgagcacaacagtggttattcacagataaaatggcgttatatccttaagacacatcaatttgatgcatgtgcaaggcattctaacaaccacttttgtagatgtatgagtgatgggatgcattgccccagcttggattgggatatagcagatgaactaaataacacatatataacaaagccaaatttctttaagcatgattataatctattattagatgtaataaccgcagcatttccaggaacaggtgctgtttttgtaattgatgcttgtaagaaagcaaatgctacagcaatcaagactttctccaataatattatagctagatttccatataacaacttactaaaaggagtaatgaaattcctgcagtatataagtaagcatccatctttcaaaaagtatcaaccagatacacggcattatgacctaatcccagtagcacccactgcaagaggtagatctctaggaaggtcaaatagttacagtgatgcacaagttggtcccccaacaaaagattgccaaaagctgaaagaagttggttgcctaagcccaaaatttggtctgccactagaaagtatcatatcttgcggttcatcacctaactacaaactatataaaaaaccccaaaaatattacaaatcaaacaacaaagaaaacacttggtgcagcaaagatgtacattgcctccatgattttgaaccaataacagaggatgttttagaaaaagtaaaagtcatgacatgttgggagatagaaccaggaactattgaagacatctttaccattgcatcagagacctgcaaaatcaatgatcgtggcgtatgtgaagtgaatgcagcaaaatggaagattgtgaagtgtgagacaggtctctactattacactgaccatagagagggtgatgatactgggtcagatttagggcactactgcctgacacataagtgtgcagggggaagatatcctatcaatcctgaaattttacaaaactgtatttgggagtttcattcgcagaagtcacagtatatcaatcaagtggatcttgagcaaatagaagaatataagaaggccttaacagagaagctaactcatactttgaatcattataattttttacctactaaaaatctcccacatatcagccctaattacaaatatgtgaccctaaatggccaagaaacctctgatggtatagaaaattcttacatagtgtcagagataccagcaattgcaggtacatcaattggcctcaaagtacaaacaaaaaataatggtaacatatttgacctgattatatatgtaaagagagctgatattattgcaagttataatcatatatacgacacagggccaactattggccacaatgtagagcatgaagagttatgcacaggccaatgtcctcaacatataccagctaaagccaattggctcacattttctcaggaaagaacaagtagatgggggtgtgaagaatttggctgcctggctataaacacaggctgtgtgtacggctcctgccaggatattataaaaccagtggcaaaagtttacaggaaatctacagaagaaaaagttgaacttgagttgtgtatagtattgccagataggaatttttgtactactctaaatgcattagagcctaagattacagaggaaatagagctacaattcaaaactatagatcaagtgagccttcctaatatagttctgctgagagaccataagctatttaagggccaaattaatgatttagggaccttcgggcaaaactgtggcaatgttcaaaaaactaaccaaagtatcttgggagctggtacagttagatttgattacctatgtcatagtgcatccagaaaagatatcatcatacggaggtgctataataataactatgattcatgtaatcatttgcaacttgcagaatctttaatttttctggataatcatgaaacactagaggtcaggaaaccaaaccatattttaggaactttgtcaatgaaattaatgctaggcgattttcaatacaaaacatttgctaaggacatagaacttgattttactggtagatgtgttgggtgtatcggttgttttgaagggtttgtctgcgagatgcatattacaacaactgtagaagcaacctgtaatctagaggcgtcatgccaattctttcataaccaactgcatattaaaccagatgtactgaaatactatacaaagatgacatgccaaactgatgagtatataccatcaaagatcaaaatatgcaataaagaatacaaaatcactattgggaaagtccgaaaaaatgataaaattgaaatagacaatagtgatcagaccagttatataaaagaaaaagatgagaggtgtaaaacttggctctgccgagttagggatgaagggatatcagtgatctttgagccattactaaatatatttggcaactatggaagaattgcagttgcagtcattagtgcaatattggcattgattgtactagtatacatcttaatgccaatatgtatgaaaataagggatatactcaagactaatgagaaggagttcctaattgaatcaaaatacaaatag

SEQ ID NO: 4182 - RNA, 4311 nt, synthetic construct
  misc_feature 1..4311: note = derived and/or modified CDS sequence (wt) from TENV(TSV-FE3-66FB)__FJ943508.1__GP
  source 1..4311: mol_type = other RNA
atggagatatttttcattgctttattggcaattgccaattcagttaattccacaccactggcaacacgatgctttcatggtggtcaattaattgcagaatcaaagtctgcaacatcactctcagaattttgtcttaaagacgacgtttctatgataaagtcagagatctactatgtgaagaatgaaaccggaatattcagtcataataaagttctcaggagttggacaattaaggattggaaattctgcaacccagtgcctacagcaggtggtagtataaatgtcatagaagttaactcagacatgagtctagcaacaaaaacatatgtctgtagcagagattgtactataacaatagatagagaagaagctcagattatattccaaacagagaagttaaaccattttgaggtatctgggaccaccctaagctcaggctggtttaaatcaaaggcatctgtgacattagacagaacatgtgagcatcttaaagttacatgtgggaagaaatctctccaatttcatgcttgttttaaacaccacatgtcctgcatccggttcttccataatactatgctacctgggaggatagttaactctatgtgtcaaaacatagaattaatcataatacttggcttaacaatagttatatttatcttaatggtgatactaactaagacatatatctgctatattttaatgcctctattcatgccaatagcttacatatatggctgggcatataacaagagttgcaaaaaatgcaattgctgtgggttagcataccatccttttacaaattgtggctctcactgtgtgtgtggtctaaaatttgaagcctcagacagaatgcgcatacatagagaatcaggattatgtcaaggttataaaagcttgagaatagcaagattactgtgtaaatcaaaaggctcatcgttggttatttctatcttgctatctatgctgctgttaagttttgtgacacctatagaaggggctctaacaaactaccctcagtcaaaactatactctcttgaagagattgcagatgttgttgagggcttgatcacagaacacaatgttaaagaatatattgttttctacacctcattatttggaggattaatcttgttacttgcattcatcttatctatcatgctaacaaaagtgaccagtatgcttgctagaacaaatgtcatttactgtgaagaatgttcaatgtatcactcaaaaacagggataaagtataatggtgatttcacaaataaatgtggtttttgcacatgtgatgaacaagaagatgcggaaggtataatcatacataaggtaagcaagaagtgcacttataaatatcaactaaaatgggctaggatcattatgataatattgattgtcttattaacaacacaaaatacaattcttatagttgctgcagaagtagattgctgggaaagagcaacacttagtcaggaatgcattggtccattgcaaaagatagaagattgccaaaataaagaagaaaagacctacatgtctgaagccaacaaacttgttagccagtcaaaaataacacaagcagatgctgatcaggtgtctgtactaggggatacaatagatagcgcaatcaaagctataagatcgcaaaagacatatcagactatgcatctgctagagacagtattcttgatgaagaactgtgattattacagcacttttgaacataatagcggttactctcaggcaaaatggagactaatggcaaagacaaatcattttgacatatgctctagacacagcaaccaccatttttgtagatgtgtgactgaaggtacaaaatgtcaaaatggtgattgggactttgcaggtgaaatgaattctacatataatacaaaaagtgatttttaccaacatgatttgaacctcttcttctcactatacgaatcagccttccctggtactgcagaatcattattctatcaactaatatcagaaaaaaacacaacaggggcatcccaattgcttggacaaattattaaaaagtttgcaaataacaatatgcttataggagtctggaaatttggacagtacctcttaacattgccttatgtcaacaccacaaaactaagcaaatctagagaagaaaccatattgacaaatcatcaacgtttagtcaggagttacactggcagacagcagtcaatggccaatgctgaagttggtgaatcaaccaagaattgcctcaatgctaagaatgttggctgtattagccctagatttggagtccctattggtaacctgactgtatgtggggaatctacaaattataaggtctacaaaacaccagccaaaatatataaatcaaataataggcctaagacttggtgctcagaagatgtgcactgtttatctaattttgagcctgcaagtgcagaggtagtcaacaaaataaagcgaatgacatgctttttgacagatgtcacaacaaatgtagatgtcttctcaatagctatatcaacttgcaaaatggctgataaaggtgtgtgcactgtgaatgatgctagatggagtattctgaagtgtgacagtggcctgctctattttactgatcatagagagggccaagatacaggaaatgattttggagagtattgtatctcacataactgcaacacagagcgatatcccatcaatccagatatcatcaaggactgcatatgggaatatcattcaaggaagtcaaagtatatatcagcaattaacttagagtcattagaggaattcagaagagctatgtcagaaaagctatctcataccctagtaatttataatttcaaacccacagcaaatttaccacatattaaacctagttacaaatctatcacagttaatgggatagaaaattcagatggcatagagtcagcatatatcttatctaatatcccagctataggtggcatgagtgtcggttataatgtactgactaaggatggcttcccactattagatataataatattcatcaaaagtgcagttatcaaaacaacttataatcatatttatgatacaggaccaacaataggaatcaatactttacacgacgaaaagtgcacagggccatgcccatctataataccacataaagaaaactggttaacattttcacaagaaaggacaagcagatggggttgtgaagaatttggttgcttggctataaatacaggttgtgtctttggttcatgccaggatattattcggccagaaaccaaaatttacagaaaagctgtagaagaggaagttatattgaatgcatgcataaatttcccaggcaatacatactgtactgaaataaatgcaattgagccaaaaattactgacgagattgagctgcaattcaaaactgtagatactaagacattaccaaacttattagcagtacaaaatcacaaactatatagtggtcagattaatgatatagggacattctcacagggatgtggaaatgtgcaaaaaactaatcaaactatgcttggcactggcacagtaaggtttgattatgtttgtcatggagctagcaggaaagatattatagttagaagatgctataacaataattatgaatcttgtaaattgctgaaagaagaaaaatctctaatatttgctgacaaccatgagacattagaagttgcaaatacaagacatctgctaggtgaattacagtttaagataatgttaggtgatatcagatacaaggcatttgctgaaaaacctgaactggaaatagatgccaagtgtgttggatgtccatcatgttttgaaagttattcttgcaacttccaaattgtaagcaatgtggatactgtttgttacatagaaggaccatgtacacttttccacaatagaattatcataaaaacaatgaagcaagcatatgggattaaaatgagctgcaaaacaaagccagcccctagtgaagaattcaaaatatgcggacgtacttataatgttgcttttaatacagtggaaaaaaatgataagattgaaataaatactggtgatcaaacgtcatatataagtgaaaaggacgataggtgtaaaacatggttgtgccgtgttcgagatgaaggcataagtgtcatctttgaaccattaaaaaatctatttggaaattactttaacattgcattctatataataataggtctaattgcgttatttttaacaatttatatcttcttaccaatgttcttcaaattaagagatgttttgaaaagaaatgagtatttatacttgcaggagttgaaacacaaataa

SEQ ID NO: 4183 - RNA, 4311 nt, synthetic construct
  misc_feature 1..4311: note = derived and/or modified CDS sequence (wt) from TENV(TSV-FL06)__FJ943506.1__GP
  source 1..4311: mol_type = other RNA
atggagatatttttcattgctttattggcaattgccagttcagttaattccacaccactagcaacacgatgctttcatggtggtcaattaattgcagaatcaaagtctgcaacatcactctcagaattttgtcttaaagatgacgtttctatgataaagtcagagatctactatgtgaagaatgaaaccggaatattcagttataataaagttctcaggagttggacaattaaggattggaaattctgcaacccagtgcctacagcaggtggtagtataaatgtcatagaagttaactcagacatgagtctagcaacaaaaacatatgtctgtagcagggattgtactataacaatagatagggaagaagctcagattatattccaaacagaaaaattaaaccattttgaggtatctgggaccactctaagctcaggctggtttaaatcaaaggcatctgtgacattagacagaacatgtgaacatcttaaagttacatgtgggaagaaatctctccaatttcatgcttgctttaaacaccacatgtcctgcatccggttcttccataatactatgctacctgggaggatagttaactctatgtgtcaaaacatagaattaatcataatacttggcttaacaatagttatctttatcttaatggtgatactaactaagacatatatctgctatattttaatgcctctattcatgccagtagcttacatatatggctgggcatataacaagagttgtaaaaaatgcaattgctgtgggttagcatatcatccttttacaaattgtggctctcactgtgtatgtggtctaaaatttgaagcctcagacagaatgcgcatacatagagaatcaggattatgtcaaggttataaaagcttgagaatagcaagattactgtgtaaatcaaaaggctcatcgttggttatttctatcttgctatctatgttgctgttaagttttgtgacacctatagaaggggctttaacaaattaccctcagtcaaaactgtactctcttgaagagattgcagatgttgttgagggcctgatcacagaacacaatgttaaagaatatattgttttttacacctcattgtttggaggattaatcttgttacttgcattcatcttatctatcatgctaacaaaagtgaccagtatgcttgctagaacaaatgtcatttactgtgaagaatgttcaatgtatcactcaaaaacagggataaagtataatggtgatttcacaaataaatgtggtttttgcacatgtgatgaacaagaagatgcagaaggtataatcatacataaggtaagcaagaagtgcacttataaatatcaactaaaatgggctaggatcattatgataatattgattgtcttattaacaacacaaaatacaattcttatagttgctgcagaagtagattgctgggaaagagcaacacttagtcatgaatgcattggtccattgcaaaagatagaagattgccaaaataaagaagaaaagacctacatgtctgaagccaacaaacttgttagccagtcaaaaataacacaagcagatgctgatcaggtctctgtactaggagatacaatagatagcgcaatcaaagctataagatcgcaaaagacatatcagactatgcatctgctagagacagtattcttgatgaaaaactgtgattattacagcacttttgaacataatagcggttactctcaggcaaaatggagactaatggcaaagacaaatcattttgatatatgctctagacacagcaaccaccatttttgtagatgtgtgactgaaggtacaaaatgtcaaaatggtgattgggactttgcaggtgaaatgaattctacatacaatacgaaaagtgatttttatcaacatgatttgaacctcttcttctcactatacgaatcagccttccctggtactgcagaatcattattctaccaactaatatcagaaaaaaacacaacaggggcatcccaattgcttggacaaatcattaaaaagtttgcaaacaataatatgcttataggagtctggaaatttggacagtacctcttaacattgccttatgtcaacaccacaaaactaagcaaatctagagaagaaaccacattgacaaatcaccaacgtttagtcaggagttacactggcagacagcagtcaatggctaatgctgaggttggtgaatcaaccaagaattgcctcaatgctaagaatgttggctgtattagccctagatttggagtccctattggtaacctgactgtatgtggagaatctacaaattataaggtctacaaaacaccagccaaaatatataaatcaaataataggcctaagacttggtgctcagaagatgtacactgtttatctaattttgagcctgcaagtgcagaggtagtcaacaaaataaagcgaatgacatgctttttgacagatgtcacaacaaatgtagatgtcttctcaatagctatatcaacttgcaaaatggctgacaaaggtgtgtgcactgtgaatgatgctagatggagtattctgaagtgtgacagtggcctgctctattttactgaccacagagagggccaagatacaggaaatgattttggagagtattgtatctcacataactgcaacacagagcgatatcccatcaatccagatatcatcaaggactgcatatgggaatattattcaaggaagtcaaagtatatatcagcaattaacttagagtcattagaggaattcagaagagctatgtcagaaaagctatctcataccctagtaatttacaatttcaaacccacagcaaatttaccacatattaaacctagttacaaatctatcacagttaacgggatagaaaattcagacggcatagagtcagcatatatcttatctaatatcccagctataggtggcatgagtgtcggttataatgtactgactaaggatggcttcccactattagacataataatattcatcaaaagtgcagttatcaaaacaacttataatcatatttatgatacaggaccaacaataggaatcaatactttacacgacgaaaagtgcacaggaccatgcccatccataataccacataaagaaaactggttaacattttcacaagaaaggacaagcagatggggttgtgaagaatttggttgcttggctataaatacaggttgtgtctttggttcatgccaggatattattcggccagaaaccaaaatttacagaaaagctgtagaagaggaagttatattgaatgcatgcataaatttcccaggcaatacatactgtactgaaataaatgcatttgagccaaaaatcactgacgagattgagctgcaattcaaaactgtagatactaagacattaccaaacttattagcagtacaaaatcacaaactatatagtggtcagattaatgatatagggacattctcacagggatgtggaaatgtgcaaaaaactaatcaaactatgcttggcactggcacagtaaggtttgattatgtatgtcacggagctagcaggaaagatattatagttagaagatgctataataataattatgaatcttgtaaattgctgaaagaagaaaaatctctaatatttgctgacaatcatgagacattagaagttgcaaatacgagacatttgctaggtgaattacaatttaggataatgttaggtgatatcagatacaaggcatttgctgaaaaacctgaactggaaatagatgccaagtgtgttggatgtccatcatgttttgaaagttattcttgcaacttccaaattgtaagcaatgtggatactgtttgttacatagaaggaccatgcacacttttccacaatagagttatcataaaaacaatgaagcaagcatatgggattaaaatgagctgcaaaacaaagcctgcccctagtgaagaattcaaaatatgcggacgtacttataatgttgcttttaatacagtggaaaaaaatgataagattgaaataaatactggtgatcaaacgtcatatataagtgaaaaggatgataggtgcaaaacatggttgtgccgtgttcgagatgaaggcataagtgtcatctttgaaccattaaaaaatctatttggaaattactttaacattgcattctatataataataggtctaattgcattatttttaacaatttatatcttcttaccaatgttcttcaaattaagagatgttttgaaaagaaatgagtatttatacttgcaagagttgaaacacaaataa

SEQ ID NO: 4184 - RNA, 4305 nt, synthetic construct
  misc_feature 1..4305: note = derived and/or modified CDS sequence (wt) from TLAV(61D240)__KX100119.1__GP
  source 1..4305: mol_type = other RNA
atgctattcttgctcatactagcctttttagggttctcaacgagcaaccctattgcaactaggtgtttccatgggggccaattaatagcagagtcaaagtctgctacatctatatcagaattctgcctcaaggatgatgtctcaatgttaaaatctgaagtggtatatacaaagaatgatactgggctatttggtcataataaagtttttagaagctggacaataaaagattggaaactctgcaatcctatacctactgcaggaggaacaataaatgtaattgaggtcaataaagatcttagtctaatgacaaagacatacatatgtagtagagattgcactataaccatagataaagaggaagctcagattatcttccaaacagataagctaaatcattttgaagtgtctggtaccacattaaattcaggatggttcaaaagcaaggcgtctgtcaccctggatagaacctgcgagcatgttaaggttacttgtggaaaaaaatctctgcaattccatgcatgctttaagcaccacatgtcatgtgttaggttcttccacaataccatattacctggcaatatgataacctcaatgtgccagaatatagaattaataattatcttagggctaacattagccatatttatattaatggttatgcttacaaagacttatatatgttacttattgatgccaattttcatgccaatagcttatctttatggttgggcctataacaaaagctgcaaaaagtgtaactgctgtggtctagcataccatccatttactaattgtggctcacactgtgtttgtggcttgaaatttgaggcatcagataggatgaggatccatagagaatctggcttgtgtcaagggtacaagagtttacgaattgccaggcttttgtgtaaatctaaagggtcatctctagttatatctggattattgtccatgttaatcttaagctttgtaacgcctatagagggaactataactagctacccagaaagcaggaaatatacactggaagagataacagatgttgttgaaggattggtatctgagcagaatataaaggagtacattgttttctacacctcattgtttggaagtttaatactattactagcatttataatgtctataactttaagcaaaataacaagcatactagcaagaagaaatgttatttattgcgaagaatgctcaatgtatcattcaaaaagaggcataaagtataacggtgacttcacaaacaaatgcggcttttgcacatgcaatgaacaggaggatgcagaagggttagtaatacataaagttagtaagagatgcacatataaatatcaactaaagtgggctaaagtgctgatggttacactggtcttgcttctaatagcgcaaaacactattctaattgttgcagctggaacagattgctggacaaaaaaaagcctagatatagactgtataggaccaatgttagacataggctcttgcacaaataagaataccagaaactatgatacagaagcacagaaattggtgagccagtctaaagtaagtcaactagatgcagaccaggcatcgttgttaggcaactctatagatagtgctattaaagcaataagagcccagaaaacttatcctacaatgcacttgttggaaacaatattcttaatgaaaaattgcgattattacacaagttttaaccataacagtggctattcacaagctaaatggcgattaattgcaaaaacagggcactttgatatatgttctagacatagcacccaccatttttgccgatgtataaatgatgggaccaaatgtcagaatggtgattgggattttgctggtgaaatgaatgaaacttacaatagcaaaaatgatttttattcacatgatctgaacttgttttacacaatttttgaaaatgcattcccagggactactgaatccttattttaccagttgatccaaaagaaaaatactacaggggcctccaaaatcttgggaaagttaataaccaagtatggtaataagaacatgttcgttggagtctggaaatttggacagtacttacttacattaccatatataaataatactgaattgagccagaacaggagacaaacaatcttggcaacacaagaatcattaagtagatcgcactctggcaggcaggagtctatgtccagtgcaattcagggcagtgttacaaaagaatgccataatgcaaaagatgttgggtgcataagccctcggtttggcattccaattggtaacctcacagcatgtggcgactcacctaattataagatatataagactccagaaaagttgtataaatcaaataataaaggggaagtttggtgttcgaatgatgttcactgcctgaatgattttgagcctgcagatgaagaagttgtcaataaagttaaaaaactcacttgtttcttaacagacgtctcagttaaaacagacatcttttcagtagctgcatccacatgtaagatggcagataaaggcgtttgtacagtgaatgatgctaaatggaatataatcaagtgtgatagtggattatactattttacagaccatagggaaggtcaggacacaggcaatgattttggtgagtattgtatatctcacagttgcaataccgagcgattccctatcaacccagacatattaaaagattgcacttgggagttccattccagaaagtctaaatatatttcaaccatcagtttagaatcattggaagaattcaggagggcaatgacagagaagttatcacacaccctaacaatttacaattttaaaccaacagctaaccttcctcatattaggccaacttacaaattcatcacagcaaatggtgtcgaaaactctgacggtattgaatcagcatatatcttgtctagtatccctgcattaggtggaattagtgttggttataatgttcaaaccaaagacaatttcccattattggatataattgtatttattaaaagtgcagtcatcaggacaacatacaaccatatttatgatactgggcctactataggtataaacacacaacatgatgagcactgcacagggccatgcccagctgtggtgccacataaagaaaactggataacattttctcaggaaagaacaagtagatgggggtgtgaagagtttggttgcttggccatcaacacagggtgtgtttttggttcttgccaagatataatacatccagaaaccaaagtataccgtaaagcagtagaagaagaagttatcttaacggtgtgcattaatttcccaggtaataattactgcacagagataaacgccattgagcctaagataacagatgagatagagctccagttcaaaacagtcgatacaaaaaccttgcccaaccttcttgcagtgcaaaatcacaaactttacagtggccagataaacgatttgggctctttttcacaaggttgtggaaatgtccaaaaaacaaatcactcaatcctaggcatgggtacagccaaatttgattatgtctgtcatggtgctagtagaaaagatgtgatagtcaggaggtgctataataataattttgattcatgcaaattactgaaagaagaaacatcattgatatttgcagataatcatgagactctggaggtagcacacacaaagcatctgataggtgaattacagtttaaaataatgttaggagatataagatacaaatcatttgctgaatcacctgagctggaaattgatgcaaaatgtgttgggtgtccatcatgttttgaaagttactcctgcaacttccaaatagtgacaaatatagacaccgtatgctcagtcgaagggccatgcacactatttcataaccgaattattatatcagctaacaagcagtcatatggactcaaaatgagttgccaaacaaagcctaaccaaaatgaagagttcattatctgcaacaggaaatatagtgtcctattcacaacaattgataaaaatgacaaaatagaagtgaatacaggggaccagacttcatatatttatgaaaaggacagcagatgtaagacttggttgtgcagggttagagatgaggggatcagtgtcctatttgaaccattaaaagcattctttggaagttactttagcataatattttatgttgtcgttggaattattgtccttttcttgattatatacatatttttgccaatgttcttcaaactaaaagatgttttgaaaagaaatgaatatttgtatcttcaggaactgaaacataaatga

SEQ ID NO: 4185 - RNA, 4305 nt, synthetic construct
  misc_feature 1..4305: note = derived and/or modified CDS sequence (wt) from NRIV(9800535)__AY593725.1__GP
  source 1..4305: mol_type = other RNA
atgttgctacttcttgtcttattaatcccctgctatgtatcagcctctcctgtagtaacaagatgcttccatggagggcaattgatagcagagaagaaatcccaaacagctgtatcagaattttgcctgaaagatgatgtctctactattaagtcagaaataacatatgagaagaacaacactggtttatttgcccatagcaaagttttacgaaattggatcataaaagattggaaaaattgcaaccctgttcccacagcagggggcagcataaatgttatagaagtcaatacagatctgagcttgaccacaaaaacatatgtgtgtagcagagactgcacaattacagttgataaagaggatgctcagataattttccaaaccgagaagttgaaccatttcgaggtctctgggactacattaagctcaggctggtttaaaaccaaagcatcagtaacattggacaggacttgtgaacatattaaagtaacatgtgggaaaaagactctgcaattccatgcttgctttaagcaccacatgtcatgtattagattcttccatggcactattcttcctggaacaatggctacttccatttgtcaaaatatagaactcataattataataagtctgacattgattatctttatcctgatgataatattaaccaaaacctatatatgttatctattgatgccactatttatgccgattgcatacttttatggttggtcatataacaaaagctgcaaaaaatgctcatgctgtggtctagcttatcacccctttacaaattgcgggtcacattgtgtatgcgggttaaaatttgaagcgtcagataggatgagaatacacagagaatccggattatgtcaaggttataagagtctacgtgtggctagattgttgtgcaagtcaaaaggttcatctctcgtaatctcaatattattatctatgttgatactaagctttgtcacaccaatagaggggacattaactaactacccagaatcaaggaagtatgatctggaggaaattgctgatgtcctggaaggatttattgtagaaaaagggataaaagaatacgtagttttttatacttctatttttggggctttactcttactaatagcattagttatcacaataacactaaataaggttacagagtatctcacaaacatcaatgttctatactgttatgaatgttcaatgtatcactcgaagaagaatataaaatatattggggattttacaaataaatgtggcttttgcacatgtggagagttggaagatcaagaaggtttaaaaatacataaagttagcagaaagtgcatatataaatatcaactaacctggtctaaaataatcatgacaatactagtgtgtctactgattgctcaaaacaccatcctaatagtcgcagcatcggatgattgctggacaaaaaaatctttagagatggaatgtataggccctttacagcaagtggatacatgcgacgataaagcaagcagatcttatagtggggaggcaagaaagctagtgagagcatctaaaatatcggacctggatgcagcacaggtggggctattaggatctacgatagaatcagcaatagcaagtataagaaagcagagaacatatccaaccatgcatctccttgaatcagtattcctgggaaagcattgtgattactataaaactttcgaacataatagtggctactcacaggcaaagtggaggttaacagctaaaacacatcattttgatatttgctcaagacatagcacccatcatttctgtagatgtatctcagatgggacaaagtgtcaaaatggggatttggactttgcaggtgaaatgaactcaacataccagtcaaaaaaggatttttttgagcacgacttcaagctattctgcactcttgtagaaaatgcttttccaggcacaacagagtcacttttttatgaaatgttgtctaagaaaaacacaactggtatcaaacagctattagataaattaacaagaaaatttgggaataacaatatgtttgtagggatatggaaatttggacagtatctaatgtcactgccatatattaatgaaacatcattaacccctgctcaaatttctaaaatactagaggttacagaccagcaccatcggtctatatctggaaggcaagaatcattggctagtgctacccctgggagtaagtccaaggaatgtggtcatgcaaaaaaggtctcttgcataagtcccaggtttagtgttccgatggaaggattaatggcatgtggggactcaccaaattacaaaatttataaaacaccaacaaagctttataaatcaaacaataagggggaagtgtggtgctcaggtgatgtccattgttctcaggagctaagcccagcatcacaagaatctgttgacaggataaaacaaattacttgctttctgacagaacctgaagtaagtgatgacgttttttcaattgcaatatctacgtgcaaagttcaagataagggggtatgtacagtaaatgaagataggtggaacgtaataaaatgtgatagtgggctgatatattatactgaccagagagatgggcaggatacaggcaatgatttcggagagtattgtttgtcccatagctgcagaatagagaggttccccataaacccggcaataattagggactgtttatgggagtaccattcgcggaaatccaaatatatcaccagcttggacttagagaatctagaagaattcaaaagggctatttctgaaaaattatcacatactcttatagtttataatttcaaaccaacagctaatcttccccatataaagccggtgtacaaatatatcacagtgcaaggggtagagaattctgatggagtagattcagcatatatagctgctagtatgccagctttgagcggaacaagtataggatataatataatgtctagagataatttcccattatttgatataattatatttataaaaagtgctattattaaggcaacttacaatcatatatatgacacaggccccactataggaattaatgtaatgcatgatgaacattgcacagggcaatgtccaacagatataccacataaagaaaattggattacatttgctcaagagagaactagtcgttggggatgcgaagaatttgggtgccttgctgtaaatacaggctgtgtttttggttcttgtcaagatataataaggccagaaacaaaggtgtatcgaaaagcagttgaggagagtgttttattgacagtatgtataacttacccaggcaaaacattctgcacagaaataaatgccatagaacctaaaatcacagatgagttagaattacagttcaaaacagttgatacaaaaacattacccaatatcttagctgtccaaaaccataagttatatagtggacaaattaatgatttgggatcattttctcaaggctgtggcaacatacagagaaccaattcatctattataggcacaggtactgcaaagtttgattatgtttgtcatggtgcttccaggaaagatatcattgtaaggagatgttacaataataactatgagtcatgcaaattattgaaggaggaacaatctttaatgttcgcagataaccatgaaactattgacgtagctaatgtcagacatctccttggagatctgcaatttaaattaatgttgggagatctaaggtataagtcatttgctgaaaacccagatttagaaatagaggcaaagtgtgttgggtgcccatcatgttttactagttactcctgcagcttcaagattgcttcaaatattgacactgtatgctcaattgaagggccttgtacgacttttcataatagattaatgattacctctacaaaacaagattatggcatcaaaatgagctgtaaaacaaaaccaaaagaaacagaagagttccagatttgcaagaaaacttacacagtattgttcacaacagttgagaaaaatgataaaatcgaaataagcacaggggatcaaacatcctttatccaagagagggatgatagatgcaaaacatggttatgcagagttagggatgaagggatcagtgttatttttgaaccaataagggctttctttggaagctactttagtatagctttttatgtagtgatcagtattattgtcctatttctagcaatctacatcttcttgcctatggtgttcaaacttagagatgtgttaaaaaggaatgaatatctatacttgcaggaaataaagcataaataa

SEQ ID NO: 4186 - RNA, 4305 nt, synthetic construct
  misc_feature 1..4305: note = derived and/or modified CDS sequence (wt) from NRIV(GSA/TS7/5170/WT)__KM514677.1__GP
  source 1..4305: mol_type = other RNA
atgttgttacttcttgtcttattaatcccctgctatgtatcagcctctcctgtagtaacaagatgcttccatggagggcaattgatagcagagaagaaatcccaaacagctgtatcagaattttgcctgaaagatgatgtctctactattaagtcagaaataacatatgagaggaacaacactggtttatttgcccatagcaaagttttacgaaattggatcataaaagactggaaaaattgcaaccctgttcccacagcagggggcagcataaatgttatagaagtcaatacagatctgagcttgaccacaaaaacatatgtgtgtagcagagattgcacaattacagttgataaagaggatgctcagataattttccaaaccgagaagttgaaccattttgaggtctctgggactacattgagctcaggctggtttaaaaccaaagcatcagtaacattggacaggacttgtgaacatattaaagtaacatgtgggaaaaagactctgcaattccatgcctgctttaagcaccacatgtcctgcattagattcttccatggcactattcttcctggaacaatggctacttccatttgtcaaaatatagaactcataattataataagtctgacattgattatctttatcctgatggtaatattaaccaaaacctatatatgttatctattgatgccactatttatgccgattgcatacttttatggttggtcatataacaagagctgtaaaaaatgctcatgctgtggtctagcttatcacccctttacaaattgcgggtcacattgtgtatgtgggttaaaatttgaagcgtcagataggatgagaatacacagagaatccggattatgtcaaggctataagagtctacgtgtggctagattattgtgcaagtcaaaaggttcatcccttgtaatctcaatattattatctatgttgatactaagctttgttacaccaatagaggggacattaactaactacccagaatcaaggaagtatgatctggaagaaattgctgatgtcctggaaggatttattgtagaaaaagggataaaagaatatgtagttttttatacatctatttttggggctttactcttactaatggcattagttatcacaataacactaaataaggttacagagtatctcacaaacatcaatgttctatactgtcatgaatgttcaatgtatcactcgaagaaaaatataaaatatattggggattttacaaataaatgtggcttttgcacatgtggagagttggaagatcaagagggtttaaaaatacataaagttagcagaaagtgcatatatagatatcaactaacctggtctaaaataatcatgacaatactagtgtgtctactgattgctcaaaacaccatcctaatagtcgcagcatcagatgattgctggacaaaaaaatctttagagatggaatgtataggccctttacagcaagtggatacatgcgacgataaagcaagcagatcttatagtggggaggcaaaaaagctagtgagagcatctaaaatatcagatctggatgcagcacaggtggggttattaggatctacgatagaatcagcaatagcaagcataagaaagcagagaacatatccaactatgcatctccttgaatcggtattcctgggaaagcattgtgattactataaaactttcgaacataatagtggctactcacaggcaaagtggaggcttacagctaaaacacatcattttgatatttgctcaagacatagtactcatcatttctgtagatgtatctcagatgggacaaagtgccaaaatggggattgggattttgcaagtgaaatgaactcaacataccagtcaaaaaaggatttttttgagcacgacttcaagctgttctgcactcttgtagaaaatgcttttccaggtacaacagagtcacttttttatgaaatgttgtctaagaaaaacacaactggtatcaaaaacttattagataaattaacaagaaaatttgggaataacaatatgtttgtagggatatggaaatttggacagtatctaatatcactgccatatgttaatgaaacatcattaacccctgctcaagtttctaaaatactagaggttacagaccaacaccatcggtctatatctggaaggcaagagtcgctggctagtgctacctctgggagcaagtccaaggaatgtggtcatgcaaaaaaggtctcctgcataagtcctaggtttagtgttccgatggaaggattaatggcatgtggggactcaccaaattacaaaatttataaaacaccagcaaagctttataaatcaaacaataagggggaggtgtggtgctcaggtgatgtccattgttctcaggaactaagcccagcatcacaagaatctgttgacaggataaaacaaattacttgctttctgacagaacctgaagtaagtgatgacgttttttcaattgcaatatctacatgcaaagttcaagataagggggtatgtacagtaaatgaagataggtggaacgtaataaaatgtgatagtgggctgatatattatactgaccagagagatgggcaggatacaggcaatgatttcggagaatattgtttgtcccatagctgcagaatagagaggttcccaataaatccgacaataattagtgattgtttatgggagtaccattcgcggaaatccaagtatatcaccagcttggacttagagaatctggaagaattcaaaagggctatttctgagaaattatcacatactcttatagtttataatttcaaaccaacagctaatcttccccatataaagccggtatacaaatatatcacagtgcaaggggtggagaattctgatggagtagattcagcatatatatctgctagtatgccagctttgagcggaacaagcataggatataatataatgtctagagacaatttcccattatttgatataattatatttataaaaagtgctattattaaggcaacttacaatcatatatatgacacaggtcccactataggaattaatgtaatgcatgatgaacattgcacagggcaatgtccaacagatataccacataaagaaaattggattacatttgctcaagagagaactagtcgttggggatgtgaagaatttgggtgccttgctgtcaatacaggctgtgtttttggttcttgtcaagatataataaggccagaaacaaaggtgtatcgaaaagcagttgaggagagtgtgctattgacagtatgtataacttacccaggcaaaacattctgcacagaaataaatgccatagaacctaaaatcacagatgagttagaattacagttcaaaacagttgacacaaaaacattacccaatatcttagctgtccaaaatcataagttatatagtggacaaattaatgatttgggatcattttcacaaggctgtggcaacatacagaaaaccaattcatccattataggcacaggtactgcaaagtttgattatgtttgtcatggtgcttccaggaaagatatcattgtaaggagatgttacaataataactatgagtcatgtaaattattgaaggaggaacaatctttaatgttcgcagataaccatgaaactattgacgtagctaatgtcaggcatctccttggagatctgcaatttaaattaatgttgggagatctaaggtacaagtcatttgcagaaaacccagatttggaaatagaggcaaagtgtgttgggtgcccgtcatgttttactagttactcctgcagcttcaagattgcttcaaatattgacactgtatgctcaattgaagggccttgtacaacttttcataatagattgatgattacctctacaaaacaagattatggcatcaaaatgagctgtaaaacaaaaccaaaagaaacagaagagttccagatttgcaagaaaacttacacagtattattcacaacagttgagaaaaatgataaaatcgaaataagcacaggggatcaaacatcctttatccaagagagggatgatagatgcaaaacatggttatgtagagttagggatgaagggattagtgttatttttgaaccaataagggctttctttggaagctactttagtatagctttttatgtagtagtcattattattgtcctatttctagcaatctacatcttcttgcctatggtgttcaaacttagagatgtgttaaaaaggaatgaatatctatacttgcaggaaataaagcataagtaa

SEQ ID NO: 4187 - RNA, 4305 nt, synthetic construct
  misc_feature 1..4305: note = derived and/or modified CDS sequence (wt) from NRIV(TND/S1/19801/WT)__KM514679.1__GP
  source 1..4305: mol_type = other RNA
atgttgttacttcttgtcttattaatcccctgctatgtatcagcctctcctgtagtaacaagatgcttccatggagggcaattgatagcagagaagaaatcccaaacagctgtatcagaattttgcctgaaagatgatgtctctactattaagtcagaaataacatatgagaggaacaacactggtttatttgcccatagcaaagttttacgaaattggatcataaaagactggaaaaattgcaaccctgttcccacagcagggggcagcataaatgttatagaagtcaatacagatctgagcttgaccacaaaaacatatgtgtgtagcagagattgcacaattacagttgataaagaggatgctcagataattttccaaaccgagaagttgaaccattttgaggtctctgggactacattgagctcaggctggtttaaaaccaaagcatcagtaacattggacaggacttgtgaacatattaaagtaacatgtgggaaaaagactctgcaattccatgcctgctttaagcaccacatgtcctgcattagattcttccatggcactattcttcctggaacaatggctacttccatttgtcaaaatatagaactcataattataataagtctgacattgattatctttatcctgatggtaatattaaccaaaacctatatatgttatctattgatgccactatttatgccgattgcatacttttatggttggtcatataacaagagctgtaaaaaatgctcatgctgtggtctagcttatcacccctttacaaattgcgggtcacattgtgtatgtgggttaaaatttgaagcgtcagataggatgagaatacacagagaatccggattatgtcaaggctataagagtctacgtgtggctagattattgtgcaagtcaaaaggttcatcccttgtaatctcaatattattatctatgttgatactaagctttgttacaccaatagaggggacattaactaactacccagaatcaaggaagtatgatctggaagaaattgctgatgtcctggaaggatttattgtagaaaaagggataaaagaatatgtagttttttatacatctatttttggggctttactcttactaatggcattagttatcacaataacactaaataaggttacagagtatctcacaaacatcaatgttctatactgtcatgaatgttcaatgtatcactcgaagaaaaatataaaatatattggggattttacaaataaatgtggcttttgcacatgtggagagttggaagatcaagagggtttaaaaatacataaagttagcagaaagtgcatatatagatatcaactaacctggtctaaaataatcatgacaatactagtgtgtctactgattgctcaaaacaccatcctaatagtcgcagcatcagatgattgctggacaaaaaaatctttagagatggaatgtataggccctttacagcaagtggatacatgcgacgataaagcaagcagatcttatagtggggaggcaaaaaagctagtgagagcatctaaaatatcagatctggatgcagcacaggtggggttattaggatctacgatagaatcagcaatagcaagcataagaaagcagagaacatatccaactatgcatctccttgaatcggtattcctgggaaagcattgtgattactataaaactttcgaacataatagtggctactcacaggcaaagtggaggcttacagctaaaacacatcattttgatatttgctcaagacatagtactcatcatttctgtagatgtatctcagatgggacaaagtgccaaaatggggattgggattttgcaagtgaaatgaactcaacataccagtcaaaaaaggatttttttgagcacgacttcaagctgttctgcactcttgtagaaaatgcttttccaggtacaacagagtcacttttttatgaaatgttgtctaagaaaaacacaactggtatcaaaaacttattagataaattaacaagaaaatttgggaataacaatatgtttgtagggatatggaaatttggacagtatctaatatcactgccatatgttaatgaaacatcattaacccctgctcaagtttctaaaatactagaggttacagaccaacaccatcggtctatatctggaaggcaagagtcgctggctagtgctacctctgggagcaagtccaaggaatgtggtcatgcaaaaaaggtctcctgcataagtcctaggtttagtgttccgatggaaggattaatggcatgtggggactcaccaaattacaaaatttataaaacaccagcaaagctttataaatcaaacaataagggggaggtgtggtgctcaggtgatgtccattgttctcaggaactaagcccagcatcacaagaatctgttgacaggataaaacaaattacttgctttctgacagaacctgaagtaagtgatgacgttttttcaattgcaatatctacatgcaaagttcaagataagggggtatgtacagtaaatgaagataggtggaacgtaataaaatgtgatagtgggctgatatattatactgaccagagagatgggcaggatacagcgaatgatttcggagaatattgtttgtcccatagctgcagaatagagaggttcccaataaatccgacaataattagtgattgtttatgggagtaccattcgcggaaatccaagtatatcaccagcttggacttagagaatctggaagaattcaaaagggctatttctgagaaattatcacatactcttatagtttataatttcaaaccaacagctaatcttccccatataaagccggtatacaaatatatcacagtgcaaggggtggagaattctgatggagtagattcagcatatatatctgctagtatgccagctttgagcggaacaagcataggatataatataatgtctagagacaatttcccattatttgatataattatatttataaaaagtgctattattaaggcaacttacaatcatatatatgacacaggtcccactataggaattaatgtaatgcatgatgaacattgcacagggcaatgtccaacagatataccacataaagaaaattggattacatttgctcaagagagaactagtcgttggggatgtgaagaatttgggtgccttgctgtaaatacaggctgtgtttttggttcttgtcaagatataataaggccagaaacaaaggtgtatcgaaaagcagttgaggagagtgtgctattgacagtatgtataacttacccaggcaaaacattctgcacagaaataaatgccatagaacctaaaatcacagatgagttagaattacagttcaaaacagttgacacaaaaacattacccaatatcttagctgtccaaaatcataagttatatagtggacaaattaatgatttgggatcattttcacaaggctgtggcaacatacagaaaaccaattcatccattataggcacaggtactgcaaagtttgattatgtttgtcatggtgcttccaggaaagatatcattgtaaggagatgttacaataataactatgagtcatgtaaattattgaaggaggaacaatctttaatgttcgcagataaccatgaaactattgacgtagctaatgtcaggcatctccttggagatctgcaatttaaattaatgttgggagatctaaggtacaagtcatttgcagaaaacccagatttggaaatagaggcaaagtgtgttgggtgcccgtcatgttttactagttactcctgcagcttcaagattgcttcaaatattgacactgtatgctcaattgaagggccttgtacaacttttcataatagattgatgattacctctacaaaacaagattatggcatcaaaatgagctgtaaaacaaaaccaaaagaaacagaagagttccagatttgcaagaaaacttacacagtattattcacaacagttgagaaaaatgataaaatcgaaataagcacaggggatcaaacatcctttatccaagagagggatgatagatgcaaaacatggttatgtagagttagggatgaagggattagtgttatttttgaaccaataagggctttctttggaagctactttagtatagctttttatgtagtagtcattattattgtcctatttctagcaatctacatcttcttgcctatggtgttcaaacttagagatgtgttaaaaaggaatgaatatctatacttgcaggaaataaagcataagtaa

SEQ ID NO: 4188 - RNA, 4305 nt, synthetic construct
  misc_feature 1..4305: note = derived and/or modified CDS sequence (wt) from NRIV(9800521)__JX857326.1__GP
  source 1..4305: mol_type = other RNA
atgttgctacttcttgtcttattaatcccctgctatgtatcagcctctcctgtagtaacaagatgcttccatggagggcaattgatagcagagaagaaatcccaaacagctgtatcagaattttgcctgaaagatgatgtctctactattaagtcagaaataacatatgagaagaacaacactggtttatttgcccatagcaaagttttacgaaattggatcataaaagactggaaaaattgcaaccctgttcccacagcagggggcagcataaatgttatagaagtcaatacagatctgagcttgaccacaaaaacatatgtgtgtagcagagattgcacaattacagttgataaagaggatgctcagataattttccaaaccgagaagttgaaccatttcgaggtctctgggactacattaagctcaggctggtttaaaaccaaagcatcagtaacattggacaggacttgtgaacatattaaagtaacatgtgggaaaaagactctgcaattccatgcctgctttaagcaccacatgtcatgtattagattcttccatggcactattcttcctggaacaatggctacttccatttgtcaaaatatagaactcataattataataagtctgacattgattatctttatcctgatgataatattaaccaaaacctatatatgttatctattgatgccactatttatgccgattgcatacttttatggttggtcatataacaaaagctgcaaaaaatgctcatgctgtggtctagcttatcacccctttacaaattgcgggtcacattgtgtatgcgggttaaaatttgaagcgtcagataggatgagaatacacagagaatccggattatgtcaaggttataagagtctacgtgtggctagattgttgtgcaagtcaaaaggttcatctctcgtaatctcaatattattatctatgttgatactaagctttgtcacaccaatagaggggacattaactaactacccagaatcaaggaagtatgatctggaggaaattgctgatgtcctggaaggatttattgtagaaaaagggataaaagaatacgtggttttttatacttctatttttggggctttactcttactaatggcattagttatcacaataacactaaataaggttacagagtatctcacaaacatcaatgttctatactgtcatgaatgttcaatgtatcactcgaagaagaatataaaatatattggggattttacaaataaatgtggcttttgcacatgtggagagttggaagatcaagaaggtttaaaaatacataaagttagcagaaagtgcatatataaatatcaactaacctggtctaaaataatcatgacaatactagtgtgtctactgattgctcaaaacaccatcctaatagtcgcagcatcggatgattgctggacaaaaaaatctttagagatggaatgtataggccctttacagcaagtggatacatgcgacgataaagcaagcagatcttatagtggggaggcaagaaagctagtgagagcatctaaaatatcggacctggatgcagcacaggtgggactattaggatctacgatagaatcagcaatagcaagcataagaaagcagagaacatatccaaccatgcatctccttgaatcggtattcctgggaaagcattgtgattactataaaactttcgaacataatagtggctactcacaggcaaagtggaggttaacagctaaaacacatcattttgatatttgctcaagacatagcacccatcatttctgtagatgtatctcagatgggacaaagtgccaaaatggggattgggactttgcaggtgaaatgaactcaacataccagtcaaaaaaggatttttttgagcacgacttcaagctattctgcactcttgtagaaaatgcttttccaggcacaacagagtcacttttttatgaaatgttgtctaagaaaaacacaactggtatcaaacagctattagataaattaacaagaaaatttgggaataacaatatgtttgtagggatatggaaatttggacagtatctaatgtcactgccatatgttaatgaagcatcattaacccctgcccaaatttctaaaatactagaggttacagaccagcaccatcggtctatatctggaaggcaagaatcattggctagtgctacccctgggagtaagtccaaggaatgtggtcatgcaaaaaaggtctcttgcataagtcctaggtttagtgttccgatggaaggattgatggcatgtggggactcaccaaattacaaaatttataaaacaccaacaaagctttataaatcaaacaataagggggaagtgtggtgctcaggtgatgtccattgttctcaggagttaagcccagcatcacaagaatctgttgacaggataaaacaaattacttgctttctgacagaacctgaagtaagtgatgacgttttttcaattgcaatatctacgtgcaaagttcaagataagggggtatgtacagtgaatgaagataggtggaacgtaataaaatgtgatagtgggctgatatattatactgaccagagagatgggcaggatacaggcaatgatttcggagagtattgtttgtcccatagctgcagaatagagaggttccccataaacccggcaataattagggactgtttatgggagtaccattcgcggaaatccaaatatatcaccagcttggacttagagaatctagaagaattcaaaagggctatttctgaaaaattatcacatactcttatagtttataatttcaaaccaacagctaatcttccccatataaagccggtgtacaaatatatcacagtgcaaggggtagagaattctgatggagtagattcagcatatatagctgctagtatgccagctttgagcggaacaagtataggatataatataatgtctagagataatttcccattatttgatataattatatttataaaaagtgctattattaaggcaacttacaatcatatatatgacacaggccccactataggaattaatgtaatgcatgatgaacattgcacagggcaatgtccaacagatataccacataaagaaaattggattacatttgctcaagagagaactagtcgttggggatgcgaagaatttgggtgccttgctgtaaatacaggctgtgtttttggttcttgtcaagatataataaggccagaaacaaaggtgtatcggaaagcagttgaggagagtgttttattgacagtatgtataacttacccaggcaaaacattctgcacagaaataaatgccatagaacctaaaatcacagatgagttagaattacagttcaaaacagttgatacaaaaacattacccaatatcttagctgtccaaaaccataagttatatagtggacaaattaatgatttgggatcattttctcaaggctgtggcaatatacagagaaccaattcatccattataggcacaggtactgcaaagtttgattatgtttgtcatggtgcttccaggaaagatatcattgtaaggagatgttacaataataactatgagtcatgcaaattattgaaggaggaacaatctttaatgttcgcagataaccatgaaactattgacgtagctaatgtcagacatctccttggagatctgcaatttaaattaatgttgggagatctaaggtataagtcatttgcagaaaacccagatttggaaatagaggcaaagtgtgttgggtgcccgtcatgttttactagttactcctgcagcttcaagattgctacaaatattgacactgtatgctcaattgaagggccttgtacaacttttcataatagattaatgattacctctacaaaacaagattatggcatcaaaatgagctgtaaaacaaaaccaaaagaaacagaagagttccagatttgcaagaaaacttacacagtattgttcacaacagttgagaaaaatgataaaatcgaaataagcacaggggatcaaacatcttttatccaagagagggatgatagatgcaaaacatggttatgcagagttagggatgaagggatcagtgttatttttgaaccaataagggctttctttggaagctactttagtatagctttttatgtagtgatcagtattattgtcctatttctagcaatctacatcttcttgcctatggtgttcaaacttagagatgtgttaaaaaggaatgaatatctatacttgcaggaaataaagcataaataa

SEQ ID NO: 4189 - RNA, 4305 nt, synthetic construct
  misc_feature 1..4305: note = derived and/or modified CDS sequence (wt) from NRIV(Adrar)__KJ716849.1__GP
  source 1..4305: mol_type = other RNA
atgttgctacttcttgttttgttaatcccctgctatgtatcagcctctcctgtagtaacaagatgcttccatggaggacaattgatagcagagaagaaatcccaaacagctgtgtcagaattttgcctgaaagatgatgtctccactattaaatcagaaataacatatgagaagaacaacactggtttatttgcccatagcaaagttttgcgaaattggatcataaaagactggaaaaattgcaaccctgttcccacagcagggggcagcataaatgttatagaagtcaatacagatctgagcttgaccacaaaaacatatgtatgtagcagagattgcacaattacagttgataaagaggatgctcagataattttccaaaccgagaagttgaaccatttcgaggtctctgggactacattgagctcaggctggtttaaaaccaaagcatcagtaacattggacaggacttgcgaacatattaaagtaacctgtgggaaaaagactctgcaattccatgcttgctttaagcaccatatgtcctgtattagattcttccatggtactattcttcctggaacaatggctacttccatttgtcaaaatatagaactcataattataataagtctgacattgattatctttatcctgatggtaatattaaccaaaacctatatatgttatctattgatgccactattcatgccgattgcatacttttatggttggtcttataacaaaagctgcaaaaaatgctcatgctgtggtctagcttatcacccttttacaaattgcgggtcacattgtgtatgcgggttaaaatttgaagcatcagataggatgagaatacacagagaatccgggttatgtcaaggctataagagtctacgtgtggctagattgttgtgcaagtcaaaaggttcatctctcgtaatctcaatattattatctatgttgatactaagctttgttacaccaatagaggggacattaactaactacccagaatcaaggaagtatgatctggaggaaattgctgatgtcctggaaggatttattgtagaaaaagggataaaagaatacgtagttttttatacttctatttttggggctttactcttactaatggcattagttatcacaataacattaaataaggttacagagtatctcacaaacatcaatgttctatactgtcatgaatgttcaatgtatcactcgaagaagaatataaaatatattggagattttacaaataaatgtggcttttgcacatgtggagagttggaagatcaagaaggtttaaaaatacataaagttagcagaaagtgcatatataaatatcaactaacctggtctaaaataatcatgacgatactagtgtgtctactgattgctcaaaacaccatccttatagtcgcagcatcagatgattgctggacaaaaaaatctttagagatggaatgtataggccctttacagcaagtggatacatgcgacgataaagcaagcagatcttatagtggggaggcaaaaaagctagtgagagcatctaaaatatcagatctggatgcagcacaagtggggctattaggatctacgatagaatcagcaatagcaagcataagaaagcagagaacatatccaaccatgcatctccttgaatcggtattcctgggaaagcattgtgattattataaaacttttgaacataatagtggctactcacaggcaaaatggaggttaacagctaaaacacaccattttgatatttgctcaagacatagtacccatcatttctgtagatgtatctcagatgggacaaagtgccaaaatggggattgggattttgcaggtgaaatgaactcaacataccagtcaaaaaaagatttttttgagcacgacttcaagctgttctgcactcttgtagaaaatgcttttccaggtacaacagagtcacttttttatgaaatgctgtctaagaaaaacacaactggtatcaaaaagctattagataaattaacaagaaaatttgggaataacaatatgtttgtagggatatggaaatttggacagtatctaatatcactgccatatgtaaatgaaacatcattaacccctgctcaagtttctaaaatactagaggttacagaccagcaccatcggtctatatctggaaggcaggaatcattggctagtgctacccctgggagtaaatccaaggaatgtggtcatgcaaaaaaggtctcctgcataagtcctagatttagtgttccgatggaaggattgatggcatgtggggactcaccaaattacaaaatttataaaacaccagcaaagctttataaatcaaacaataagggggaagtgtggtgctcaggtgatgtccattgttctcaggagctaagcccagcatcacaagaatctgttgacaggataaaacaaattacttgctttctgacagaacctgaagtaagtgatgacgttttttcaattgcaatatctacgtgcaaagttcaagataagggggtatgcacagtaaacgaagataggtggaacgtaataaaatgtgatagtgggctgatatattatactgatcagagagaagggcaggatacaggcaatgatttcggagaatattgtttgtcccatagctgcaggatagagaggttccccataaacccggcaataattagtgattgtttatgggagtaccattcgcggaaatccaaatatatcaccagcttggatttagagaatctagaagaatttaaaagggccatctctgaaaaattatcacatactcttatagtttataatttcaaaccaacagctaatcttccccatataaagccgatatataaatatatcacagtgcaaggggtagagaattctgatggagtggattcagcatatatagctgctagtatgccagctttgagcggaacaagtataggatataatataatgtctagagataatttcccactatttgatataattatatttataaaaagtgctattattaaggcaacttacaatcatatatatgacacaggccccactataggaattaatgtgatgcatgatgaacattgcacagggcaatgtccaacagatataccacataaagaaaattggattacatttgctcaggagagaactagtcgttggggatgcgaagaatttgggtgccttgctgtaaatacaggctgtgttttcggttcttgtcaagatataataaggtcagaaacaaaggtgtatcgaaaagcagttgaggagagtgtcttattgacagtatgtataacttacccaggcaaaacattctgcacagaaataaatgctatagaacctaaaatcacagatgagttagaattacagttcaaaacagttgatacaaaaacattacccaatatcttagctgtccaaaatcataagttatatagtgggcaaattaatgatttgggatcattttcacaaggctgtggcaacatacagaaaaccaacttatccattataggcacaggtactgcaaagtttgattatgtttgtcatggtgcctccaggaaagatatcattgtaagaagatgttacaataataactatgagtcatgtaaattattgaaggaggaacaatctttaatgtttgcagataatcatgaaactattgacgtagctaatgtcaggcatctccttggagatctgcaatttaaattaatgttgggagatctaaggtacaagtcatttgcagaaaacccagatttggaaatagaggcaaagtgtgttgggtgcccgtcatgttttactagctactcctgcagcttcaagattgcttcaaatattgacactgtatgctcaattgaagggccttgtacaacttttcataatagattgatgattacctctacaaaacaagattatggcatcaaaatgagctgtaaaacaaaaccaaaagaaacagaagaattccagatttgtaagaaaacttacacagtactgttcacaacagttgagaaaaatgataaaatcgaaataagcacaggggatcaaacatcctttatccaagagaaggatgatagatgcaaaacatggttatgcagagttagggatgaagggatcagtgtcattttcgaaccaataagggctttctttggaagctactttagtatagctttttatgtagtgatcagtattattgtcctatttctagcaatctacatcttcttgcctatggtgttcaaacttagagatgtattaaaaagaaatgaatatctatacttgcaggaaataaagcataagtaa

SEQ ID NO: 4190 - RNA, 4305 nt, synthetic construct
  misc_feature 1..4305: note = derived and/or modified CDS sequence (wt) from NRIV(DakArD28542)__JX857317.1__GP
  source 1..4305: mol_type = other RNA
atgttgctacttcttgtcttattaatcccttgctatgtatcagcctctcctgtagtaacaagatgcttccatggagggcaattgatagcagagaagaaatcccaaacagctgtatcagaattttgcctgaaagatgatgtctctactattaagtcagaaataacatatgagaagaacaacactggtttatttgcccatagcaaagttttacgaaattggatcataaaagactggaaaaattgcaaccctgttcccacagcagggggcagcataaatgttatagaagtcaatacagatttgagcttgaccacaaaaacatatgtgtgtagcagagattgcacaattacagttgataaagaggatgctcagataattttccaaaccgagaagttgaaccatttcgaggtctctgggactacattgagctcaggctggtttaaaaccaaagcatcagtaacattggacaggacttgtgaacatattaaagtaacatgtgggaaaaagaccctacaattccatgcctgctttaagcaccacatgtcctgtattagattcttccatggcactattcttcctggaacaatggctacttccatttgtcaaaatatagaacttataattataataagtctgacattgattatctttatcctgatggtaatattaaccaaaacctatatatgttatctattgatgccactatttatgccgattgcatacttttatggttggtcatataacaaaagctgcaaaaaatgctcatgctgtggcctagcttatcacccctttacaaattgtgggtcacattgtgtatgcgggttaaaatttgaagcatcagataggatgagaatacacagagaatccggattatgtcaaggctataaaagtctacgtgtggctagattgttgtgcaagtcaaaaggttcatctctcataatctcaatattattatctatgttgatactaagctttgttacaccaatagaggggacattaactaactacccagaatcaaggaagtatgatctggaggaaattgctgatgtcctggaaggatttattgtagaaaaagggataaaagaatacgtagttttttatacttctatttttggggctttattcttactaatggcattagttatcacaataacactaaataaggttacagagtatcttacaaacatcaatgttttatactgtcatgaatgttcaatgtatcactcaaagaagaatataaaatatattggggattttacaaataaatgtggcttttgcacatgtggagagttggaagatcaagaaggtttaaaaatacataaagttagcagaaagtgcatatataaatatcaactcacctggtctaaaataatcatgacgatactagtgtgtctactgattgctcaaaacaccatcctaatagtcgcagcatcagatgattgctggacaaaaaaatctttagagatggaatgtataggccctttacagcaagtggatacatgcgacgataaagcaagcagatcttacagtggggaggcaaaaaagctagtgagagcatctaaaatatcagacctggatgcagcacaagtggggctattaggacctacgatagaatcagcaatagcaagcataagaaagcagagaacatattcaaccatgcatctccttgaatcagtattccttggaaagcattgtgattactataaaactttcgaacataatagtggctactcacaggcaaagtggaggttaacagctaaaacacatcattttgatatttgctcaagacatagtacccatcatttctgtagatgtatctcagatgggacaaagtgccaaaatggggattgggattttgcaggtgaaatgaactcaacataccagtcaaaaaaggacttttttgagcatgacctcaagctgttctgcacccttgtagaaaatgcttttccaggcacaacagagtcacttttttatgaaatgttatctaagaaaaacacaactggtgtcaaaaagctattagataaattaacaagaaaatttgggaataacaatatgtttgtagggatatggaaatttggacagtatctaatgtcactgccatatgtcaatgaaacatcattaacccctgctcaagttgctaaaatactagaggttacagatcagcaccatcgatctatatctggaaggcaagaatcattggctagtgctacccctgggagtaagtccaaggaatgtagtcatgcaaaaaaggtctcctgcataagtcctaggtttagtgttccgatggaaggattaatggcatgtggggactcaccaaattacaaaatttataaaacaccagcaaagctttataaatcaaacaacaagggggaagtgtggtgctcaggtgatgttcattgttctcaggagctaagcccagcatcacaagaatctgttgacaggataaaacaaattacttgctttctgacagaacctgaagtaagtgatgacgttttttcaattgcaatatctacgtgcaaagttcaagataagggagtatgtacagtaaatgaagataggtggaacgtaataaaatgtgatagtgggctgatatattatactgaccagagagatgggcaggatacaggcaatgatttcggagaatattgtttgtcccatagctgcagaatagagaggttccccataaacccggcaataattagtgattgtttatgggagtaccattcgcggaaatccaaatatatcaccagcttggacctagagaatctagaagaattcaaaagggctatttctgaaaaattatcacatactcttatagtttataatttcaaaccaacagctaatcttccccatataaagccggtatacaaatatatcacagtgcaaggggtagagaattctgatggagtagattcagcatatatagctgctagtatgccagctttgagcggaacaagtataggatataatataatgtctagagataactttccattatttgatataattatatttataaaaagcgctattattaaggcaacttacaatcatatatatgacacaggccccactataggaatcaatgtaatgcatgatgaacattgcacagggcaatgcccaacagatataccacataaagaaaattggattacatttgctcaagagagaactagtcgttggggatgcgaagaatttgggtgccttgctgtaaatacaggctgtgtttttggttcttgtcaggatataataaggccagaaacaaaggtgtatagaaaagcagttgaggagagtgtcttattaacagtatgtataacttacccaggcaaaacattctgcacagaaataaatgccatagaacctaaaatcacagatgagttagaattacagttcaaaacagttgatacaaaaacattacccaatatcttagctgtccaaaaccataagttatatagtggacaaattaatgatttgggatcattttcacaaggctgtggcaacatacagaaaaccaattcatccattataggcacaggtactgcaaagtttgattatgtgtgtcatggtgcttccaggaaagatatcattgtaaggagatgttacaataataactatgagtcatgtaaattattgaaggaggaacaatctttaatgttcgcagataaccatgaaactattgacgtagctaatgtcagacatctccttggagatctacaatttaaattaatgttgggagatctaaggtacaagtcatttgcagaaaacccagatttggaaatagaggcaaagtgtgttgggtgcccgtcatgttttactagttactcctgcagcttcaagattgcttcaaatattgacactgtatgctcaattgaagggccttgtacaacttttcataatagattgatgatcacctctacaaaacaagattatggcatcaaaatgagctgtaaaacaaagccaaaagaaacagaagagttccagatttgcaagaaaacttacacagtattgttcacaacagttgagaaaaatgataaaatcgaaataagcacaggggatcaaacatcctttatccaagagagggatgatagatgcaaaacatggttatgcagagttagggatgaagggatcagtgttatttttgagccaataagggctttctttggaagctactttagtatagctttttatgtagtggtcagtattattgtcctatttctagcaatctacatcttcttgcctatggtgttcaaacttagagatgtgttaaaaaggaatgaatatctatacttgcaggaaataaagcacaagtga

SEQ ID NO: 4191 - RNA, 4305 nt, synthetic construct
  misc_feature 1..4305: note = derived and/or modified CDS sequence (wt) from NRIV(SUD-HKV141)__JX857323.1__GP
  source 1..4305: mol_type = other RNA
atgttgctacttcttgtcttattaatcccctgctatgtatcagcctctcctgtagtaacaagatgcttccatggagggcaattgatagcagagaagaaatcccaaacagctgtatcagaattttgcctgaaagacgatgtctctactattaagtcagaaataacatatgagaagaacaacactggtttatttgcccatagcaaagttttacgaaattggatcataaaagactggaaaaattgcaaccctgttcccacagcagggggcagcataaatgttatagaagtcaatacagatttgagcttgaccacaaaaacatatgtgtgtagcagagattgcacaattacagttgacaaagaggatgctcagataattttccaaactgagaagttgaaccatttcgaggtctctgggactacattgagctcaggctggtttaaaactaaagcatcagtaacattggacaggacttgtgaacatattaaagtaacatgtgggaaaaagaccctacaattccatgcctgctttaagcaccacatgtcctgtattagattcttccatggcactattcttcctggaacaatggctacttccatttgtcaaaatatagaactcataattataataagtctgacattgattatctttatcctgatggtaatattaaccaaaacctatatatgttatctattgatgccactatttatgccgattgcatacttctatggttggtcatataacaaaagctgcaaaaaatgctcatgctgtggcctagcttatcacccttttacaaattgtgggtcacattgtgtatgcgggttaaaatttgaagcgtcagataggatgagaatacacagagaatccggattatgtcaaggctataaaagtctacgtgtggctagattgttgtgcaagtcaaaaggttcatctctcataatctcaatattattatctatgttgatactaagctttgttacaccaatagaggggacattaactaactacccagaatcaaggaagtatgatctggaggaaattgctgatgtcctggaaggatttattgtagaaaaagggataaaagaatacgtagttttttatacttctatttttggggctttattcttactaatggcattagttatcacaataacactaaataaggttacagagtatcttacaaacatcaatgttttatactgtcatgaatgctcaatgtatcactcaaagaagaatataaaatatattggggattttacaaataaatgtggcttttgcacatgtggagagttggaagatcaagaaggtttaaaaatacataaagttagtagaaagtgcatatataaatatcaactcacctggtctaaaataatcatgacgatactagtatgtctactgattgcccaaaacaccatcctaatagtcgcagcatcagatgattgctggacaaaaaaatctttagagatggaatgtataggccctttacaacaagtggatacatgcgatgataaagcaagcagatcttacagtggggaggcaaaaaagctagtgagagcatctaaaatatcagacctggatgcagcacaggtggggctattaggacctacgatagaatcagcaatagcaagcataagaaagcagagaacatattcaaccatgcatctccttgaatcagtattcctgggaaagcattgtgattactataaaactttcgaacataatagtggctactcacaggcaaagtggaggttaacagctaaaacacatcactttgatatttgctcaagacatagtacccatcatttctgtaggtgtatctcagatgggacaaagtgccaaaatggggactgggattttgcaggtgaaatgaactcaacataccagtcaaaaaaggacttttttgagcatgacctcaagctgttctgcactcttgtagaaaatgcttttccaggcacaacagagtcacttttttatgaaatgttgtctaagaagaacacaactggtgtcaaaaagctattagataaattaacaagaaaatttgggaataacaatatgtttgtagggatatggaaatttggacagtatctaatgtcactgccatatgtcaatgaaacatcattaacccctgctcaagttgctaaaatactagaggttacagatcagcaccatcggtctatatctggaaggcaagaatcattggctagtgctacccctgggagtaagtccaaggaatgtggtcatgcaaaaaaggtctcctgtataagtcctaggtttagtgttccgatggaaggattaatggcatgtggggactcaccaaattacaaaatttataaaacaccagcaaagctttataaatcaaacaacaagggggaagtgtggtgctcaggtgatgttcattgttctcaggagctaaccccagcatcacaagaatctgttgacaggataaaacaaattacttgctttctgacagaacctgaagtaagtgatgacgttttttcaattgcaatatctacgtgcaaagttcaagataaaggagtatgtacagtaaatgaagataggtggaacgtaataaaatgtgatagtgggctgatatattatactgaccagagggatgggcaggatacaggcaatgatttcggagaatattgtttgtcccatagctgcagaatagagaggttccccataaacccggcaataattagtgattgtttatgggagtaccattcgcggaaatccaaatatatcaccagcttggacctagagaatctagaagaattcaaaagggctatttctgaaaaattatcacacactcttatagtttataatttcaaaccaacagctaatcttccccatataaaaccggtatacaaatatatcacagtgcaaggggtagagaattctgatggagtagattcagcatatatagctgctagtatgccagctttgagcggaacaagtataggatataatataatgtctagagataactttccattatttgatataattatatttataaaaagcgctattattaaggcaacttacaatcatatatatgacacaggccccactataggaatcaatgtaatgcatgatgaacattgcacagggcaatgcccaacagatataccacataaagaaaattggattacatttgctcaagagagaactagtcgttggggatgcgaagaatttgggtgccttgctgtaaatacaggctgtgtttttggttcttgtcaggatataataaggccagaaacaaaggtgtatagaaaagcagttgaggagagtgtcttattaacagtatgtataacttacccaggcaaaacattctgcacagaaataaatgccatagaacctaaaatcacagatgagttagaattacagttcaaaacagttgatacaaaaacattacccaatatcttagctgtccaaaaccataagttatatagtggacaaattaatgatttgggatcattttcacaaggttgtggcaacatacagaaaaccaattcatccattataggcacaggtactgcaaagtttgattatgtgtgtcatggtgcttccaggaaagatatcattgtaaggagatgttacaataataactatgagtcgtgtaaattattgaaggaggaacaatctttaatgtttgcagataaccatgaaactattgacgtagctaatgtcagacatctccttggagatctgcaatttaaattaatgttgggagatctaaggtacaagtcatttgcagagaacccagatttagaaatagaggcaaagtgtgttgggtgcccgtcatgttttactagttactcctgcagcttcaagattgtttcaaatattgacactgtatgctcaattgaagggccttgtacaactttccataatagattgatgatcacctctacaaaacaagattatggcatcaaaatgagctgtaaaacaaagccaaaagaaacagaagagttccagatttgtaagaaaacttacacagtattgttcacaacagttgagaaaaatgataaaatcgaaataagcacaggggatcaaacatcctttatccaagagagggatgatagatgcaaaacatggttatgcagagttagggatgaagggatcagtgttatttttgagccaataagggctttctttggaagctactttagtatagctttttatgtagtggtcagtattattgtcctatttctagcaatctacatcttcttacctatggtgttcaaacttagagatgtgttaaaaaggaatgaatatttatacttgcaggaaataaagcacaagtaa

SEQ ID NO: 4192 - RNA, 4305 nt, synthetic construct
  misc_feature 1..4305: note = derived and/or modified CDS sequence (wt) from NRIV(SUD-HKV66)__JX857320.1__GP
  source 1..4305: mol_type = other RNA
atgttgctacttcttgtcttattaatcccctgctatgtatcagcctctcctgtagtaacaagatgcttccatggagggcaattgatagcagagaagaaatcccaaacagctgtatcagaattttgcctgaaagatgatgtctctactattaagtcagaaataacatatgagaagaacaacactggtttatttgcccatagcaaagttttacgaaattggatcataaaagactggaaaaattgcaaccctgttcccacagcagggggcagcataaatgttatagaagtcaatacagatttgagcttgaccacaaaaacatatgtgtgtagcagagattgcacaattacagttgacaaagaggatgctcagataattttccaaaccgagaagttgaaccatttcgaggtctctgggactacattgagctcaggctggtttaaaactaaagcatcagtaacattggacaggacttgtgaacatattaaagtaacatgtgggaaaaagaccctacaattccatgcctgctttaagcaccacatgtcctgtattagattcttccatggcactattcttcctggaacaatggctacttccatttgtcaaaatatagaactcataattataataagtctgacattgattatctttatcctgatggtaatattaaccaaaacctatatatgttatctattgatgccactatttatgccgattgcatacttctatggttggtcatataacaaaagttgcaaaaaatgctcatgctgtggcctagcttatcacccttttacaaattgtgggtcacattgtgtatgcgggttaaaatttgaagcgtcagataggatgagaatacacagagaatctggattatgtcaaggctataaaagtctacgtgtggctagattgttgtgcaagtcaaaaggttcatctctcataatctcaatattattagctatgttgatactaagctttgttacaccaatagaggggacattaactaactacccagaatcaaggaagtatgatctggaggaaattgctgatgtcctggaaggatttattgtagaaaaagggataaaagaatacgtagttttttatacttctatttttggggctttattcttactaatggcattagttatcacaataacactaaataaggttacagagtatcttacaaacatcaatgttttatactgtcatgaatgctcaatgtatcactcaaagaagaatataaaatatattggggattttacaaataaatgtggcttttgcacatgtggagagttggaagatcaagaaggtttaaaaatacataaagttagtagaaagtgcatatataaatatcaactcacctggtctaaaataatcatgacgatactagtgtgtctactgattgctcaaaacaccatcctaatagtcgcagcatcagatgattgctggacaaaaaaatctttagagatggaatgtataggccctttacagcaagtggatacatgcgatgataaagcaagcagatcttacagtggggaggcaaaaaagctagtgagagcatctaaaatatcagacctggatgcagcacaggtgaggctattaggacctacgatagaatcagcaatagcaagcataagaaagcagagaacatattcaaccatgcatctccttgaatcagtattcctgggaaagcattgtgattactataaaactttcgaacataatagtggctactcacaggcaaagtggaggttaacagctaaaacacatcattttgatatttgctcaagacatagtacccatcatttctgtaggtgtatctcagatgcgacaaagtgccaaaatggggactgggattttgcaggtgaaatgaactcaacataccagtcaaaaaaggacttttttgagcatgacctcaagctgttctgcactcttgtagaaaatgcttttccaggcacaacagagtcacttttttatgaaatgttatctaagaagaacacaactggtgtcaaaaagctattagataaattaacaagaaaatttgggaataacaatatgtttgtagggatatggaaatttggacagtatctaatgtcactgccatatgtcaatgaaacatcattaacccctgctcaagttgctaaaatactagaggttacagatcagcaccatcggtctatatctggaaggcaagaatcattggctagtgctacccctgggagtaagtccaaggaatgtggtcatgcaaaaaaggtctcctgcataagtcctaggtttagtgttccgatggaaggattaatggcatgtggggactcaccaaattacaaaatttataaaacaccagcaaagctttataaatcaaacaacaagggggaagtgtggtgctcaggtgatgttcattgttctcaggagctaaccccagcatcacaagaatctgttgacaggataaaacaaattacttgctttctgacagaacctgaagtaagtgatgacgttttttcaattgcaatatctacgtgcaaagttcaagataagggagtatgtacagtaaatgaagataggtggaacgtaataaaatgtgatagtgggctgatatattatactgaccagagggatgggcaggatacaggcaatgatttcggagaatattgtttgtcccatagctgcagaatagagaggttccccataaacccggcaataattagtgattgtttatgggagtaccattcgcggaaatccaaatatatcaccagcttggacctagagaatctagaagaattcaaaagagctatttctgaaaaattatcacatactcttatagtttataatttcaaaccaacagctaatcttccccatataaaaccggtatacaaatatatcacagtgcaaggggtagagaattctgatggagtagattcagcatatatagctgctagtatgccagctttgagcggaacaagtataggatataatataatgtctagagataactttccattatttgatataattatatttataaaaagcgctattattaaggcaacttacaatcatatatatgacacaggccccactataggaatcaatgtaatgcatgatgaacattgcacagggcaatgcccaacagatataccacataaagaaaattggattacatttgctcaagagagaactagtcgttggggatgcgaagaatttgggtgccttgctgtaaatacaggctgtgtttttggttcttgtcaggatataataaggccagaaacaaaggtgtatagaaaagcagttgaggagagtgtcttattaacagtatgtataacttacccaggcaaaacattctgcacagaaataaatgccatagaacctaaaatcacagatgagttagaattacagttcaaaacagttgatacaaaaacattacccaatatcttagctgtccaaaaccataagttatatagtggacaaattaatgatttgggatcattttcacaaggttgtggcaacatacagaaaaccaattcatccattataggcacaggtactgcaaagtttgattatgtgtgtcatggtgcttccaggaaagatatcattgtaaggagatgttacaataataactatgagtcatgtaaattgttgaaggaggaacaatctttaatgtttgcagataaccatgaaactattgacgtagctaatgtcagacatctccttggagatctgcaatttaaattaatgttgggagatctaaggtacaagtcatttgcagagaacccagatttagaaatagaggcaaagtgtgttgggtgcccgtcatgttttactagttactcctgcagcttcaaaattgcttcaaatattgacactgtatgctcaattgaagggccttgtacaactttccataatagattgatgatcacctctacaaaacaagattatggcatcaaaatgagctgtaaaacaaagccaaaagaaacagaagagttccagatttgtaagaaaacttacacagtattgttcacaacagttgagaaaaatgataaaatcgaaataagcacaggggatcaaacatcctttatccaagagagggatgatagatgcaaaacatggttatgcagagttagggatgaagggatcagtgttatttttgagccaataagggctttctttggaagctactttagtatagctttttatgtagtggtcagtattattgtcctatttctagcaatctacatcttcttacctatggtgttcaaacttagagatgtgttaaaaaggaatgaatatttatacttgcaggaaataaagcacaagtaa

SEQ ID NO: 4193 - RNA, 4344 nt, synthetic construct
  misc_feature 1..4344: note = derived and/or modified CDS sequence (wt) from BWAV(M459)__NC_034490.1__GP
  source 1..4344: mol_type = other RNA
atggcaatgtttgaattaattgttctcctggctttttcatatgttacaggagttccacaggaattaactagatgttttacaggtggatcagtagtacgtcagcattggagcaaaaatgccatatctgaactctgcttgaaagatgatgttagtataataaaaagtgaaatagaatataaaaagaatgagacaggtacatttgcattgagtaaaatctatagaaaatggataactacagattgggaaaaatgtcaaccgcaaaaatctacaggtggtcatattagtgtcttagaggtccgacatgacctaactttagcaagtgcaacatacatctgtggcaatccatgcactattaatgtagacagagaaatggctcaagtccatcttcagacagagggagtaaatcattttgaaatttctggtacaacaattaaatctggctggttcaaaacaactacatatattactttagaccaaacatgtgaacatttaaaagtatcatgtgggaaacagtctgtacaattccatgcttgctttaagcaacatatggcatgcgtaagatttttacatagaacaatcctacctggcaatatggcaaattctatatgccaaaatatagaaataattattttactagcacttaccttatctatctttatcctcttgtgcatattaacaaaaacatatatctgttacatattattaccaatatttataccaatatcttatatatatggatacttttataatagatcatgtaaaaaatgctcccaatgtggattagtctatcatccatttacagaatgtggtagaaattgtgtttgtggtgccagatatgacacttcagaaaggatgaaattgcatagattatctggactgtgcccaggatataaaagtctaaaagcagcaagagttttatgcaaatctaaaggctcagcatcaatattatcaatactaatttcattattgatattaacatttgttacaccaatcaatggcttgatgttaaaggacacagatattactaatttaaagatagacacattaccagatgatatgttagaattaattcacaatgtagattatttgaaactaatattggaaattaacataacgatatttggattcatattaataataattctctttatgctgttaatgttttatagataccaacatatctttattagtatatatgtgattgattgtaaggaatgtaacatgtatcatagcaagtcaggattgaggtataatggtgattttactaataaatgtatgacttgtacatgtggtgaagtagatgatatggagggcttgaacaaacacaaaaaaagatataattgtttaatcaaatataaaactacgatattgcaacactttttcctgtctatattagtatgcttaatactgaaggaatcagttttatttgctgcagcacaatctgaagaaataataaaatgcctagaacaagagtctttaacatcaaaatgcactggacccctacttaaaactccacaatgcacagagcaacaaaaaaatcttttatttatagaaatagctaaacaaatggaaaaagataatataattacttcattagataatgctttgattgcaaagctcccaaatgaaatagcaggtagcatggcaatacttgatacaaagaaatactatcatgagcaaatcacattagaatatgctattttgtctaagtattgtgattattataaaaaatatgaaggaaatacaggatacagccaaacaacatggagaacttatttgcgatcacaggatcttgaaatatgtttaatattaccatatcaattcttctgtagatgcttcaaaagtggaacaggatgtatagacacaaaaatggaaattaaatcgacaatggacacatattatagctcacatcaaactaaatttgattcagatcttaattatatgctacatgtcattcacctagccttcaggggaagtgcaacaagttatatagcaaaatgtttaatagaaaaaaattatactgaaacaatatcgtacttaactaagattcaggagaaatatccaaacaatcaattattgaaagttgctatattctttaccaatcatttattaaatcagagcttagtagaaaattttgaagttagcacagaatggtctaggtacaaacattcaactgcccaacctgagcatgagtggaaaaaaggaagtgaacttaagatgttagaccctaataagctaaagactgggccagctattcaaacatgtttacatattaaagatttacattgtatatctcctagatctagagcaccaacatctggtataataacctgtggattaaatgatcaagcttgtgtctaccggaaaccagacaagaagatatatgcctctcatatgacacagcatggattttgtgttatggatggacactgtctgaagccatttgaacctattagtggagaaatgctccaaattattaaaaaatcaaaatgttggactgaagatatagaagatttaataactgaaggtcaagataaagggagaataagttgtcagccaattgatgttggcaattgcaacgtcagtgggaacttatggacaattacattgtgctctgataaaaagttttattatacagataataaacatgtccatgataattctaaagatattggctactattgcatggaagaaaattgcaagatacccagattcccaattcacccagattttgttaaagattgtgaatgggatttaaatcatataaaaatagatcatctaaaacaaataaatatagaagatataaattcttataagaaaatactaacagaaaaattaaccacagcacttaactcttttaaatacaaagggaatgagaatttgcctcattctatccctaaatataaatatataacaattcagggaacacaaaccatcgatggtattgaaaatgcatttattgaagttgaaattcctgccctttcaggaagtgcaactggatttaaaatatcatcaagagatggtattgaattatttgatgccatactatatgtaaagcaggcttcttttagctcagtttacaaaaaattatatgtaacaggacctactattgggataaacactaaacatgatgaaaggtgcaccggtgcatgcccaatgacactcccacattcctatggttggctaaccttttctaaagaaagaacaagtcaatggggttgcgaagaatatggctgtttggcaattagtgacggctgtgtgtttggttcatgccaagatattattaaggatgatctaactatctatagaaaagagacagaagaactgtctcttgcagaaatttgtattacctttatgcataatactttttgcacttctatagattcaactacacccaccattacagatattttagaagcacaattcaagacagttgaatctttcaaattacctaatacagttgggctaaaaatgcataagttatatattggtacaataaatgatattggtgtgtacaaaaaagcttgtggaaatgttcaaaaatataataatacaattttgggctcaggcagccctaagtttgattatgtttgtcacttggcaaaaagaaaggatgtgattttaaggaaatgttttgacaatgattataattcttgcaaattactgaaggttgcaaatgatctaagaattgaagaagatggtgaaaaattaaaagttataaattataaaaaagtaatgggtactttaaaattcaaagctatatttggtgatattaaatataaatcttttacacaagatgtagatatagatgcagaagcaacatgtgttgggtgtttaaattgttttgaaaatataaattgcgagataaaggtgcaaagtccattagaaacaacttgcgaagtagaaagctcctgtgatctatttacaacaagaatattgttccatcaagatatacataaatatgcattaaaattaatttgttctaaagaggcctccagtaaattttggattaggttttgcaacaaagaaatcaaatcatcaataagtttgatcaatgcagcacctatcttagagctggcccctattgaccaaacatcatatgtaaaagaagaagatgagagatgtgggacatggatgtgtagggtcgctcaagagggaattggagttatctttgagccatttaaaaacttgtttgggagttatttaggaatattttacattattataattgtgataatactgcttgtactctttgtttatattttcttgccgatgattttaaagctgaaagagattttacaaaaaaatgaggttgcataccaacgagatatgaaaattagataa

SEQ ID NO: 4194 - RNA, 4344 nt, synthetic construct
  misc_feature 1..4344: note = derived and/or modified CDS sequence (wt) from BWAV(UgAr1888)__KJ867186.1__GP
  source 1..4344: mol_type = other RNA
atggcaatatttaaattaattgttctcctggctttttcatatgctacaggagttccacaggaattaagtagatgttttacaggtggatcagtagtacgtcagcattggagcaaaaatgccatatctgaactctgcttgaaagatgatgttagtataataaaaagtgaaatagaatataaaaagaatgagacaggcacatttgcattgaataaaatctataggaaatggataactacagattgggaaaaatgtcagccacaaaaatctacaggcggtcatattagtgttttagaggttcggcatgacctaactttagcaagtgcaacatacatctgtggcaatccatgcaccatcaatgtagacagagaaatggcccaagtccatcttcaaacagagggggtgaatcatttcgaaatttctggcacaacaattaaatctggctggttcaaaacaactacatatattactctagatcaaacatgtgaacatttaaaagtatcatgtgggaaacagtctgtacaattccatgcttgctttaagcagcatatggcatgcgtaagatttttgcatagaacaattttacctggcaatatggcaaattctatatgtcaaaatatagagataattattttactagcacttactttatctatctttatcctgttatgcatattaacaaaaacatatatctgctatatattattaccaatatttataccgatatcttacatatatggatacttttataatagatcatgtaaaaaatgctcccaatgtggattggtctatcatccatttacagaatgtggtagaaattgtgtttgtggtgctagatatgacacttcagaacgaatgaaattgcatagactatctggactgtgcccaggatataagagtctaaaaacagcaagagttttatgtaaatctaaaggctcagcatcaatattatcaatactaatttcattattaatattaacatttgttacaccaattaatggcttgatgttgaaggacacagatattactaatttaaagatagacacattaccagatgatatgttagaattaattcacaatgtagattacttgaaactaatattggaaattaacataatgatatttggattcatattaataataattctctttatgctactaatgttttatagataccaacatatctttattagtatatatgtgattgattgtaaggaatgtgacatgtatcatagcaaatcgggattaagatataatggcgattttactaataaatgtatgacttgtacatgtggtgaagtagatgatatggaaggtctgaacaaacacaaaaaaaggtataattgtttgatcaagtataaaactacaatattgcaacacttttccctgtctatgttagtatgcttaatactgaaagaatcggttttatttgctgcagcacaacctgaggaaataataaaatgcctagaacaagagtctttaacatcagaatgcactgggcccctacttaagactccacaatgtacagagcaacaaaagaatcttctatttatggaaatagctaaacaaatggaaaaagataatgtaattacttcattagataatgctttaattgcaaagcttccaaatgaaatagcaggcagcatggcaatacttgatacaaagaaatattatcatgagcaaatcacactagaatatgctattctgtctaagtattgtgattattataaaaaatatgaaggaaatacaggatacagccaaacaacatggagaacttatttgcgatcacaggatcttgaaatatgtttaatcttaccatatcaattcttctgtagatgcttcaaaagcggaacaggatgtatagatacaaaaatagaatttaaatcaacaatggacacatattatagttcacatcaaactaaatttgattcagacctcaattatatgctgcatgtcattcatctagctttcaggggaagtgcaacaagctatatagcaaaatgtttaatagaaaaaaattatactgaaacaatatcatacttaactaagattcaggagaaatatccaaataatcagttgttaaaagttgctatattctttactaatcatttattaaatcagagcttagtagaaaattttgaagttagcacagaatggtctaggtacaaacattcagctacccaacctgagcatgagtggaagaaaggaagtgagttaaagatattagactctaataagttaaagactgggccagctattcaaacatgtttacatattaaagatttacattgtatatctcctagatctagggcaccaacatctggcataataacctgtggattaaatgatcaagcttgtgtgtatcggaagccaaacaaagagatatatgcctctcatatgacacagcatggattttgtattatggacggacactgtctgaaaccatttgagcctattagtggagaaatgcttcaaattattaaaaaatcaaaatgttggactgaagatatagaagatttaataactgaaggtcaagataaaggaagaataagttgtcagccgattgatgttggcaattgtaatgtcagtggaaacttatggacaattacattgtgctctgataaaaagttttattatacagataataaacatgtccatgatagttctaaagatgttggctattattgtatggaagaaaattgcaagatacctagattcccaattcatccagattttgttaaagattgtgaatgggatttaaatcatatggaaatagatcatctaaaacaaataaatatagaggatataaattcttataagaaaatactaacagaaaaattaatcacagcacttaactcttttaaatataaaggaaatgagaatttgcctcattctatccctaaatatgaatatataacaattcagggaacacaaaccattgatggtatagaaaatgcatttattgaagttgaaattcctgccctttcagggagtgcaactggattcaaaatatcatcaagagatggtattgaattatttgatgccatactatatgtaaagcaggcttcatttagctcagtttacaaaaaattatatgtaacaggacctactattgggataaataccaaacatgatgagaggtgtaccggtgcgtgcccagtgacactcccacattcctatggctggctaaccttttctaaagaaagaacaagtcagtggggttgtgaagaatatggttgtttggcaattagtgacggctgtgtgtttggttcatgccaagatattattaaggatgatctaactgtctatagaaaggagacagaagaactgtctcttgcagaaatttgtattacatttatgcataatactttttgcacttctatagattcaactacacccaccattacagatattctagaggcacaattcaagacagttgaatctttcaaattacctaatacagttgggctaaaaatgcataagttatatattggtacaataaatgatattggtgtgtataaaaaagcttgcggaaatgttcagaaatataataatacaattttgggctcaggcagtcctaagtttgattatgtatgtcacttggcaaaaagaaaggatgtgattttgaggaaatgttttgacaatgattacaattcttgcaaattactaaaggttgcaaatgatctaagaattgaagaagatggtgaaaaattaaaagttataaattataaaaaagtaatgggcactttaaaattcaaagctatatttggtgatgttaaatataaatcttttacacaagatgtagatatagatgcagaagcaacatgtgttggatgtttaaattgttttgaaaatataaattgtgagataaaagtgcaaagtccattagaaacaacttgtgaagtagaaagctcctgtgatttatttacaacaagaatattgttccatcaagatatacataaatatgcattaaaattaatttgttctaaagaggccactagtaaattttggattaggttttgtaagaaagaaatcaaatcatcaataagtttaataaatgcagcacctatcctagaattagcccctattgatcaaacttcatatgtaaaggaagaagatgagagatgcggaacatggatgtgcagagttgctcaagagggaattggggttatctttgagccatttaaaaatttatttgggagttatttaggaatattttacattattataattgtaataatactgcttgtgctttttgtttatatttttttaccaatgattttaaagctaaaagagattttacaaaaaaatgaggttgcataccaacgagatatgaaggttagataa

SEQ ID NO: 4195 - RNA, 4332 nt, synthetic construct
  misc_feature 1..4332: note = derived and/or modified CDS sequence (wt) from BWAV/PGAV(SAAr1)__KJ867177.1__GP
  source 1..4332: mol_type = other RNA
atgatttgcatatgcattttcgtggccattttcccagctatctatgcaattccagatagctatagcaggtgtttcacaggtggcacagttgtcaaagagatgtggtctaaagatgctgttacagaactttgcatcaaagatgatgttagcattgtcaaaactgaaacatcatataagaaaaacgggactgggacatttgctttaaataaggtaaccaggaaatggctcatgacagattgggaaaaatgcaagcctcaaaagtctagcagtggacatataaatgtgattgaggtcagggatgatctaacactagcaacttcaacatatatatgttcaagttcttgcactattaatgtagatagagaaacagcacaaatacagttgaacacagattctatcaatcatttcgaaatagctggtacaaccattaagacaggttggtttaaatccactaccttagttgcattagatcaaacatgtgagcacttaaaagtatcatgtggtaagcagtcagtacaattccatgcttgttttaatcagcatatgtcatgtgttagatttcttcatagaactatattgccaggcaatatggcaaagtcaatatgccaaaatatagaaattataatacttgttggcctaattattctcatattcttgctactatgtatcttaacaaaaacatacatatgctatatattactaccaatattcatcccattatcatatgcatatgggtatttctataataaagcatgtaagaaatgttcacaatgcggtttagtttaccatccattcacagaatgtgggtcaaattgcgtgtgtggggctaggtatgacacttcagaaagaatgaaactccatagaatttcaggattatgcccagggtataaaagtttgcgaacagctagagtcttatgcaagtcaaaaggttcagcatctatcttatctattttaatttcaatactaatcttaatgtttgtcacacctattaacggctacatgataactaatgaatttgatgaaggaaaattaacagtagatagcctgccagatgatatgttaagtatgatatctagactttcagccttacaatttatatttactttaaatattgcatgttcagtgctagtaactctattaacatgccttttcttgatcattttttatagattccaacatagattccttagtaagtatgccataaattgcacagaatgtgatatgtaccatcaaaagaaaggattaatctataatggggattttactaacaaatgtatgacatgtacatgtggtgaagtcaatgatatggaaggtttaaataaacacaaaaaaagatacaactgcttaataaagtataaagcagcctggtttttaaacctaactataacaataatatgtcttatgctaattaaagatggtagtatgatggcagcagcagaaaccaacatagaaacatgcatggcaaagcctagcttgaccactgattgtacggggccttttctaaaaataactaaatgtgatgaatctcaaaaagcattaccatttcaagaaatcgctaaacaactagtaaaatccaatgtcttaacacttcttgacaagcatattgtagaaaaacttcctaatgaaatagctggcagcctgtctattttggacaaaaagcaacactaccatgagcaattggcagttgaatatggaatattatctaagtattgtgattattacgagttatacaagagcaattctggctatagtcaatctacatggggaacatatttgcgttcacatgatttcgaaatttgtttattgctaccataccaatatgtgtgtagatgctttaaatcaggaactggatgcactgatactaaatttgaatttgaacagaaaatgaatgagacatataatagtaagaacgatatgtacaattcagatttcacactagctttaactgttttacacttagctatgcgaggcacagcatcaacatatataatagataatgttttacaaaagaattattcaaatgttatcgaatacttaaatactacaaaaaacaacttcaaatccaaccaggtatttggagttttggtagactttactatatatttattaagacatgcttcatatgccaaatacaatttaccacaaagtcttaaaaaattcagatcagtaagttcagacttaacaacaatttcaggcagatcatctggacagaatatagtctctgatttgcatcaaggagatgttataaaaacatgtttaaacattaagcaattaaactgtatttcacctaagtccagaacaacaacaacgaatctgataacatgtggatcctctcagattagtgtatataatttacctcgaggccaattgtatgaatctgtcactacagagcatggaacatgtgcaggtgatggccattgcttgactgatttcatgcccataaatagtgactttctagctacgctaaaaaaatcaaaatgttggacaacagacatacctaatataatcaagcttgtagagagtgacggtaaaataagttgtcagcctattgatgtaggatcctgcaacgtatcaggcaatatatggacaatcacaaaatgctcagataataaatattattatactgacaataagcatgttcatgatgatgaaaaagacattggtcattattgtatggaagaaacctgtaagtttgttcgcttccccataaatgacaaatttgtcagcaactgtgaatgggatctgaatcacatcgaaataaataagctcaatcaggttgaattagacaatataaatgcatataaaaaggttttaactgaaaaattaactagctctcttagtgttttcaaatataaattaacacaaaatttgccacatgttattccgaaattcaaatatataaccatacaaggaacccaaacggtagatggtattgagaattcattcatagaagttgaaattccagcactgtcaggtgctgcatcaggatttaaaataatgacaaaagagaataatgaattatttgatgcaatattgtatgtaaagcaagcttcctttagtagtatttacaaaaagatctatacaacagggccaactataggaataaatacaaaacatgatgaaaaatgtactggtgcgtgccctgtaaatttaccacatagtacaggttggcttacatttgctaaagagagaactagcacatggggttgtgaagaatatggatgccttgctataaatgatggatgtgtttttggctcatgccaagatataataaaggatgaaatgtacatattcaaaaaggaaacagaagaagtggcattagtagagatttgtataagcttcaatcataagacattctgcactgatgtagattcaacaacacccataattactgatactctagaggcacaattcaagacagtagaatcatataaattaccaaatcatgtagctttaaagcaacataagctgtatgtaggccaaatcaatgattttggagtatataaaaaggcatgtggaaatgtgcaaaaaataaataatactatttatggagaaggtactccacgatttgattatttatgtcacctagctaagaggaaagatgttttagtcaggaaatgctttgataatgattataactcttgctctctcttaactatagcagatgacctgagattggaagaagacggtgaaaagctaaaagtcatcaattatagaaaagtactaggctctatgaagttcaaagctctctttggggatataagatataaatcattcacagaggatattgaattggatgtagaggcttcttgtgcaggttgtataaattgttttgacaatatacattgtgaaataaaattaacaaatggtttagacacatcttgcagtttcgaatctagttgtgatgcattcaattccagaatattatttaattcaaatcaacatgtatattctactaagttgatatgtactaaagaacaaacaaaggcttttgaaataaaaatctgcggaaaaactataaaagctgatttagtggtaactgaagcaaaaccaatacttgagttaacccctattgatcagacatcctatattaaagaagaagacaccagatgtggaacatggttttgcaggctgacaaaagaaggattctcagtattgttagaaccattcaagaacttattcgggagttatttagggattgcttatactatcataatagccttgttatgcttgtttgtttttatatacataatcttacctatgataatgaagttgaaagaagttttaaagcaaaatgaaatagcttatcagaaggaacaaaagaaaaggtga

SEQ ID NO: 4196 - RNA, 4332 nt, synthetic construct
  misc_feature 1..4332: note = derived and/or modified CDS sequence (wt) from BWAV/PGAV(191B-07)__KJ867180.1__GP
  source 1..4332: mol_type = other RNA
atgatttacatatacattttcgtagccattttcccagctatctatgcaattccagatagctatagcaggtgtttcacaggtggcacagttgtcaaagagatgtggtctaaagatgctgttacagaactttgcatcaaagatgatgttagcattgtcaaaactgaaacatcctataagaagaacgggactgggacatttgctttaaataaggtaaccaggaaatggctcatgacagattgggaaaaatgcaaacctcaaaagtctagcagtggacatataaatgtgattgaggtcagggatgatttaacattagcaacttcaacatatatatgctcaagttcttgcactattaatgtggatagagaaacagcacaaatacagttgaacacagattctatcaatcatttcgaaatagctggtacaactattaagacaggttggtttaaatctactaccttagttgcattagatcaaacatgtgagcacttaaaagtatcatgtggtaagcagtcagtacaattccatgcttgttttaatcagcatatgtcatgtgttagatttcttcatagaactatattgccaggcaatatggcaaagtcaatatgccaaaatatagaaatcataatacttgttggcctaactatccttatattcttgctactatgtatcttaacaaaaacatacatatgttatatattactaccaatattcatcccattatcatatgcatatgggtatttctataacaaagcatgtaagaaatgttcacaatgcggtttagtttaccatccgttcacagaatgtgggtcaaactgcgtgtgtggggctaggtatgatacttcagaaagaatgaaactccatagaatttcagggttatgcccagggtataaaagtttgcgaacagctagagtcttatgcaagtcaaaaggctcagcatctatcttatctattttaatttcaatactaattttaatgtttgtcacacctattaatgggtacatgataactaatgaatttgatgaaggaaaattgacagtagatagcctgccagatgatatgttaagtatgatatctagactttcagccttacaatttatatttactttaaatattgcgtgttcagtgctagtaactctattaacatgccttttcttgatcattttttatagatttcaacatagattccttagtaagtatgccataaattgcacagaatgtgatatgtatcatcaaaagaaaggattaatctataatggggattttactaacaaatgtatgacatgtacatgtggtgaagttgatgatatggaaggcttaaataaacacaaaaagagatacaactgcttaataaagtataaagcagcctggtttttaaatctaactataacaataatatgtcttatgctaattaaagatggtagtatgatggcagcagcagaaagcaatatagaaacatgcatggcaaagcctagcttgaccactgattgtacggggccttttctaaaaataactaaatgtgatgaatctcaaaaagcattaccatttcaagaaatcgctaaacaactagtaaaatccaatgtcttaacacttcttgacaagcatattgtagaaaaacttcctaatgaaatagctggcagcctgtctattttggacaaaaagcaacactaccatgagcaactggcagttgaatatgggatattatctaagtattgtgattattacgaattatataagagcaattctggctatagtcaatctacatggagaacatatttgcgttcacatgatttcgaaatttgtttattgctaccataccaatatgtgtgtagatgcttcaaatcaggaactggatgcactgatactaaatttgaatttgaacagaaaatgaatgagacatataatagtaagaacgatatgtataattcagatttcacactagctttaactgttttgcacttagctatgcgaggaacagcatcaacatatataatagataatgttttacaaaagaattattcaaatgtcatcgaatacctaaatactacaaaaaacaacttcaaatctaaccaagtatttggagttttggtagactttaccatatatttattaagacatgcttcatatgccaaatacaatttaccacagagtcttaaaaaattcagatcagtaagttcagacttaacaacaatttcaggcagatcatctggacaaaatatagtctctgatttgcatcaaggagatgttataaaaacatgtttaaacatcaagcaattaaactgtatttcacctaggtccagaacaacaacaacaaatctgataacatgtggaacttcccaaattagtgtatataatttacctcgaggccaattgtatgaatctgttactacagaacatggaacatgtgcagatgatggccattgcttgactgatttcatgcccataaatagtgactttctagctacgctaaagaaatcaaaatgttggacaacagatatacctaatataatcaagcttgtagagagtgatggtaaaataagttgtcagcctattgatgtaggatcctgcaatgtatcaggtaatatatggacaatcacaaaatgctcagataataagtattattatactgacaataagcatgttcatgatgatgcaaaagatattggtcattattgtatggaagaaacctgtaaatttgttcgcttccccataaatgacaaatttgtcagcaactgcgaatgggatctgaatcatatcgaaataaataagctcaatcaggttgaactagacaatataaatgcatataaaaaggttttaactgaaaaattaactagttctcttagtgttttcaaatataaattaacacaaaatttgccacatgttattccaaaattcaaatatataactatacaaggaacccaaacggtagatggtattgagaattcattcatagaagttgaaattccagcactatcaggtgctgcatcaggatttaaaataatgacaaaagagaacaatgaattatttgatgcaatattgtatgtaaagcaagcttcctttagtagtatttacaagaagatctatacaacagggccaactataggaataaatacaaaacatgatgaaaaatgcactggtgcatgccctgtaaatttaccacataatacaggttggcttacatttgctaaagagagaactagcacatggggttgtgaagaatatggatgccttgctataaacgatggatgtgtttttggctcatgccaagatataataaaggatgaaatgtacatattcaaaaaggaaacagaagaagtggcattggtagaaatttgtataagcttcaatcataaaacattctgcactgatgtagattcaacaacacccataattactgatactctagaggcacaattcaagacagtagaatcatataaattaccaaatcatgtagctttgaagcaacataagctgtatgtaggccaaatcaatgattttggagtatataaaaaggcatgtggaaatgtgcaaaaaataaataatactatatatggagaaggtactccacgatttgattatttatgtcacctagctaagaggaaagatgttttagtcaggaaatgctttgataatgactataactcttgctctctcttaactatagcagatgacctgagattagaagaagacagtgaaaagctaaaagtcatcaattatagaaaagtactgggctctatgaagttcaaggctctcttcggggatataagatataaatcattcacagaggatattgaattagatgtagaggcttcttgtgcaggttgtataaattgttttgataatatacattgtgaaataaaattaacaaatggtttagacacatcttgcagtttcgaatctagttgtgatgcattcaattccagaatattatttaattcaaatcaacatgtatattctactaagttaatatgtactaaagaacaaacaaaagcttttgaaataaaaatctgcggaaaaactataaaagctgatttagtggtaactgaagcaaaaccaatacttgagttaactcctattgatcagacatcttatattaaagaagaagacaccagatgtggaacatggttttgcaggttgacaaaagaaggattctcagtattgttagaaccgttcaagaatttattcgggagttatttagggattgcttatactgtcataatagctttgttatgcttgtttgtttttatatacataatcttacctatgataatgaagttgaaagaggttttaaagcagaatgaaatagcttatcagaaggaacaaaagaaaaggtga

SEQ ID NO: 4197 - RNA, 4326 nt, synthetic construct
  misc_feature 1..4326: note = derived and/or modified CDS sequence (wt) from CEV(283)__KX817313.1__GP
  source 1..4326: mol_type = other RNA
atgattttcatgctaatcctatttgcagtggctgctgcaagccctgtttatcagaggtgcttccaagatggtgctatagtgaagcaaaatccatcaaaggaagcagtgacggaagtgtgccttaaagatgatgtaagcatgataaaaactgaggccagatatactaagaacagtactggagtattctcaaacaatgtagcaataaggaagtggctagtctctgattggcatgattgcagacccagaaaagtcgttgggggtcatataaatgtcatagaagttggggatgacttaacactccatactgagtcatacgtttgcagtgccgattgcactataggtgttgacaaagaaacagcccaagtcaggctacagactgatacaacaaatcatttcgagattgcaggaaccacagtaaaatctggatggttcaagagcacaacatatattagtctggatcagacctgcgaacatttgaaggtttcttgcggtccaaagtccatacaattccacgcctgcttcaaccaacacatgtcatgtgtcagattcttacatagaactattctgccaggttctattgcgaactcaatatgccaaaatgttgaaataataatattagtaacactagccttgctgatttttattttacttagtatcataagtaaaacatatatatgctatctattgatgcctatattcatcccaattgcttatatatatggtctaatttataacaaatcatgtaaaaaatgcaagctatgtggtttagtctatcacccatttactgagtgtggtactcactgcgtctgtggtgcaagatatgacacgtcagataggatgaaactccatcgagcatcaggtctctgccctggatataaaagtcttagagctgctagagttatgtgcaaatcgaaagggccagcctccatactgtcaataatcactgcagttctaatactaacttttgtcacacctataaacgcaatgatggttggagagagcaaggaaacctttgaacttgaggagctccctgatgacatgctagaaatggctaacaatctaaacacttattatatgctctgtgtggcaaattatgcagtcacatggagcttgctaatagttgccttaataataggtttattattcaagaaataccaacatcgattcttagatatttatgccatgtactgtgaagagtgcgatatgtatcatgataggtctggtattaaatggaacggtgatttcacgaataagtgtggccattgcacatgcgggcagtacgaagatgcatccgggctcttagtgcaccggaaaacatataattgcctaatacagtacaaatctaaatggattatgaactttttggtaacttatgtaatcttggtattgcttaaagattctgtagttattgttcaggcaaaaggggtggatttcagtgaatgtattgaagcagaaaaagtaaggtggaactgtacaggcccttttgttaatctaggaaactgtgagaaaaaacaaaagaaagaaccatactctaatattgctgctcaattaaagggcttgggtgctatctctatactggatgttcctataattgcaagtattcctgaggatattgccggagcattaagatacatagaagaccagagatcataccactctcagttgactgttgagtatgctatgttgaccagatactgtgattattacactcagttcagtgacaattctggttatagtcagacaacctggagggtttaccttagatcacacgattttgaggcatgcgttttgtatccaaaccagcacttctgcagatgtgtaaagcatggggacaaatgtagtagttcaaattgggactttgcctctgaaatgaagaattactactctggtaagcaaagcaagtttgataaggatttgaatttagccctcacatctctacaccatgctttcagagggacctcttcatcttacatagcagggttgctatctagtaaagcaaatgatgagttagtgcagtacacatctaaaattagggagaagttccccgggaatgcactactaaaggcagtaattgactatattgcatatatgaaggggcttaccgaaatgagtaacttcaaaaaggatgagttctgggatgagttagtatatgtgcctgaccctactaagcctcccaagctatcaagaagcagtggaacagtatatgatttcaaatcagctacatccaacttgggtgaaaagaactgtaaggatgtaaagggtgttgtatgcttgtcgcctagatctggtgtgacatatgactcaataatagcttgtggtgaaggatccagtccaaatatctatagaatacccaaaacaggagtgtaccaatccaattcagaaccatctaattactgtgtgtcggatagccactgccttgaagattttgaagtgataaaccaagaggagctagatgctataaaaaagtctagatgctgggaagttgattacctatatgctaacccttctaaacaaagtgatggcataagaagctgccgtatgagagatgctgggcactgcaatgtcaccacaaatagatggccaataatacaatgtgatgacaataaatactactattctgaattgcagagagactatgacaaagagcaagatataggtcacttttgccttagccctaggtgtaccactgtcagattccctatccatccaaaacatgtaagcaactgcgattggcaagtgagccactccacagtagataaagtggatgtacataacctggaggatattgagcaatacagaaaagccataacacaaaagctccaaaatagcttatcgatatttaagtatgctagaaccaagaatctcccacatataaaacctatatataaatatataacaattgaaggtacagaaactgcagaaggaattgaaagtgcttatatagaatcagaaataccagcattagcagggacctctattggatttaaaataaataccaaagaggggaagcatttactagatgttatagcttatgttaagcaagcttcttactcgtcattatacaataaaatgtacgtgaccgggcctacagtaggcataaatacaaaacatgatgagttatgcactggcccttgccctgttaatgtcccacactcagacggatggctgacattcgctagagaaagaactagttcttggggttgtgaggaattcgggtgtttagcaatcagtgatggatgcgtttttgggtcttgccaggatctaataaaggaagaactggcagtgtataggaaagagacagaagaagcaaccaatgttgaattatgcttgactttttcagataagacctactgtacagaattaaatcctataacacctataataacaaatctgtttgaagtacaattcaaaactgtagaaacttacagcctgcctagggttgtagcagtccaaaaccacgagattagaataggacagatcaatgacttaggcatttattctaagggctgtggaaatgtccaaaaagtcaacaacaccatatatggtaatggagttccaaaattcgattacctttgtcatctagcaagtagaaaggaggtaattgttagaaaatgttttgacaatgattttcaggcatgcaaatttttgcaaagtccaccaagctataggcttgaggaagatgacggatcaatcacagtgatagattataagaaaatcctcggcacaataaaaatgaaagctatactaggagatgtaaaatataagacatttgcagagaatatcgatataactgctgaaggagtttgtacaggatgtgtcaattgttttgaaaatatacactgtgagcttacaatacacacaactatagaggccagttgcccagttactagtccttgcactttatttcatgatcggatattgatcactccagatgaacacaagtatgctatgaaagtaatttgcacagagaagcaaacaggaacattaccgttcaaaatctgtaactcaaaagtcgatgccactttaactttagtagaagccaaacctattctagaactggcctctgttgatcaaactgcatatataagagaaaaagatgaaaggtgtaaaacatggatgtgcagagtaagggatgaagggattcaggttatattagagccatttaaaaatctctttggttcttatattggtatattttatacttcaatcctcattgttattacaatatttataattatttatgtaatcctgcccatatgttttaaattgaaagacactttacaaaagcatgaagatgcatacaagagagaaatgaaaataagataa

SEQ ID NO: 4198 - RNA, 4326 nt, synthetic construct
  misc_feature 1..4326: note = derived and/or modified CDS sequence (wt) from CEV(BFS283)__AF123483.1__GP
  source 1..4326: mol_type = other RNA
atgattttcatactaatcctatttgcagtggctgctgcaagccctgtttatcaaaggtgcttccaagatggtgctatagtgaagcaaaatccatcaaaggaagcagtgacggaagtgtgcctcaaagatgacgtaagcatgataaaaactgaggccagatataccaagaatagtactggagtgttctcaaacaacgtggcgataaggaagtggctagtctcagattggcatgattgcagacccagaaaagtcgttgggggtcatattaatgtcatagaagttggggatgacttgacactccatactgagtcatacgtttgcagtgctgattgcactataggtgtggacaaagaaacagcccaagttaggttgcagactgatacaacgaatcatttcgagattgcaggaaccacagttaaatctggctggttcaaaagcacgacatatattagcctagaccagacttgcgaacatttgaaggtttcttgcggtccaaagtccatacaattccatgcctgtttcaatcaacacatgtcatgtgtcagatttttacatagaactattctgccaggttctattgcaaactcaatatgtcaaaatgttgaaataataatattagtgacattggccttgctgatttttatcctgcttagtatcataagtaaaacatacatatgctatctgttgatgcctatatttatcccaatcgcttatatatatggcctaatttataacaaatcatgcaaaaaatgcaagctgtgtggtttagtttatcacccaattacagagtgtggtacccattgcgtctgtggcgcaagatatgacacatcagataggatgaaactccatagagcatcaggtctttgccctgggtacaaaagtcttagagctgctagagttatgtgtaagtcaaaaggaccagcctctatactgtcaataatcactgctgttttaatactaacctttgtcacacctataaatgcaatgatggttggagggagcaaagagacctttgaacttgaggagctccctgatgacatgctagaaatggctaacaatttaaatacttattatatgctctgcgtaacaaattatgcagttacatggagcctgttgataattgccttagcaataggtttattatttaaaagataccaacatcggtttttagatatttatgctatgtattgtgaagaatgcgatatgtatcatgataggtctggtattaaatggaacggtgatttcacaaataagtgtggccaatgtacatgcggacagtacgaagatgcatccggactcttggtgcaccgaaaaacatacaattgcctaatacagtacaaatctaagtggattatgaacttcttgataacttatgtaatcttggtattgcttaaagattctgtagttatcgttcaagcaaaaggaacagatttcagtgaatgtattgatgcagataaaataaagtggaactgtacaggtccttttgttaatctaggaaactgtgagaaaaagcaaaagaaagaaccatactctaatattgctgctcaattgaagggcttgagtgctatctctatactagatgttcctataattgcaagcatccctgaggatattgctggggcattgagatacatagaagaccagagatcataccactctcagttgactgttgagtatgctatgttaaccagatattgtgattattacactcagttcagtgacaactctggttatagtcaaacaacctggagagtttaccttagatcacatgtttttgaggcatgcattttgtacccaaatcagcacttctgcagatgtgtaaaacatggagataaatgtagcagctccaactgggactttgcctctgaaatgaagaattattactctggtaagcaaaacaagtttaataaagacttgaatttggcccttacatctctacaccatgccttcagagggacctcctcgtcttacatagcaggattgctatctactaaagcaaatgatgagttagtgcagtatacatctaaaatcagagagaagttccccgggaatgcattactaaaggcaataattgactatattgcatacatgaagggactcacagagatgagcaacttcaaaaaggatgagttttgggatgagttggtatatgtgcctgaccctactaagcctcccaagctatcaaggggcagtgaaacagtttatgatttcaaatcagctacgtccaacttgggtgaaaagaactgtaaggatgtaaagggtgttgtgtgtttatcgcctagatctggtgtgacatatgactcaataatagcctgtggtgaagggtctagcccgaatatctacaaaataccaaaaacaggagtgtaccaatccaattcagaaccatctaactactgtgtgtcagatagccactgtcttgaagattttgaagtaataagccaagaggagttggatgctataaaaaagtccaggtgttgggaagttgattacctatatgccaatcctcctaaacaaagtgatggcgtaagaagctgccgtatgaaagatgctgggcactgcaatgtcactacaaacagatggccaataatacaatgtgatgacaataaatactattattctgagctgcagagagactatgataaagagcaggatataggtcatttctgccttagccccaggtgtgccactgttagattccctatccatccaaagcatataagcaactgcgattggcaagtgagccactccacagtagacaaagtgaatgtacataacctagaagatattgagcagtacaggaaggccataacgcaaaagctccagaatagcttgtcaatatttaagtatgctagaaccaagaacctcccacacataaagcctatatataaatacataacaattgaaggtacagaaactgcagaaggaattgaaagtgcctatatagagtcagaaataccagcattagcagggacttctatcggatttaaaataaataccaaggaggggaaacatttattagatgttatagcttatgttaagcaagcttcttactcctcattatacaataaaatgtatgtgactggacccacagtaggcataaatacaaaacatgatgagttgtgcactggcccttgccctgttaatgtcccacattcagacgggtggctaacatttgctagagaaagaactagttcttggggttgtgaggaattcgggtgtttagcaattagtgatggatgcgtttttgggtcctgtcaagatctaataaaggaagaactaacagtgtataggaaagagacagaagaagcaaccaatgttgaactatgcttgacttttgcagacaagacctactgtacagaattaaatcctgtaacacctataataacgaatctatttgaagtacaattcaagactgtggaaacttatagtctgcccagggttgtagcagtccagaatcatgagattaggataggacagatcaatgacctaggtgtttactctaagggctgtgggaatgtccaaaaagttaataacaccatatatggtaatggagttccaaaattcgattacctttgccacctagcaagtagaaaagaggtgattgttaggaaatgttttgataacgattttcaggcatgcaaatttttgcaaagcccaccgagctataggcttgaagaggatgatggatcaatcacagtgatagattataagaagatccttggtacaataaagatgaaggctatactaggggatgtaaaatataagacatttgcagagaatatagatataactgctgaaggagtttgtacaggatgtatcaattgttttgagaatatacattgtgagcttacaatacacacaactatagaggccagttgtccagttactagtccttgcactttgttccatgataggatattgatcactccagatgaacacaagtatgctataaaagtaatttgcacagagaaacaaacaggaacattaccattcaaaatctgtaactcaaaaatcgatgccactctgactttagtagaagccaaacctattttagagctagcccctgtcgatcaaactgcatatataagggaaaaagatgaaaggtgcaaaacatggatgtacagagtaagggatgaagggattcaggttatattggagccatttaaaaatctctttggttcttatataggtatattttatacttctatccttgttgttattgcaatgtttataattgtttatgtaatcctgcccatatgttttaaactgaaagacactttacaacggcatgaagatgcatacaaaagagaaatgaaaataagataa

SEQ ID NO: 4199 - RNA, 4329 nt, synthetic construct
  misc_feature 1..4329: note = derived and/or modified CDS sequence (wt) from CHATV(Mohko ILO8-3)__KF719222.1__GP
  source 1..4329: mol_type = other RNA
atgatgattttcatattgatactgtttgcagtcagtgctgcaagtccagtatatcaacggtgtttccaagatggggctatagtgaagcaaaacccatctaaggaggctgttacagaagtatgcctcaaagacgacgttagcatgataaagacagaagccaggtatgtgaagaatgctacaggaatctattctaacaatgtggcaatcaggaaatggttagtctcagactggcatgactgtaggcctaggaaagtctcaggtggacacatcaatgttatagaagttggtgatgatctttcacttcatactgaatcttatgtctgcagtgctgattgcacaattggagtggataaagaaaccgcacaagttagacttcaaactgacacaacaaaccattttgagatagcaggaacaacagtcaagtccggatggtttaaaagcacaacatacataactctagatcaaacatgtgagcacttgaaagtctcttgtggacctaagtcagttcaattccacgcatgctttaatcaacacatgtcctgcgtcagattcttgcataggacaattctgcctggatccattgccaactcaatatgccagaatatagaaataataattctagtaactcttacactactaatttttgtacttttaagtatattgagtaagacatatatctgttatttactaatgcctatctttattcctatagcatatatatatggtattatttacaataagtcttgtaagaaatgtaaattgtgcgggttagtttaccacccattcacagaatgcgggacacattgtgtatgcggtgctcgctatgatacctccgatagaatgaaattacacagatcttctggtctatgccctgggtataagagtctaagggctgccagagttatgtgtaagtccaaaggccctgcatcaatactatcgataattacagcaatactggttctaacttttgtcacaccaataaattcaatggttataggagaaagcaaagaggtctttgaattggaagagctcccagatgatatgttggaaatggcactgaagattaatctttattattttgtttgtgttataaattatgctgtgacttggagcctcgtaattgttgccttgctaattgcgttaatattcaaaaagtaccaacacagattcttaaatctttatgcaatgtactgtgaggaatgtgacatgtatcatgatagaatcggcttgaagaggaatggagatttcacaaataaatgcaggcaatgtacgtgcggacagtatgaggatgctactgggctaatgacacacagaaagacatacaattgccttgtgcaatataagtctaagtggattttgaatttcttgataacttatatgatcttaactctgattaaggactcagctataattgtacaagcagctggtacagacttcagtgcttgtttagaagcacagagtgtggattggaattgcacagggccatttttaaacctcggaaattgccaaaaacagcagaaaaaggagtcctatgcaaatattgctacacaactcaaaggcttgcaggcaatctcagtactggatgtgcctatgatagcaaacataccggaggatatagcaggagcactaagatatatagaagaaaaagacacatttcatgtccaattaactgcagaatatgctatgctgactaggtactgcgattactacacacaatttgcagacaattctggttacagtcagacgacatggagggtttatttgagatcacacgattttgatgcttgcatactatacccaaaccaacatttttgtcgatgtgtcaagcacggagacaaatgcagtagttccaactgggattttgcaaatgagatgaagaactattactcagggaagcaaaacaaatttgataaagatttgaatttggccctgatggcagtgcaccatgcattcagaggtacctcatcagcatatattgcaacaatgttgtccaaaaaatcgaataatgatctggttacatacaccaataagataaaggaaaagttccccggaaatgctttattaaaagctataatggattatatatcatacatgaagggcttatctgaaatgacaaactttaaatacgatgaattctgggatgatcttctgcacaagccaagccccacaaatgcccctcctctgtcaagagatagtgaaccatcatacaacttcaagtcagttatttcctcaaggtctgtgaaaagctgtaaaaatgttaaaaacgtagtgtgcttgtcacctagatctggcgtgtcttacgactctatattggcatgcggtgaaccaaatggaccaagtgtatacaagaagccatccgatggtgtattccagtccaattcggataagacaatgtattgcttagctgatagtcactgcttagaagattttgaagtagttagtcaggaagagttagatgctataaaaaagtccaagtgttgggtaacagaataccctaatgtaaaattgtccaaattgagtgatgggattacgagctgcagaatgaaagattcagggaaatgcaatgttgcagctaacagatggccaataatacaatgcgaaaatgataaattctattactcagaattacagaatgattacgataaaacacaggatatcggacatttttgccttagtccagggtgctctacaatccggttcccaattaaccagaagcatatatctaactgtaattggcaggttagtcggtctagcatagcaaaaatcgatgtgcatgatattgaggacattgatcagtatagaaaggccataactcagaaacttcaaactggtctctcattatttaaatatgctaagacaaaaaatctaccacatataaagccaatttacaaatatataactattgaaggaactgagactgccgaaggcatagaaagtgcatatattgaatctgagatacctgcattagctgggacatcaattggtttcaaaatcaactctaaagaagggaagcatttattggatattgttggttatgtcaaaagtgcatcatactcatctgtgtatacaaagctttactcaacaggtccaacatcaggaataaatacgaaacatgatgagctatgcactgggccatgccctgtgaatataaaccatcagacaggatggttgacctttgcgaaagaaagaacaagctcatggggctgtgaagaatttggttgccttgctattagtgatgggtgtgtctttgggtcatgtcaggatatagtgagagatgaattgtcagtatataggaaagaaacagaagaagtaacagatgtagaactttgtctgaccttctcagacaagacttactgtacaaatttaaatcctataacgccaatcataacagacttatttgaggtccagtttaaaactgtggaaacttacagcttaccaagaatagtggccatccagaaccatgaagtgaagattggccaaataaatgatttgggagtttactcgaaaggttgtggtaacgttcaaaaagtgaatgggacagtttatggcaatggggtcccaaaatttgattatttgtgtcatctagctagtaggaaagaggtcattgtaagaaagtgctttgataatgattaccaagcatgtaaattcttacaaacaccagcaagctacagactggaggaaagtagtggcacagtgactgttatcgattataagaaaatattagggacaatcaaaatgaaagctatcttaggggatgtcaaatataaaacttttgcagataatgtagatatgactgctgagggatcatgtgccgggtgcataaattgttttgaaaatatccattgcgaattaacactacatacaacaatagatgcaagttgccctgttacaagcccgtgcacagtatttcatgataggatactaataacaccaaatgagcataagtatgcaatgaaagttatctgtactgaaaagccgggtaatacattaacaatcaaaatttgcggcactaaaattgacgcttcgttagctcttattgatgctaagccaatactagagttagcaccagttgatcagaccgcttacattagagaaaaagatgaaaggtgcaagacttggatgtgtagagtaagagatgaaggcttgcaggtcattttagaacctttcaagaacttatttggctcttatatagggatattttatacctttattatctgtattattgtattattgattgttatctacattgttttgcctatctgctttaagctaagagacactctcaggcagcatgaggatgcctataaaagagagatgaaaattaggtaa

SEQ ID NO: 4200 - RNA, 4329 nt, synthetic construct
  misc_feature 1..4329: note = derived and/or modified CDS sequence (wt) from CHATV(Mohko M07-1)__KF719225.1__GP
  source 1..4329: mol_type = other RNA
atgatgattttcatattgatactgtttgcagtcagtgctgcaagtccagtatatcagcggtgtttccaagatggggctatagtgaagcaaaacccatctaaggaggctgttacagaagtatgcctcaaagacgacgttagcatgataaagacagaagccaggtatgtgaagaatgctacaggaatttattctaacaatgtggcaatcaggaaatggttagtctcagactggcatgactgcaggcctaggaaagtctcaggtggacacatcaatgttatagaagttggtgatgatctttcacttcatactgaatcttatgtctgcagtgctgattgcacaattggagtggataaagaaaccgcacaagttcgacttcaaactgacacaacaaaccattttgagatagcaggaacaacagtcaaatccggatggttcaaaagcacaacatacataactctagatcaaacatgtgaacacttgaaggtctcttgtggacctaagtcagttcaattccatgcatgctttaatcaacacatgtcctgcgtcagattcttacataggacaattctgcctggatccattgccaactcaatatgtcagaatatagaaataataattctagtaactcttacactactaatctttgtacttttaagtatattgagtaagacatatatctgttatttactaatgcctatctttattcctatagcatatatgtatggtattatttacaataagtcttgtaaaaaatgtaaattgtgcgggttagtttaccacccattcacggaatgcgggacacattgtgtatgcggtgctcgctatgatacctccgatagaatgaaattacacagatcttctggtctatgccctggatataagagtctaagggctgccagagttatgtgtaagtccaagggccctgcatcaatattatcgataattacagcaatactggttctaacttttgtcacaccaataaattcaatggttataggagaaagcaaagaggtctttgaattggaagagctcccggatgatatgttggaaatggcactgaagattaatctttattattttgtttgtgttataaattatgctgtgacttggagcctcataattgttgccttgctaattgcgttaatattcaaaaagtaccaacacagattcttaaatctttatgcaatgtactgtgaggaatgtgacatgtatcatgatagaatcggcctgaagaggaatggagacttcacaaacaaatgcaggcaatgtacatgcggacagtatgaggatgctactgggctaatgacacacagaaagacatacaactgccttgtgcaatataagtctaagtggattttgaatttcttgataacttatatggtcttaactctgattaaggactcagctataattgtacaagcagctggtacagacttcagtgcttgtttagaagcacagagtgtggactggaattgcacagggccatttttaaacctcggaaattgccaaaaacagcagaaaaaggagtcctatgcaaatattgctacacaactcaaaggcttgcaggcgatctcagtactggacgtgcctatgatagcaaacataccggaggatatagcaggagcactaagatatatagaagaaaaagacacctttcatgttcaattaactgcggaatatgctatgttgactaggtactgcgattactatacacaatttgcagataattctggttatagtcagacgacatggagggtttatttgagatcacacgattttgatgcttgcatactatacccaaaccaacatttttgccgatgtgtcaagcacggagataaatgcggtagttccaaccgggattttgcaaatgagatgaagaactactattcaggaaagcaaaacaaatttgataaagatttaaatttggccctgatggcagtgcaccatgcatttagaggtacttcatctgcatatattgcaacaatgttgtccaaaaaatcgaataatgatctggttacatacaccaataagataaaggaaaagttccctggaaatgctttattgaaagctataatggactatatatcatacatgaagggcttatcagaaatgacaaactttaagtacgatgaattctgggatgaccttctacacaagccaagccctacaaatgcccctcctctgtcaagagatagtgaaccatcatacaacttcaagtcagttatctcctcaagatctgtgaaaagctgtaaaaatgtcaaaaacgtagtgtgtttgtcacctagatctggcgtgtcttacgactctatattggcatgcggtgaaccaaatggaccaagtgtgtacaagaagccatctgatggtatattccagtccaattcggataagacaatgtattgcttagctgatagtcactgcttagaggattttgaagtggttagtcaggaagaattagatgctataaaaaagtccaagtgttgggtaacagaataccctaatgtaaaattgtccaaactgagtgatgggatcacaagctgcagaatgaaagattcaggaaaatgcaatgttgcagccaacagatggccgataatacaatgtgaaaatgataaattctattactcagaattacagaatgattacgataaaacacaggatatcggacatttttgccttagtccagggtgctctacaatccggttcccaattaaccagaagcatatatctaactgtaattggcaagttagtcgatctagcatagcaaaaatcgatgtgcatgatattgaggacattgatcagtatagaaaggccataactcagaaacttcaaactggtctctcattatttaaatatgccaagacaaaaaatctaccacatataaagccaatttacaaatatataactattgaaggaactgagactgccgaaggcatagaaagtgcatatattgaatctgagatacctgcattagctgggacatcaattggttttaaaatcaactccaaagaagggaagcatttattggatattgtcggttatgtcaaaagtgcatcatactcatctgtgtatacaaagctttactcgacaggtccaacatcaggaataaatacaaaacatgatgagctatgcactgggccatgccctgtgaatataaatcaccagacaggatggttgacttttgcgaaagaaagaacaagctcatggggctgtgaagaatttggttgcctcgctattagtgatgggtgtgtctttgggtcatgtcaggatatagtgagagatgaattgtcagtatataggaaagaaacagaagaagtaacagatgtagaactttgtctaaccttctcagacaagacttactgtacaaatttaaatcctataacgccaatcataacagacttatttgaggtccagtttaaaactgtggaaacttacagcttaccaagaatagtggccatccaaaaccatgaagtaaagattggccaaataaatgatttgggagtttactcgaaaggttgtggtaacgttcaaaaagtgaatgggacagtttatggcaatggggtcccaaaatttgattatttgtgtcatctagctagcaggaaagaggtcattgtgaggaagtgctttgataatgattaccaagcatgcaaattcttacagacaccagcaagttacagactggaggaaaatagtggcacagtgactgttattgattataaaaaaatattggggacaatcaaaatgaaagctatcttaggggatgtcaaatataaaacttttgcagataatgtagatatgactgctgaaggatcatgtgccgggtgtataaattgctttgaaaatatccattgcgagttaacactacatacaacaatagatgcaagttgccctgttacaagcccgtgcacagtatttcatgataggatactaataactccaaatgagcataagtatgcaatgaaagttatctgtactgaaaagccaggtaatacattaacaatcaaaatttgcggcactaaaattgatgcttcattagctcttattgatgctaagccaatactagagttagcaccagttgatcaaacagcttacattagagagaaagatgagaggtgcaagacttggatgtgtagggtgagagatgaaggcttgcaggtcattttagaacctttcaagaacttatttggctcttatatagggatattttatacctttattatctgtatgattgtattattgattgttatctacattgttttgcctatctgctttaagctaagagacactctcaggcagcatgaggatgcctacaaaagagagatgaaaattaggtaa

SEQ ID NO: 4201 - RNA, 4329 nt, synthetic construct
  misc_feature 1..4329: note = derived and/or modified CDS sequence (wt) from CHATV(Mohko M07-2-83)__KF719228.1__GP
  source 1..4329: mol_type = other RNA
atgatgattttcatattgatactgtttgcagtcagtgctgcaagtccagtatatcagcggtgtttccaagatggggctatagtgaagcaaaacccatctaaggaggctgttacagaagtatgcctcaaagacgacgttagcatgataaagacagaagccaggtatgtgaagaatgctacaggaatttattctaacaatgtggcaatcaggaaatggttagtctcagactggcatgactgcaggcctaggaaagtctcaggtggacacatcaatgttatagaagttggtgatgatctttcacttcatactgaatcttatgtctgcagtgctgattgcacaattggagtggataaagaaaccgcacaagttcgacttcaaactgacacaacaaaccattttgagatagcaggaacaacagtcaaatccggatggttcaaaagcacaacatacataactctagatcaaacatgtgaacacttgaaggtctcttgtggacctaagtcagttcaattccatgcatgctttaatcaacacatgtcctgcgtcagattcttacataggacaattctgcctggatccattgccaactcaatatgtcagaatatagaaataataattctagtaactcttacactactaatctttgtacttttaagtatattgagtaagacatatatctgttatttactaatgcctatctttattcctatagcatatatgtatggtattatttacaataagtcttgtaaaaaatgtaaattgtgcgggttagtttaccacccattcacggaatgcgggacacattgtgtatgcggtgctcgctatgatacctccgatagaatgaaattacacagatcttctggtctatgccctggatataagagtctaagggctgccagagttatgtgtaagtccaagggccctgcatcaatattatcgataattacagcaatactggttctaacttttgtcacaccaataaattcaatggttataggagaaagcaaagaggtctttgaattggaagagctcccggatgatatgttggaaatggcactgaagattaatctttattattttgtttgtgttataaattatgctgtgacttggagcctcataattgttgccttgctaattgcgttaatattcaaaaagtaccaacacagattcttaaatctttatgcaatgtactgtgaggaatgtgacatgtatcatgatagaatcggcctgaagaggaatggagacttcacaaacaaatgcaggcaatgtacatgcggacagtatgaggatgctactgggctaatgacacacagaaagacatacaactgccttgtgcaatataagtctaagtggattttgaatttcttgataacttatatggtcttaactctgattaaggactcagctataattgtacaagcagctggtacagacttcagtgcttgtttagaagcacagagtgtggactggaattgcacagggccatttttaaacctcggaaattgccaaaaacagcagaaaaaggagtcctatgcaaatattgctacacaactcaaaggcttgcaggcgatctcagtactggacgtgcctatgatagcaaacataccggaggatatagcaggagcactaagatatatagaagaaaaagacacctttcatgttcaattaactgcggaatatgctatgttgactaggtactgcgattactatacacaatttgcagataattctggttatagtcagacgacatggagggtttatttgagatcacacgattttgatgcttgcatactatacccaaaccaacatttttgccgatgtgtcaagcacggagataaatgcggtagttccaactgggattttgcaaatgagatgaagaactactattcaggaaagcaaaacaaatttgataaagatttaaatttggccctgatggcagtgcaccatgcatttagaggtacttcatctgcatatattgcaacaatgttgtccaaaaaatcgaataatgatctggttacatacaccaataagataaaggaaaagttccctggaaatgctttattgaaagctataatggactatatatcatacatgaagggcttatcagaaatgacaaactttaagtacgatgaattctgggatgaccttctacacaagccaagccctacaaatgcccctcctctgtcaagagatagtgaaccatcatacaacttcaagtcagttatctcctcaagatctgtgaaaagctgtaaaaatgtcaaaaacgtagtgtgtttgtcacctagatctggcgtgtcttacgactctatattggcatgcggtgaaccaaatggaccaagtgtgtacaagaagccatctgatggtatattccagtccaattcggataagacaatgtattgcttagctgatagtcactgcttagaggattttgaagtggttagtcaggaagaattagatgctataaaaaagtccaagtgttgggtaacagaataccctaatgtaaaattgtccaaactgagtgatgggatcacaagctgcagaatgaaagattcaggaaaatgcaatgttgcagccaacagatggccgataatacaatgtgaaaatgataaattctattactcagaattacagaatgattacgataaaacacaggatatcggacatttttgccttagtccagggtgctctacaatccggttcccaattaaccagaagcatatatctaactgtaattggcaagttagtcgatctagcatagcaaaaatcgatgtgcatgatattgaggacattgatcagtatagaaaggccataactcagaaacttcaaactggtctctcattatttaaatatgccaagacaaaaaatctaccacatataaagccaatttacaaatatataactattgaaggaactgagactgccgaaggcatagaaagtgcatatattgaatctgagatacctgcattagctgggacatcaattggttttaaaatcaactccaaagaagggaagcatttattggatattgtcggttatgtcaaaagtgcatcatactcatctgtgtatacaaagctttactcgacaggtccaacatcaggaataaatacaaaacatgatgagctatgcactgggccatgccctgtgaatataaatcaccagacaggatggttgacttttgcgaaagaaagaacaagctcatggggctgtgaagaatttggttgcctcgctattagtgatgggtgtgtctttgggtcatgtcaggatatagtgagagatgaattgtcagtatataggaaagaaacagaagaagtaacagatgtagaactttgtctaaccttctcagacaagacttactgtacaaatttaaatcctataacgccaatcataacagacttatttgaggtccagtttaaaactgtggaaacttacagcttaccaagaatagtggccatccaaaaccatgaagtaaagattggccaaataaatgatttgggagtttactcgaaaggttgtggtaacgttcaaaaagtgaatgggacagtttatggcaatggggtcccaaaatttgattatttgtgtcatctagctagcaggaaagaggtcattgtgaggaagtgctttgataatgattaccaagcatgcaaattcttacagacaccagcaagttacagactggaggaaaatagtggcacagtgactgttattgattataaaaaaatattggggacaatcaaaatgaaagctatcttaggggatgtcaaatataaaacttttgcagataatgtagatatgactgctgaaggatcatgtgccgggtgtataaattgctttgaaaatatccattgcgagttaacactacatacaacaatagatgcaagttgccctgttacaagcccgtgcacagtatttcatgataggatactaataactccaaatgagcataagtatgcaatgaaagttatctgtactgaaaagccaggtaatacattaacaatcaaaatttgcggcactaaaattgatgcttcattagctcttattgatgctaagccaatactagagttagcaccagttgatcaaacagcttacattagagagaaagatgagaggtgcaagacttggatgtgtagggtgagagatgaaggcttgcaggtcattttagaacctttcaagaacttatttggctcttatatagggatattttatacctttattatctgtatgattgtattattgattgttatctacattgttttgcctatctgctttaagctaagagacactctcaggcagcatgaggatgcctacaaaagagagatgaaaattaggtaa

SEQ ID NO: 4202 - RNA, 4326 nt, synthetic construct
  misc_feature 1..4326: note = derived and/or modified CDS sequence (wt) from CHATV(LEIV-15854)__HQ734820.1__GP
  source 1..4326: mol_type = other RNA
atgattttcatattgatactgtttgcagtcagtgctgcaagtccagtatatcaacggtgtttccaagatggggctatagtgaagcaaaacccatctaaggaggctgttacagaagtatgcctcaaagacgacgttagcatgataaagacagaagccaggtatgtgaagaatgctacaggaatctattctaacaatgtggcaattaggaaatggttagtctcagactggcatgactgcaggcctaggaaagtctcaggtggacacattaatgttatagaagttggtgatgatctttcacttcatactgaatcttatgtctgcagtgctgattgcacaattggagtggataaagaaaccgcacaagttagacttcaaactgacacaacaaaccattttgagatagcaggaacaacagtcaagtccggatggtttaaaagcacaacatacataactctagatcaaacatgtgagcacttgaaggtatcttgtggacctaagtcagttcaattccatgcatgctttaatcaacacatgtcctgcgtcagattcttgcataggacaattctgcctggatccattgccaactcaatatgccagaatatagaaataataattctagtaactcttacactactaatttttgtacttttaagtatattgagtaagacatatatctgttatttactaatgcctatctttattcctatagcatatgtgtatggtattatttacaataagtcttgtaaaaaatgtaaattgtgcgggttagtttaccacccattcacagaatgcgggacacattgtgtatgcggtgctcgctatgatacctccgacagaatgaaattgcacagatcttctggtctatgccctgggtataagagtctaagagctgccagagttatgtgtaagtctaaaggccctgcatcaatactatcgataattacagcaatactggttctaacttttgtcacaccaataaattcaatggttataggagaaagcaaagaggtctttgaattagaagagctcccagatgatatgttggaaatggcactgaagattaatctttattattttgtttgtgttatgaattatgctgtgacttggagcctcgtaattgttgccttgctaattgcgttaatattcaaaaagtaccaacacaggttcttgaatctttatgcaatgtactgtgaggaatgtgacatgtatcatgatagaatcggcttgaagaggaatggagatttcacaaacaaatgcaggcaatgtacatgcggacagtatgaggatgctactgggctaatgacacacagaaaaacatacaactgccttgtgcaatataagtctaagtggattttgaatttcttgataacttatatggtcttaactctgattaaggactcggctataattgtgcaagcagctggtacagactttagtgcttgtttagaagcacagagtgtggattggaattgcacagggccatttttaaacctcggaaattgccaaaaacagcagaaaaaggagtcctatgcaaatattgccacacaactcaaaggcttgcaggcaatctcagtactggatgtgcctatgatagcaaacataccggaagatatagcaggagcactaagatatatagaagaaaaagacacctttcatgtccaattaactgcagaatatgctatgctgactaggtattgcgattactacacacaatttgcagataattctggttatagtcagacgacatggagggtttatttgagatcacacgattttgatgcctgcatactatacccaaaccaacatttttgtcgatgtgtcaagcacggagataaatgcagtagttccaactgggattttgcaaatgagatgaagaactactactcaggaaagcaaaacaaatttgataaagatttaaatttggccctgatggcagtacaccatgcattcagaggtacctcatctgcatatattgcaacaatgttgtcaaaaaaattgaataatgatctgattacatacaccaataagataaaggaaaagttccctggaaatgctttattgaaagctataatggattatatatcatacatgaagggcttatcagaaatgacaaactttaagtatgatgaattctgggatgaccttctgcacaagccaagccccacaaatgcccctcctctgtcaagagatagtgaaccatcatacaacttcaagtcagttatttcctcaagatctgtgaaaagctgcaaaaatgtcaaaaatgtagtgtgtttgtcacctagatcaggtgcgtcttacgactctatattggcatgcggtgaaccaaatggaccgagtgtgtacaagaagccatctgatggtgtatttcagtccaattcggacaagacaatgtattgcttagctgatagtcactgtttagaagattttgaagtggttagtcaggaagaattagatgctataaaaaagtccaagtgttgggtaacagaataccctaatgtaaaattgtccaaattgagtgatgggatcacaagctgcagaatgaaagattcagggaaatgcaatgttgcagctaacagatggccaataatacaatgcgaaaatgataaattctattactcagaattacagaatgattacgataaaacgcaggatatcggacatttttgccttagtccaggatgctctacaatccggttcccaattaaccagaagcatatatctaactgtaattggcaggttagtcgatctagcatagcaaaaattgatgtgcatgacattgaggacattgatcagtatagaaaggccataactcagaaacttcaaactggtctctcattatttaaatatgctaagacaaaaaatctaccacatataaagccaatttacaaatatataactattgaaggaactgagactgctgaaggcatagaaagtgcatatattgaatctgagatacctgcattagctgggacatcaattggttttaaaatcaactctaaagaagggaagcatttattggatattgttggttatgtcaaaagtgcatcatattcatctgtgtatacaaagctttactcgacaggtccaacatcaggaataaatacgaaacatgatgagctatgcactgggccatgccctgtaaatataaaccaccagacaggatggttgacctttgcgaaagaaagaacaagctcatggggctgtgaagaatttggttgccttgctattagtgatgggtgtgtttttggatcatgtcaggatatagtgagagatgaattgtcagtatataggaaagagacagaagaagtaacagatgtagaactttgtctaaccttctcagacaagacttactgtacaaatttaaatcctataacgccaatcataacagacttatttgaggtccagttcaaaactgtggaaacttacagcttaccaagaatagtggccgtccaaaaccatgaagtaaagattggccaaataaatgatttgggaatttactcgaaaggttgtggtaacgttcaaaaagtaaatgggacagtttatggcaatggagtcccaaaatttgattacttgtgtcatctagctagtaggaaagaggttattgtgaggaagtgctttgataatgattaccaagcatgtaaattcttacaaacaccagcaagctacagactagaggaaaatagtggcacagtgactgttattgattataaaaaaatattggggacaatcaaaatgaaagctatcttaggggatgtcaagtataaaacttttgcagataatgtagacatgactgctgagggatcatgtgccgggtgcataaattgttttgaaaatatccattgcgaattaacactacatacaacaatagatgcaagttgtcctgttacaagcccgtgcacagtatttcatgataggatactaataaccccaaatgagcataagtatgcaatgaaagttatctgtactgaaaagccgggtaatacattaacaatcaaaatttgcagcactaaaattgacgcttcgttagctcttattgatgctaagccaatactagagttagcaccagttgatcagacagcttatattagagaaaaagatgaaaggtgcaagacttggatgtgtagagtaagagatgaaggcttgcaggtcatcttagaacccttcaagaacttatttggttcttatatagggatattttatacttttattatctgtgtgattgtactattgattgttatctacattgttttacctatctgctttaaactaagagacactctcaggcagcatgaggatgcctataaaagagagatgaaaattaggtaa

SEQ ID NO: 4203 - RNA, 4326 nt, synthetic construct
  misc_feature 1..4326: note = derived and/or modified CDS sequence (wt) from CHATV(LEIV-17756)__EU621834.1__GP
  source 1..4326: mol_type = other RNA
atgattttcatattaatactgtttgcagttagcactgcgagtccagtatatcaacggtgcttccaggatggggctatagtgaagcaaaacccatccaaggaagctgtcacagaggtgtgcctcaaagatgatgtcagtatgattaagacggaggccaggtatattaggaatgccacagggactttctctaacaacgtagcaatcaggaaatggattgtctcggattggcatgattgtagacctaaaaaagtctcaggtgggcacatcaatgtaatagaagtcggtgatgatctctcactccacactgaatcctatgtctgcagtgctgattgcacaattggagtggataaagaaactgctcaggtcagactccagactgacacaacaaaccattttgagatagcaggcacgacagtcaagtcaggatggtttaagagcacaacatatataaccctagaccaaacatgtgagcatctaaaagtctcttgtgggcctaaatcagtccaattccatgcatgctttaaccagcatatgtcttgcgtcagattcttacatagaacaattctacctggatctattgctaattcaatatgtcaaaatatagaaataataattttagtaactcttacattactaatttttgtactcttaagtatattaagcaagacttatatctgttatttactgatgccgatttttatccctatagcatatatatacggcatcatttataataaatcttgtaaaaaatgcaaattatgtggactagtgtatcatccgttcacagaatgtgggacgcattgtgtatgcggtgcccgctatgatacttctgacaggatgaaactgcataggtcatccggtctatgccctggatacaagagtttgagagctgccagagttatgtgcaagtcaaaggggcctgcatcaatactgtcaataatcacagcaatattggttctgacctttgtcacaccaataaattcaatggttgtaggagaaagtaaagaggtattcgaactggaggagctcccagatgatatgctagagatggcattaaaaataaacttctactattttgtctgcgttatgaattatgctgtgacttggggcctcatagttgttgctctgttaattgggttgattttcaaaaagtaccagcacagatttttgaatctttatgcaatgtattgtgaggaatgtgatatgtatcatgatagaacaggcttgaagaggaatggagactttacgaacaagtgcaggcaatgtacatgtgggcagtacgaagatgctactgggctaatgacacaccggaaaacatacaattgccttgtgcagtataaatccaaatggatcttgaatttcctaataacttacatggttttaactttgatcaaggattcagctatagttgtgcaggctacaggaacagattttagctcttgtctggaaacacaaagtgtaaattggaattgtacaggaccatttctaaaccttgggaattgccaaaaacagcaaaaaaaggagtcttatgcaaatattgcaacgcaactcaaaggcctgcaagcaatctcagttcttgacatgcccatgatagcaagcataccagaagatatagcaggggcactaagatatatagaagagagggagacctttcatgtccaattaactgcagaatatgctatgttgactaggtattgtgattactacactcaatttgcagacaactcaggctacagtcaaaccacatggagggtttatctgcgatcacatgactttgatgcttgtatactttacccaaatcaacacttttgccgatgtgtcaagcatggagataagtgcagtagttctaactgggactttgcaaatgagatgaagaattactattcaggaaagcagaataaatttgataaagatttgaacctagccttaatgacaatgcatcatgcattcaggggaacatcatctgcatatattgcagcattgttgtcaaagaggtcaaatgatgatctagttgcatatacaaataagataaaagagaaatttcctggaaatgctctattgaaagccgtgatggattatatatcatatatgaagagcttgtctgaaatgtcaaactttaaatatgatgagttctgggatgatcttcttcacaagcccaatcccacaaaagctccttccctctcaagaggtgacgagccagcatacaatttcaaattggcaatttcttcaaggtctatgaaaagctgcaaaaatgtcaaaagtgtagtatgtttatcgcctagatctggagtgtcgtatgattcaatattagcatgtggcgagccaaatgctccaagcgtacacagaaagccatctgacggtgtatttcaatccaattcagataaaacgatgtattgtctagccgacagccattgcttagaagactttgaagtggttagccaagaagaattagatgcaataaagaaatctgagtgttgggtaacggaatatccaaatgtaaaattatctaaactaagtgatgggatcaagagctgcagaatgaaagattcaggaaaatgcaatgttgcaacaaacagatggccaataatacaatgcgaaaacgataaattctactattctgaattgcagaatgattatgataagacacaggacattgggcacttttgtcttagtccaggatgttctacaatccggttcccaatcaatcagaagcatatatccaattgcaactggcaggttagccgttctagtatagcaaaaattgatgtgcataatattgaagacatagagcagtatagaaaggctataactcagaaacttcaaactagtctttccctgttcaaatatgccaggacaaaaaatctgccacatataaagccaatttacaaatatataactattgaaggaactgaaaccgctgaaggtatagagagtgcatatatagaatctgaaatacctgcattagctggaacctcaattggttttaaaatcaactctaaagaagggaaacatctactagatgttattggttatgtcaaaagtgcttcatattcatctgtatatactaagctctattcaacaggtccgacatcaggcataaatacaaagcatgacgaactgtgtactggaccatgccccgcaaacataaaacaccagactggatggttgacttttgcaagagaaagaacaagctcatggggttgtgaagaatttggctgtcttgctatcagtgatggatgtgttttcggctcatgccaggatatagtgagggatgagttatcagtgtataggaaggaaacagaagaagtgactgatgtcgagctgtgcctaactttttcagataagacttattgcacaaacctgaaccccataacaccaatcataacagatttattcgaagtacaattcaaaactgtggaaacctatagcttaccaaggatagtagcaatccaaaatcatgaaataaaaatagggcagataaatgatttaggagtttactcaaagggatgtggtaatgtccaaaaggtgaatgggacagtttatggtaatggggttccaaaatttgactacttgtgccatctagctagcaggaaagaggttattgtgaggaagtgttttgacaatgattatcaagcatgtaaattcttgcaaacaccggcaagttacaggttagaagagaacagtggcacagtaactgtgattgattataagaagatactggggacaatcaagatgaaagccattctgggagatgttaaatataagacatttgcagataatgtagatataactgctgaggggtcatgcactggatgcataaattgttttgaaaatatccattgcgagctaacaatacatactacaatagatgcaagctgccctgtcacaagcccatgcacagtgttccatgatagaatactagtgactccaaatgagcataagtatgcaatgaaagttatatgcactgaaaagccaggtagcacattagcaatcaagatctgcaatacaaaaattgatgcttcactggctcttattgatgccaagccgatattagaactagcaccagtcgatcagacagcctacatcagggagaaggatgagaggtgcaaaacctggatgtgcagggtgagagatgaaggcttgcaggttattttagagccttttaagaacttatttggctcttatataggaatattttataccttcgttatctctataattgcattattaattgttatctacattattttgcctatctgcttcaagctaagagatactcttaggaagcacgaggatgcttataagagagaaatgaaaattagataa

SEQ ID NO: 4204 - RNA, 4326 nt, synthetic construct
  misc_feature 1..4326: note = derived and/or modified CDS sequence (wt) from CHATV(LEIV-18733)__HQ734821.1__GP
  source 1..4326: mol_type = other RNA
atgattttcatattagtactgcttgcagtcagtactgcgagtccagtgtatcagcggtgcttccaggatggggctatagtgaagcagaacccatctaaagaggctgttacagaggtgtgccttaaagatgatgttagcatgataaagacagaagcaaggtatatgaagaatgccacaggaactttttccaacaacgtagccatcaggaaatggctggtctcagactggcatgactgcagacctaagaaagtctcgggcgggcatattaatgtcatagaggttggtgatgatctctcactccatactgagtcttatgtctgcagtgctgattgcacaattggagtggataaagagactgcacaggttagactccaaactgacacaacgaaccattttgaaatagcaggcacaaccgtaaaatcagggtggtttaagagcacaacatacataactctagaccaaacatgtgagcatctgaaagtctcatgcggacccaaatcagttcaattccatgcatgcttcaaccaacacatgtcctgtgtcagatttttgcacagaacagtcttgcctggatccattgctaattcaatatgccaaaatatagaaataataattttagtgactctcacgctattgatttttgtactcttaagtatactaagtaagacttacatctgctacttgctgatgcctatctttatccctatagcatatgtatatggtatcatttacaataagtcttgcaaaaaatgtaagctatgtgggttagtttatcacccattcacggaatgcgggacacattgtgtatgcggtgctcgctatgacacctctgataggatgaaactgcacaggtcttctggtttgtgccctggctacaagagtttaagagctgcaagggtcatgtgtaagtcaaagggtcctgcgtcaatactgtcaataattacggcaatattggttctaacctttgtgacaccaataaattcaatggttataggagaaagcaaggaagttttcgaactagaagaactcccagatgacatgctagaaatggctttgaaaataaatttttactattttgtttgcgtcataaactatgctgtgacttggggtctcatagttgttgctttgctaattgggctggtatttaaaaagtaccagcatagatttttaaacctttatgcgatgtattgtgaagagtgcgacatgtatcacgatagaactggattgaaaaggaatggagactttacaaataaatgtagacagtgcacatgtggacagtatgaagatgccactggtctaataacgcacaggaagacatataactgccttgtgaaatataagtctaaatggatattaaatttcctaataacttatatggtcttaactttgattaaggattcagctatagttgtgcaggctgctggaacagatttcagtgcttgtttagaagcacagagtgtggattggaattgcacaggaccatttttgaaccttggtaattgtcaaaaacagcagaagaaggagtcttatgcaaacatcgcaacacaactcaaaggcctacaggcgatctcagtactcgacatgcccatgatagcgagtataccagaagatatagcaggggcattaagatatatagaagaaaaagaaactttccatgttcaactaactgcagaatatgctatgttaaccagatattgcgattattatactcaatttgcagacaactcgggctacagtcagactacatggagagtttatctgagatcacatgactttgatgcttgtatactttatccaaatcaacacttttgccgatgcgttaagcatggagacaaatgcagtagttctaactgggattttgctaatgagatgaaaaactactactcagggaaacaaagtaaatttgataaggatttaaatttggccctgatgacagtacatcatgcattcagagggacctcatctgcatacattgcaacaatgctatctaaaaaatcaaataatgacctagttgcatatacaaataagataaaagagaaattccctggaaatgctttgttgaaggctgtcatggattacatatcgtacatgaagagtctatccgaaatgacaaatttcaaatacgatgagttctgggacgatctcttgtacaggccgaatcctacaaaagctccttccctctcaagagaaagcgaaacatcgtacaactttaaactggtcatttctcctaaatccatgaaaagctgcaaaaatgttaaaagtgtagtatgcttatcacccagatctggagcatcatatgattcaatattagcatgtggcgagccaaatgggccaagcgtgtatagaaaaccatctggcggtgtattccaatccaattcagataaaacaatgtattgcctagctgatagccattgcttggaggattttgaggtaattggtcaagaagagttggatgcaataaagaaatccgtgtgttgggcagtagaatatccagatgtgacattgtctaagttgagcgatggggttaagagttgcagaatgaaggattcaggaaagtgcaatgttgcagctaacagatggccgataatacaatgtgaaaatgacaaattctattattcagagctgcaaaatgattatgataaaacacaggacatcggccatttctgtcttagtcctgggtgctcaacagtaagattcccaatcaatcagaagcatatatctaattgcaattggcaggttagccggtctagcatagcaaagattgatgtgcatgatattgaagatatcgatcagtacagaaaggctataactcagaagctccaaacaagtctctctctattcaaatatgctaagacaaaaaatctaccgcatattaaaccaatttacaagtatataactattgaaggcactgaaactgctgaaggtatagaaagcgcatatattgaatctgaaatacctgcattagctggaacgtcagttgggttcaaaatcaattccaaggagggtaagcacttactggacatcattggttatgttaaaagtgcatcatactcttctgtatatactaagctctactcaacaggtccgacatcgggcataaatacaaaacatgatgaattatgcaccggaccatgccctgcaaatatcaaccaccaaaatgggtggttgacctttgcaaaggagagaacaagctcttggggttgtgaggaatttggttgccttgccatcagtgatggatgtgtctttgggtcatgccaagatatagtgagggatgagttgtcagtatataggaaggaaacagaagaggttaccgatgtagaactgtgtttaacattctcagacaagacttattgcaccaacttaaaccccataacgcctattataacagacctattcgaggtgcagttcaaaactgtagaaacctacagtctaccaagaatagtagcaattcaaaaccacgagataaagattgggcaaataaatgatttgggagtctactcaaaaggatgcggcaatgtccagaaagtgaatgggacagtttatggtaatggagttccaaaatttgattatttatgccatttggctagcaggaaagaggttattgtgaggaagtgcttcgataatgattatcaggcttgcaaattcttacaaacgccagctagttacagacttgaagaaaatagtggtacaataacagtgattgactacaaaaagatactaggaacaatcaagatgaaagccatcctaggggatgttaagtataagacatttgcagacaatgtagacataactgttgaagggtcatgcgccgggtgcataaattgctttgagaatattcattgtgaattaacaatacatacgacaatagaagcaagttgccctgtcacaagcccatgcacagtatttcacgataggatactaataactccgaatgagcataagtatgcgatgaaagttgtctgcacagaaaagccaggcaatacactaactctcaaggtttgcaatactaaagtagatgcatcactagctcttattgatgccaaaccaatattagaattagcgccagttgatcagacagcctacatcagggaaaaagatgaaaggtgtaaaacatggatgtgcagagtaagagatgaaggcttgcaggttatactagagcctttcaaaaatttgtttggttcttatatagggatattttatactattatcatctctataattgtgctattaattgttatctacattatcttgcctgtttgtttcaagttaagggatactctaaggcagcatgaggacgcctacaagagagagatgaaagttagatag

SEQ ID NO: 4205 - RNA, 4326 nt, synthetic construct
  misc_feature 1..4326: note = derived and/or modified CDS sequence (wt) from CHATV(LEIV-22712)__HQ734822.1__GP
  source 1..4326: mol_type = other RNA
atgattttcatattaatactgttcgcagtcagtgctgcaagtccagtatatcagcgatgtttccaggatggggctatagtgaagcaaaacccatccaaggaagctgtcacagaggtgtgcctcaaggatgatgtaagcatgataaaaacagaagctaggtatacaaaaaatgccacagggactttctctaacaatgtagcaatcaggaaatggttggtctcagattggcatgattgcagacctaagaaagtttcaggcggacacatcaatgtaatagaagtcggtgatgatctttcactccacactgagtcttatgtctgtagtgctgactgcactattggagtggataaggaaactgcacagattagacttcaaactgacacaacaaatcacttcgagatagcaggcacgacagttaaatcaggatggtttaagagcacgacgtacataaccctagatcaaacatgtgagcacttaaaagtctcttgcggacccaagtcagtacagttccatgcatgcttcaatcaacatatgtcttgtgtcagattcttgcatagaacagttctgcccgggtccattgcgaattcaatatgccagaatatagaaataataattctagtaactcttacattgctaatctttgtactcttaagtatattaagtaagacgtatatctgttacttgctgatgcctatttttatccctatagcatatgtatacggtattatttacaataaatcttgtaaaaaatgtaagctatgtgggctagtttaccatccattcacagaatgtggaacacattgtgtgtgtggcgcccgctacgatacttctgacaggatgaagttacacagatcttctggcctgtgccctgggtacaaaagtttaagagctgccagagttatgtgtaagtcaaaagggcctgcatcagtactgtcaataatcacagcaatattagttctaacttttgtcacaccaataaattcaatggttgtaggagaaagtaaagaggtatttgaactagaagagctcccagatgatatgctagaaatggcattgaagataaacttctactacttcatttgcgtcatgaattatgctgtgacttggggcctcatagttgttggtttgctgattggattggtattcaaaaagtaccagcacagattcttaaacctttatgctatgtactgtgaagaatgtgacatgtatcacgatagaactggcttaaagaggaatggagattttacaaataaatgcaggcagtgtacgtgcggacagtatgaagatgccactgggcttataacacacaggaaaacatacaattgccttgtacagtataaatccaaatggatcttgaatttcttaatagcttatatgactttgactttgattaaagattcagctataattgtacaggctactggtacagattttatctcttgtctagaaacgcaaagtgtaaattggaattgcacaggaccatttttgaaccttgggaattgtcaaaaacagcaaaaaaaggagccatatgcaaatattgcgacacagctcaaaggcttacaagcaatctcagttcttgacatacccatgatagcaaacataccggaagatatagcaggggcgctaagatatatagaggagaaggaaacttttcatgtccaattgactgcagaatatgctatgctgaccagatattgtgattattatactcaatttgcagacaactcaggctacagtcaaactacatggagggtttatttgagatcacatgattttgatgcttgcatattgtacccgaaccagcatttttgccgatgtgtcaagcatggagataagtgcagtagctccaactgggattttgcaaatgagatgaagaattattactctgggaaacagagtaaatttgacaaagatttgaacttggcattgatgacaatgcaccatgcattcagagggacatcatctgcatatattgcaacattgctgtcaaagaagttaaacgacgacctagctgcatatacaaacaagataaaggagaaattccctggaaatgccctattgaaggccatgatggactatatatcatatatgaagagcttatctgaaatggcaaatttcaaatatgatgagttctgggatgatcttttgcacaaacctgatcctacaaaagcacccctcctctcaagaggcagtgagccagtgtataacttcaaattagtcgtctcttcaaggtctgtgaaaagctgtaagaatgtcaagagtgtagtgtgtttgtcgcctaggtctggggtatcatatgattcagtcttggcatgtggcgaaccaaatggtccgagtgtgtacaggaagccatctgatggcgtgttccaatccaactcagataaaacaatatattgcttggccgacagccattgcttagaagattttgaagtaattagtcaagaagagttagatgcaataaaaaagtccgagtgttgggtaattgaatacccgaatgtgaaattaaccaaaccaagcgatgggatcaaaagctgcagaatgaaagattcagggaaatgcaatgttgcaactaacagatggccgataatacaatgcgaaaacaacaatttttactactctgagctacaaaacgattatgacaaaacacaagacattggacacttttgtcttagcccagggtgctctacaatccggtacccaatcaatcagaagcatatatccaattgcaactggcaggttagccattctagcatagccaaaattgatgtgcataatattgaagacatcgagcagtatagaaaagctataactcagaagctccaaactagcctctccctattcaagtatgctaagactaagaatctaccgcatataaaaccaatttacaaatatataactatcgaaggaactgaaactgccgaaggcatagaaagtgcatatatagaatctgaaatacctgcattggctgggacctcaattggcttcaaaatcaattctaaggaagggaagcatctactagatgttattggttatgttaagagtgcatcatattcatctgtatacagcaagctctattcaacaggtccaacatcaggtataaacacaaagcatgatgaactgtgtactgggccatgccccgaaaatataaaacaccaaactggatggttaacctttgcaagagaaagaacaagctcatggggttgtgaagaatttggctgtctcgctatcagtgatgggtgtgtcttcgggtcatgtcaagatatagtgaaagatgagttatcagtgtataggaaggaaacagaagaggtgaccgatgttgagttgtgcctaactttctcagataaaacttattgcacaaatctaaacccaataacgccaatcataacaaacttattcgaagtacaatttaaaactgtggaaacctacagtctaccaagaattgtagctatccaaaatcacgaaataaagattgggcagataaatgatttaggggtttactcgaaagggtgcggcaatgttcagaaagtgaatgggacagtttatggcaatggggtaccaaaattcgattatttatgccatctagctagcaggaaagaagttattgtaaggaaatgttttgataatgattatcaagcatgtaagttcttacaaacaccggcaagttacagattggaagaaaatagtggtgcaataactgtgattgactacaaaaagatactgggaacaattaaaatgaaagccattctaggagatgttaaatacaaaacatttgcagataatgtagacataactgctgaggggtcatgcactggatgcataaattgctttgaaaatattcattgcgaattgacaatacataccactatagaggcaagttgtcctgtaacgagcccatgcacagtgttccatgatagaatattagtaaccccaaacgaacacaaatatgcaatgaaagttgtctgcaccgaaaagccaggtagcacactagtaatcaaggtctgtaatactaaaattgatgcttcattggccctcattgatgctaagccaatactagaattggcgccggtcgaccagacagcttacatcagagaaaaagatgagagatgtaagacctggatgtgcagagtaagggatgaaggcttgcaggttattttggagccttttaagaatttgtttggctcttatatagggatattttataccttcattatttctataattgtattactaattgtcatctacattatcttgcctatttgcttcaagctgagggacactcttagaaagcatgaagatgcctacaagagagaaatgaaaattaggtag

SEQ ID NO: 4206 - RNA, 4332 nt, synthetic construct
  misc_feature 1..4332: note = derived and/or modified CDS sequence (wt) from INKV(KN3641)__U88059.1__GP
  source 1..4332: mol_type = other RNA
atggaagtcctaaacttaatctggttgctgacattatgctcggctagtccagtgtttcagcggtgtttccaagatggggctatagtgaagcaaaacccatcaaaggaggcagtgacagaagtttgcctaaaggatgacgtgagcatgataaaaacagaagcaaaatacatcaaaaatacaacaggaacatttgccaacaacatagccatgagaaaatggttagttgcagattggcatgattgcaggccccaaaaatcatcaggtggccatatcaatgttattgaagttggcgatgacttgtcacttcatacggaatcatatatttgcagtgctgactgtgtcataacggttgacaaagaaacagctcaaattcgtttacaaactgacaacacaaaccactttgaggttgctggtactacagttaaatcagggtggttcaagagtactacatatattacacttgatcaaacatgtgagcatctgaaagtgtcatgcggacctaaatcaatacagttccatgcttgctttaatcaacatatgtcatgtgtgcgatttctgcataggacaatacttccaggttcgatagcaaattctatatgtcagaatatagaaataattattctggtaactttgtctttagtgatttttatatttttaacaatagttagtaagacatatgtatgttacctattaatgcctatatttatcccaatagcatatatttacgggtggatatataacaaatcttgtaaaaaatgtagattgtgtgggttagtttaccacccatttaccgagtgtgggacacattgtgtttgtggtgcaagatatgaaacttctgataggatgaaattgcatagggcatctgggttgtgtccggggtataagaatctcagagcagccagagttatgtgcaaatcaaaagggccagcatcagttttatccattatgacagcagttctcatactaacgtttgtcactcctattagtgctatggtcattggtgaatcaagtgaagtgtacacactaggtgacttgcctgatgatatggtagaaatggcagaaagagtaaatatctactatcagatcattataattaattacagcataacatgggttttcttactacttggcttaattatagcatatttctttaggaaatatcaacatagatttttaagcttttatgcaatgtattgtaaagaatgtgacatgtatcatgaaagagctggtttgacctactggggtgactttacaaataaatgcaggcaatgcacatgtgggcaatttgaggatgttactgggttgatggtgcataagaaatcttacaattgcataattaaatacaaagcaaagtggataagagatatgctaatcacatatttacttatcatgctaatcaaagattcactattatttgtcggtgcgacaggaacagatttcgctgcatgtatagatgagaaaacagtcacatggaatcgtactggaccatttctaaatttaggcaggtgcgataaatcccagaagaagactggttatactgatatagctgatcagttgaaaggtttgggtgcgatatcagtgctagatattccaatgataaaaaagatgccagatgagatatctggatcactgaagtgtatagatgatttagagacacatcatgaacaattgactgctgaatatgccttccttactagatactgcgattattatacacagtacactgataattcaggttatagtcaaactgtgtggaggacttatttgcgatctcatgattttggtgcatgtgtcgtttatccaaatcaacatttctgcagatgtgtaaaacatggtgataagtgcaatagtgctaagtgggatttcgcaaatgaaatgaaaacattctatactggtcagaaagcaaaatttaacaaagatttaaatttggcattattggtattacacaaagcatttagaggaactggcacttcatatattgcagaaagtatggcccgaaaagataacaggtctatgacacattttgccttagagataaagaaaaaattcccaacaaatgcgctattgacagcattgatagattacatttcttatttacaatcacctgcagagatgtctacttttgaacttgatgaggattgggaagatttcaaatacaaacctgaaccaacagaatcgcctcaacttagatcacatagaactgatcagtataattttaaaaatgcagatagtaatagcaatgttaaagtctgcaaaaatattcaaaaagtgtcatgtatttcacctaggtctagagccaaatttgaaaatataatagcatgtggagaacatgcgaacccatcagtatatacgatgcccaatgtcagtatttaccaatctaattcagagaggagccactactgtatagctgactcacattgtttagaagaatatgaagtagtggaaacagaactcttaaatgcattgaaaaaatctaaatgttgggctagagaaatggatgatattgttctgcacaaacaagttgatggcttaaggagttgtagaatgaaagatactgggaactgtaacgttcaagaaaatgattggactattgttttatgtgagaatggcaattattattattcagaagctcacagagactatgataaagatcaagatgtaggtcacttttgtctcagccctcgatgtagtacaatacgctacccaataagtaaaaggcatattaaaaattgtgattggcagatctcacattcaacaattgacaagatctcagttcaggaattagcagatatagagcaatataagaaagccatatcacagaagttacagacaagtctatcgatctttaagtatgtgaaaacaaagaatcttccacatattaaaccagcatacaaatatataaccgtggaaggtgttgaaactgttgaagggatagaaaatgcttttatagaatctgaaattcctgcactagctggcacagccattggtttcaaaataaattcaagagagggcaactacctaatggatgtaataggttatgttaaaagtggatcatattcagcaacatacacaaaactatatataactggtccaactataggggtaaatactaagcatgatgaaaagtgcacaggaccctgcccagctataatagatcataaagaaggctggttaacttttgcaaaaggaagaactagcacatggggttgtgaagaatttggttgtttagcagttagtgatggctgtgtatttggatcttgtcaagatatcataaaagatgaattagctgtccataggaaaactactgaggagcccaccacagtagaattatgcttgacattttcagacaagacatattgcactaacttgaatgccataacccctataataacagataaatttgaagttcaattcaaaacagttgagtcttacacattaccaaggataatagctataaaaaatcacgaaattaaagttgggcaaatcaatgacctaggtgtgtactctaaaggatgtgggaatgttcaaaaaataaatgggacaaactatggcaatggattaccaaagtttgattatttatgccatttagcaggtagaaaagaagttatcataaggaaatgtttcgataacgattaccaagcttgcaaatttctacaaagtcctccaagctatcgtttagaggagcatcaaggcacagtaacagtaatagattataaaaaaattctaggcactataaagatggaggctatattaggagatgtgaaatataggaattaccagagtaatattgaaatcaatgctaaaggaacatgtgctggatgtataaattgttttgaaaatattcactgtgaatttactatacataccacagtagaagcaagttgccctatagtgacagactgggtttcattccatgacagaatactgatcacaccagacgaacataaatatgcattaaaagttgtatgtcaagaaaaacctaaactgtctctaaaatttaagatctgtaacacaaatattgatgcgtctatgactgttgtggattccaagccgatcctagagcttgcaccagttgatcaaactacatacattagagaaagagatgaaagatgcaaaacttggatgtgcagggttcgagatgaagggttccaggtaatattggaaccgtttaaaaacctttttggctcttacattggaatattttatacgggtatattatgtattgtatgtctccttattgttatttatattatactgcctatttgtttcaagttgagggacactctaaggcaacttgaggatgcatataagaaggaggtgaaaataagatga

SEQ ID NO: 4207 - RNA, 4332 nt, synthetic construct
  misc_feature 1..4332: note = derived and/or modified CDS sequence (wt) from INKV(SWAR83-161)__U88060.1__GP
  source 1..4332: mol_type = other RNA
atggaagtcctaaacttaatctggttgctgacattatgctcggctagtccagtgtttcagcggtgtttccaagatggggctatagtgaagcaaaacccatcaaaggaggcagtgacagaagtttgcctaaaagatgacgtgagcatgataaagacagaagcaaaatacatcaaaaatgcgacagggacatttgccaacaacatagcaatgagaaaatggttggttgcagattggcatgattgtaggccccaaaaatcatcaggtggtcatattaatgttattgaagttggcgatgacttgtcacttcatacagaatcatatatttgcagtgccgactgtgtcataacggtcgacaaggaaacagctcaaattcgcttgcaaactgacaacacaaatcactttgaagttgctggtactacagttaaatcagggtggttcaagagtactacatatattacacttgatcaaacatgcgagcatcttaaagtatcatgtggacctaaatcaatacaattccatgcttgctttaatcagcacatgtcatgtgtgcgattcctgcataggacaatacttccaggttcaatagcaaattctatatgtcagaacatagaaataattatcctggtgactctgtctttagcgatttttatatttttaacaatagttagtaagacatatgtatgttacttattaatgcctatatttattccaatagcatatatttacggatggatatataacaaatcttgtaaaaaatgtaagttatgtgggttagtttaccacccatttactgagtgtgggacacattgtgtttgtggtgcaaggtatgaaacgtctgataggatgaaattgcatagagcatctggattgtgtccaggatataagaacctcagagcagccagagttatgtgtaagtcaaaagggccagcatcagttttatccatcatgacagcaattcttatactaacatttgttactcctattagtgctatggtcattggtgaatcaagtgaagtgtacacactagatgaattgcctgatgatatggtacaaatggcagaaagagtaaatatatactaccagatcattattattaattacagcataacatgggctttcttattatttggcttagttctagcatatttctttaagaaatatcaacataggttcttgagcttttatgcaatgtattgtaaagaatgtgacatgtaccatgagagagcaggtttgacatattggggtgacttcacaaacaaatgcaggcaatgtacatgtgggcaatttgaggatgttactgggttaatggtgcataagaaatcttataattgtataattaaatacaaagcaaaatggataagagacatactaatcacatatctgattatcatgttaatcaaagattcactattgtttgttggtgcaacaggaaccgattttgctgcatgcatagatgagaaaacagtcacatggaattgtactggaccatttctaaacttaggcaagtgcgataaatcccaaaagaagattggttatgctgatattgctgatcagttgaaaggtctgggtgcaatatcagtgctagatattccaatgataaaaaggatgccggatgagatatctgggtcactgaagtatattgatggtttagagacataccatgaacaactgactgccgaatatgccttccttactagatactgtgattattatacacagtacactgataattcaggttacagtcaaactgtgtggaggacttatttgcgatctcatgattttggtgcatgtgtcgtttatccaaatcaacatttctgcagatgtgtaaaacatggtgataagtgtaatagtgctaagtgggactttgcaaatgaaatgaagacattttatactggtcaaaaagcaaaattcaacaaagatctaaacttggcattattagtattacacaaagcattcagaggaactggtacttcatatattgcagaaagtatggcccggaaagataacaggtctatgacacattttgccttagagataaagaaaaagtttccaacaaatgcactattgacagcattaatagattacatttcttatttacaatcacttgcagagatgtctacttttgaacttgatgaggattgggaagatttcaagtataaacccgaaccaacagaagcacctcaacttagatcacatagaactgatcagtataatttcaaaaatgcagatagtaatagcaatgttaaagtctgcaaaaacattcaaaaagtgtcatgcatttcacctagatccagggctaagtttgaaaatataatagcatgcggagaacatgcgaacccatcagtatatatgatgcccaatgttagtatttatcaatctaattcagagaggagtcactactgtatagctgactcacattgtttagaagagtatgaagtagtggagtcagaactcttaaatgcattgaaaaaatctaaatgttgggctaaagaaatggatgatattgttctgcataaacaatctgatggcttaaggagttgtagaatgaaagatactgggaattgtaatgttcaagaaaatgactggactattgttctgtgtgagaatggcaattattattattcagaagctcacagagactatgataaagatcaagatgttggccatttttgtctcagccctcggtgtagtacaatacgctacccaataaataaaagacatattagaaattgtgattggcagatctcccattcaacaattgacaagatctcagttcaagaattggctgatatagagcaatataaaaaggctatatcacaaaagttacaaacaagcctatcaatcttcaagtatgtgaagacaaaaaatcttccacatattaaaccagcatataaatacataactgtggaaggtattgaaactgttgaagggatagaaaatgcttttatagaatctgaaatccctgcactagctggaacagctattggttttaaaataaactcgagggagggcaactacctaatggatgtaataggctatgtcaaaagtgcatcatattcagcaacatacacaaagctatatacaactggtccaactataggagtaaatactaagcatgatgaaaagtgtacaggaccttgcccacctataatagatcataaagaaggctggttaacctttgcaaaagaaagaactagcacatggggttgtgaagaatttggttgtttagcagttagcgatggctgtgtatttggatcttgtcaagatatcataaaagatgagttagctgtctataggaaaactactgaagagctcactacagtagaattatgcctaacattctcagataaaacatattgcactaatctgaatgccataactcctataataacagataagtttgaagttcaattcaaaactgttgaatcgtacacattgccaagaataatagctattaaaaatcatgaaattaaggttgggcagatcaatgatctaggtgtgtactccaaaggatgtgggaatgttcaaaaaataaatgggacaaattatggcaatggagtgccgaaatttgattacttatgccatttggcaagtaggaaagaagttatcataagaaaatgttttgataatgattaccaagcttgcaaatttctgcaaagtcctccaagctatcgcttagaggagcatcaaggcacagtaacagtcatagattataaaaagatcctaggcattataaagatgaaagctatattaggagatgtaaaatacaaaaattatcagagcaatattgaaatcaatgctgaaggaacatgtgctggatgtataaattgttttgaaaacattcactgtgaatttactatacataccacagtagaagcaagttgccctatagtgacagactgtgtttcattccatgatagaatactgatcacaccagacgagcataaatatgcattaaaagttgtatgtcaggaaaagcctaaattgtctctaaaatttaagatctgtaacacaaatattgatgcgtctatgactatagtggattccaagccaatcctagagcttgcaccagttgaccaaactacatacattagagagaaagacgaaagatgcaaaacgtggatgtgcagggttcgagatgaaggattccaagtaatattggaaccctttaaaaacctttttggctcttacattgggatattttatacaggtatattatgtattatatgcctccttattgttatttacatcatattgcctatttgtttcaagttgagggacactctaaggcaacatgaagatgcatacaagaaggagatgaaaataagataa

SEQ ID NO: 4208 - RNA, 4332 nt, synthetic construct
  misc_feature 1..4332: note = derived and/or modified CDS sequence (wt) from INKV(Lovanger)__KU681435.1__GP
  source 1..4332: mol_type = other RNA
atggaagtcctaaacttaatctggttgctgacattatgctcagctagtccagtgtttcagcggtgtttccaagatggggctatagtgaagcaaaacccatcaaaggaggcagtgacagaagtttgcctaaaagatgacgtgagcatgataaagacagaagcaaaatacatcaaaaatgcgacagggacatttgccaacaacatagcaatgagaaaatggttggttgcagattggcatgattgtaggccccaaaaatcatcaggtggtcatattaatgttattgaagttggcgatgacttgtcacttcatacagaatcatatatttgcagtgctgactgtgtcataacggtcgacaaggaaacagctcaaattcgcttgcaaactgacaacacaaatcactttgaagttgctggtactacagttaaatcagggtggttcaagagtactacatatataacacttgatcaaacatgcgagcatcttaaagtatcatgtggacctaaatcaatacaattccatgcttgctttaatcagcacatgtcatgtgtgcgattcctgcataggacaatacttccaggttcaatagcaaattctatatgtcagaacatagaaataattatcctggtgactctgtctttagcgatttttatatttttaacaatagttagtaagacatatgtatgttacttattaatgcctatatttattccaatagcatatatttacggatggatatataacaaatcttgtaaaaaatgtaagttatgtgggttagtttaccacccatttactgagtgtgggacacattgtgtttgtggtgcaaggtatgaaacgtctgataggatgaaattgcatagagcatctggattgtgtccagggtataagagcctcagagcagccagagttatgtgtaagtcaagggggccagcatcagttttatccatcatgacagcaattcttatactaacatttgttactcctattagtgctatggtcattggtgaatcaagtgaagtgtacacactagatgaattgcctgatgatatggtacaaatggcagaaagagtaaatatatactaccagatcattattattaattacagcataacatgggctttcttattatttggcttagttctagcatatttctttaagaaatatcaacataggttcttgagcttttatgcaatgtattgtaaagaatgtgacatgtaccatgagagagcaggtttgacatattggggtgacttcacaaacaaatgcaggcaatgtacatgtgggcaatttgaggatgttactgggttaatggtgcataagaaatcttataattgtataattaaatacaaagcaaaatggataagagacatactaatcacatatctgattatcatgttaatcaaagattcactattgtttgttggtgcaacagggaccgattttgctgcatgcatagatgagaagacagtcacatggaattgtactggaccatttctaaacttaggcaggtgcgataaatcccaaaagaagattggttatgctgatattgctgatcagttgaaaggtctgggtgcaatatcagtgctagacattccaatgataaaaaggatgccggatgagatatctgggtcactgaagtatattgatggtttagagacataccatgaacaactgactgccgaatatgccttccttactagatactgtgattattatacacagtacactgacaattcaggttacagtcaaactgtgtggaggacttatttgcgatctcatgattttggtgcatgtgtcgtttatccaaatcaacatttctgcagatgtgtaaaacatggtgataagtgtaatagtgctaagtgggattttgcaaatgaaatgaagacattttatactggtcaaaaagcaaaattcaacaaagatctaaacttggcattattagtattacacaaagcattcagaggaactggtacttcatatattgcagaaagtatggcccggaaagataacaggtctatgacacattttgccttagagataaagaaaaagtttccaacaaatgcactattgacagcattaatagattacatttcttatttacaatcacttgcagagatgtctacttttgaacttgatgaggattgggaagatttcaagtacaaacctgaaccaacagaagcacctcaacttagatcacatagaactgatcagtataatttcaaaaatgcagatagtaatagcaatgttaaagtctgcaaaaacattcaaaaagtgtcatgcatttcacctagatccagggctaagtttgaaaatataatagcatgcggagaacatgcgaacccatcagtatatatgatgcccaatgtcagtatttatcaatctaattcagagaggagtcactactgtatagctgactcacattgtttagaagagtatgaagtagtagagtcagaactcttaaatgcattgaaaaaatctaaatgttgggctaaagaaatggatgatattgttctgcataaacaagctgatggcttaaggagttgtagaatgaaagatactgggaattgtaatgttcaagaaaatgactggactattgttctgtgtgagaatggcaattattattattcagaagctcacagagactatgataaagatcaagatgttggccatttttgtctcagccctcggtgtagtacaatacgctacccaataaataaaagacacattagaaattgtgattggcagatctcacattcaacaattgacaaaatctcagttcaagaattggctgatatagagcaatacaaaaaggctatatcacaaaagttacaaacaagcctatcaatcttcaagtatgtgaagacaaaaaatcttccacatattaaaccagcatataaatacataactgtggaaggtgttgaaactgttgaagggatagaaaatgcttttatagaatctgaaatccctgcactagctggaacagctattggttttaaaataaactcgagggagggcaactacctaatggatgtaataggctatgtcaaaagtgcatcatattcagcaacatacacaaagctatatacaactggtccaactataggagtaaatactaagcatgatgaaaagtgtacaggaccttgcccacctataatagatcataaagaaggctggttaacctttgcaaaagaaagaactagcacatggggttgtgaagaatttggttgtttagcagttagtgatggctgtgtatttggatcttgtcaagatatcataaaagatgagttagttgtctataggaaaactactgaagagctcactacagtagaattatgcctaacattctcagataaaacatattgcactaatctgaatgccataactcctataataacagataagtttgaagttcaattcaaaactgttgaatcgtacacattgccaagaataatagctattaaaaatcatgaaattaaggttgggcagatcaatgatctaggtgtgtactccaaaggatgtgggaatgttcaaaaaataaatgggacaaattatggcaatggatggccgaaatttgattacttatgccatttggcaagtaggaaagaagttatcataagaaaatgttttgataatgattacaaagcttgcaaatttctgcaaagtcctccaagctatcgcttagaggagcatcaaggcacagtaacagtcatagattataaaaagattctaggcactataaagatgaaagctatattaggagatgtaaaatacaaaaattatcagagcaatattgaaatcaatgctgaaggaacatgtgctggatgtataaattgttttgaaaacattcactgtgaatttactatacataccacagtagaagcaagttgccctatagtgacagactgtgtttcattccatgatagaatactgatcacaccagacgagcataaatatgcattaaaagttgtatgtcaggaaaagcctaaattgtctctaaaatttaagatctgtaacacaaatattgatgcgtctatgactatagtggattccaagccaatcctagagcttgcaccagttgaccaaactacatacattagagagaaagacgaaagatgcaaaacgtggatgtgcagggttcgagatgaaggattccaagtaatattggaaccttttaaaaacctttttggctcttacattgggatattttatacaggtatattatgtattatatgcctccttattattatttacatcatattgcctatttgtttcaagttgagggacactctaaggcaacatgaagatgcatacaagaaggagatgaaaataagataa

SEQ ID NO: 4209 - RNA, 4332 nt, synthetic construct
  misc_feature 1..4332: note = derived and/or modified CDS sequence (wt) from INKV(Lovanger)__KX554936.1__GP
  source 1..4332: mol_type = other RNA
atggaagtcctaaacttaatctggttgctgacattatgctcggctagtccagtgtttcagcggtgtttccaagatggggctatagtgaagcaaaacccatcaaaggaggcagtgacagaagtttgcctaaaagatgatgtgagcatgataaagacagaagcaaaatacatcaaaaatgcgacagggacatttgccaacaacatagcaatgagaaaatggttggttgcagattggcatgattgtaggccccaaaaatcatcaggtggtcatattaatgttattgaagttggcgatgacttgtcacttcatacagaatcatatatttgcagtgctgactgtgtcataacggtcgacaaggagacagctcaaattcgcttgcaaactgacaacacaaatcactttgaagttgctggtactacagttaaatcagggtggttcaagagtactacatatattacacttgatcaaacatgcgagcatcttaaagtatcatgtggacctaaatcaatacaattccatgcttgctttaatcagcacatgtcatgtgtgcgattcctgcataggacaatacttccaggttcaatagcaaattctatatgtcagaacatagaaataattatcctggtgactctgtctttagcgatttttatatttttaacaatagttagtaagacatatgtatgttacttattaatgcctatatttattccaatagcatatatttatggatggatatataacaaatcttgtaaaaaatgtaagttatgtgggttagtttaccacccatttactgagtgtgggacacattgtgtttgtggtgcaaggtatgaaacgtctgataggatgaaattgcatagagcatctggattgtgtccagggtataagagcctcagagcagccagagttatgtgtaagtcaagggggccagcatcagttttatccatcatgacagcaattcttatactaacatttgttactcctattagtgctatggtcattggtgaatcaagtgaagtgtacacactagatgaattgcctgatgatatggtacaaatggcagaaagagtaaatatatactaccagatcattattattaattacggcataacatgggctttcttattatttggcttagttctagcatatttctttaagaaatatcaacataggttcttgagcttttatgcaatgtattgtaaagaatgtgacatgtaccatgagagagcaggtttgacatattggggtgacttcacaaacaaatgcaggcaatgtacatgtgggcaatttgaggatgttactgggttaatggtgcataagaaatcttataattgtataattaaatacaaagcaaagtggataagagacatactaatcacatatctaattatcatgttaatcaaagattcactattgtttgttggtgcaacagggaccgattttgctgcatgcatagatgagaaaacagtcacatggaattgtactggaccatttctaaacttaggcaggtgcgataaatcccaaaagaagattggttatgctgatattgctgatcagttgaaaggtctgggtgcaatatcagtgctagatattccaatgataaaaaggataccggatgagatatctgggtcactgaagtatattgatggtttagagacataccatgaacaactgactgccgaatatgccttccttactagatactgtgattattatacacagtacactgacaattcaggttacagtcaaactgtgtggaggacttatttgcgatctcatgattttggtgcatgtgtcgtttatccaaatcaacatttctgcagatgtgtaaaacatggtgataagtgtaatagtgctaagtgggattttgcaaatgaaatgaagacattttatactggtcaaaaagccaaattcaacaaagatctaaacttggcattattagtattacacaaagcattcagaggaactggtacttcatatattgcagaaagtatggcccggaaagataacaggtctatgacacattttgccttagagataaagaaaaagtttccaacaaatgcactattgacagcattaatagattacatttcttatttacaatcacttgcagagatgtctacttttgaacttgatgaggattgggaagatttcaagtacaaacctgaaccaacagaagcacctcaacttagatcacatagaactgatcagtataatttaaaaaatgcagatagtaatagcaatgttaaagtctgcaaaaacattcaaaaagtgtcatgcatttcacctagatccagggctaagtttgaaaatataatagcatgcggagaacatgcgaacccatcagtatatatgatgcccaatgtcagtatttatcaatctaattcagagaggagtcactactgtatagctgactcacattgtttagaagagtatgaagtagtggagtcagaactcttaaatgcattgaaaaaatctaaatgctgggctaaagaaatggatgatattgttctgcataaacaagctgatggcttaaggagttgtagaatgaaagatactgggaattgtaatgttcaagaaaatgactggactattgttctgtgtgagaatggcaattattattattcagaagctcacagagactatgataaagatcaagatgttggccatttttgtctcagccctcggtgtagtacaatacgctacccaataaataaaagacatattagaaattgtgattggcagatctcacattcaacaattgacaaaatctcagttcaagaattggctgatatagagcaatacaaaaaggctatatcacaaaagttacaaacaagcctatcaatcttcaagtatgtgaagacaaaaaatcttccacatattaaaccagcatataaatacataactgtggaaggtgttgaaactgttgaagggatagaaaatgctttcatagaatctgaaatccctgcactagctggaacagctattggttttaaaataaactcgagggagggcaactacctaatggatgtaataggctatgtcaaaagtgcatcatattcagcaacatacacaaagctatatacaactggtccaactataggagtaaatactaagcatgatgaaaagtgtacaggaccttgcccacctataatagatcataaagaaggctggttaacctttgcaaaagaaagaactagcacatggggttgtgaagaatttggttgtttagcagttagtgatggctgtgtatttggatcttgtcaagatatcataaaagatgagttagctgtctataggaaaactactgaagagctcactacagtagaattatgcctaacattctcagataaaacatattgcactaatctgaatgctataactcctataataacagataagtttgaagttcaattcaaaactgttgaatcgtacacattgccaagaataatagctattaaaaatcatgaaattaaagttgggcagatcaatgatctaggtgtgtactccaaaggatgtgggaatgttcaaaaaataaatgggacaaattatggcaatggattgccgaaatttgattacttatgccatttggcaagtaggaaagaagttatcataagaaaatgttttgataatgattaccaagcttgcaaatttctgcaaagtcctccaagctatcgcttagaggagcatcaaggcacagtaacagtcatagattataaaaagattctaggcactataaagatgaaagctatattaggagatgtaaaatacaaaaattatcagagcaatattgaaatcaatgctgaaggaacatgtgctggatgtataaattgttttgaaaatattcactgtgaatttactatacataccacagtagaagcaagttgccctatagtgacagactgtgtttcattccatgatagaatactgatcacaccagacgagcataaatatgcattaaaagttgtatgtcaggaaaagcctaaattgtctctaaaatttaagatctgtaacacaaatattgatgcgtctatgactatagtggattccaagccaatcctagagcttgcaccagttgaccaaactacatacattagagagaaagacgaaagatgcaaaacgtggatgtgcagggttcgagatgaaggattccaagtaatattggaaccctttaaaaacctttttggctcttacattgggatattttatacaggtatattatgtattatatgcctccttattgttatttacatcatattgcctatttgtttcaagttgagggacactctaaggcaacatgaagatgcatacaagaaggagatgaaaataagataa

SEQ ID NO: 4210 - RNA, 4335 nt, synthetic construct
  misc_feature 1..4335: note = derived and/or modified CDS sequence (wt) from JSV__AF123487.1__GP
  source 1..4335: mol_type = other RNA
atggaagtcctaaacttaatctggttactagcattgtgttcagctagtccagtatttcaacgatgttttcaagatggagctatagtgaagcaaaacccatctaaggaagcagtgacagaggtgtgcttaaaggatgacgtgagcatgataaaaacagaagcaaaatatgtaaaaaacaccacagggacatttgctaataacatagctatgagaaaatggttggtcgcagattggcatgactgtaggccccaaaagtcatcaggtggtcatatcaacgttattgaagttggagatgatctgtcactccacacagagtcatatatttgcagtgcagattgtgttatcacagttgacaaagaaactgctcagatccgtttgcaaactgacaatacaaaccactttgaggttgctgggaccacagtaaaatcaggttggttcaaaagtacaacttatattacacttgatcaaacatgtgagcatcttaaagtatcatgcggaccaaaatcgatacagtttcatgcttgcttcaatcagcatatgtcttgtgtgcgattcttacatagaacaatactaccaggatcgattgctaattctatatgtcaaaatatagaaataattatcttggttactctctcattagtaatcttcatattcttatcaatagtaagtaagacatatgtatgttacttattaatgcctatcttcatcccaatagcttttatctatggatggatatacaataaatcctgcaagaaatgcaaattatgcggcttagtttatcacccattcacagagtgtggaacacactgtgtatgtggtgcaagatatgaaacttctgataggatgaaattgcatagagcatctggattgtgtccagggtacaagagtctcagagcagctagagttatgtgcaaatcaaaaggaccagcttctatcctatctataatgactgcaattctcatactaacatttgtcactcctattagtgccatggttataggtgaatcaagtgaggtgtacacactagatgatttacccgatgatatggtacaaatggcagagagggtgaatatctattatcaaataatcatcattaattatggtgtcacttgggctttcttattgcttggtttaattttggcatacttcttcaaaaaatatcaacataaatttctagacttttatgcaatgtattgtgaggaatgcgatatgtatcacgagaaatctggtttgacacactggggcgactttactaataaatgtagacagtgcacatgcggtcagtttgaagatgttgctggcttgatgatacatagaaaatcttacaattgtttggttaaatacaaagcaagatggataagggacatactcatcatgtatttggctatgattctgatcaaagattcactattattcgttggtgcatcagggacagactttgctgcatgtatagatgagaaagtcgttacatggaactgcactgggccattcctaaatttaggtagatgcgacaaatctcagaagaaaacaaactatgaaggtatagctaatcagttgaagggcttaggagttatatctgttttggatatcccgatgataaaaaatatgccagatgaaatatcaggttcactaaagtatatcgatagcctagagacataccatgagcaattaactgctgaatatgctttcctcaccaggtactgcgactattatacacaatacacggataactctggctatagtcgaacagtatggaggacttacttacgatctcacgattttggtgcatgtgtcgtttatccgaatcaccatttatgtagatgtgtaaagtatggggacaaatgcaatagtgccaagtgggattttgccaatgagatgaaaacattctacacaggccagaaagtgaagtttaataaggatttaaacttggcattattggtattacataaagcatttagaggcactggaactgcatatgtcgcggaagctatggctcggaaagataacggttctatggcacattttgctttggagataagaaaaaagttcccaacaaatgctttgttagcagcattaatagattatatagtttatttacagtcccttgcagaaatagccacatttgaactcgatgaagattgggaagattttaaatataagccagagccaacagaatcaacacctcaagctaggtcacacagaaatgatcagtataacttcaaaaatgctgaaagtaatagtaataccaaagtctgtaagaatgttcagaaagtactatgtatttcacccaggtcaaaagcaaaattcgaaaatattatagcatgtggagagcatgcaaatccatctgtatacatgatgccaaatgtcagtatctaccaatccaattcggaaaggagtcactattgtatagctgactctcattgccttgagaaatatgaagtggtggaaacagaacttttgaatgctttaaagaagtcaaaatgttgggccaaggaaatggatgatattgtcttacataagcagagtgatggcttgaggagttgtagaataaaagatactgggaactgcaatgttcaagaaaatgattggaccattgtcttatgtgaaaatggcaactattactactctgaggtccacaaagactatgataaagatcaggatgtaggtcatttctgtcttagtcctagatgcactacaatacgttatccaataagtagaaggcatataaggaagtgcgaatggcaaatatcacattcaacaattgataaaatctctgttcaagagttagcagacatagagcaatataagaaggccatatcacaaaaattgcaaacaagtctatcaattttcaagtatgtaagaacaaaaaacctcccacatatcaaacccgcatataagtacataactgtagaaggtgtcgaaactattgaaggaatcgaaaacgcctttatagagtctgagattccagcattggcaggtacagctataggtttcaaaataaattcaagagaaggcaactatttaatggatgtgataggatatgttaagagtgcatcatattcagcagtatacacaaaactatatacaactgggcctactataggaataaacaccaaacatgatgaaaaatgcacaggaccttgcccagctgtaatagatcataaggatggttggctaaccttctcaaaagagaggaccagcacttggggttgtgaagagttcggttgcttagcagtcagtgatggttgtgtatttggctcttgccaagatataataaaagatgagttggctgtttacaggaaaaccactgaagaactcactacagtagaactgtgcttgacattttcagataaaacatattgcaccaacttgaatgctataactcctattataacagataaatttgaagtgcagttcaaaactgttgaatcttatacactaccaagggtcattgccataaagaatcatgagattaaagttggacaaatcaatgacttaggtgtctactcaaaaggatgtggaaatgttcaaaaggtcaatggaacaaactatggcaatggttcaccaaggtttgattatctctgccacttggcgagtagaaaggaagtaatcctaaggaaatgttttgacaatgattatcaggcttgtaaattcttgcagagtccttcaagttatcgtttagaagagcaccaggggacagtgacagttatagattataaaaagattttaggcactataaagatgaaggctatattaggggatgtgatatacataaattatcaaaataatatagaaatcaatgctgagggaacatgtgctggatgtattgattgctttgaaaatatacactgtgaatttactatacatactacagttgaagcaagttgtcctataacaacagagtgtgtctcatttcatgatagaatattgatcacaccagatgaacataagtatgcattgaagattgtatgccatgataaaccaaaagtgtctcttaaatttaaaatctgtaacacaaatgttgatgcagctatgactattgtggattctaaaccaattttagaacttgcgccagtagatcaaacaacatatatcagagagaaagatgaaagatgcaagacttggatgtgtagagtccgagatgaagggttccaggtgatattagaaccttttaaaaacctctttggttcgtatattgggatattttatactggtatactgtctattatttgtttactcattgtcgtctatattatattgcccatttgtttcaaattaagggacactttaaggcagcatgaagatgcctatagaaaggaaatgaagataagatga

SEQ ID NO: 4211 - RNA, 4335 nt, synthetic construct
  misc_feature 1..4335: note = derived and/or modified CDS sequence (wt) from JSV(BFS 4474)__KX817319.1__GP
  source 1..4335: mol_type = other RNA
atggaagtcctaaacttaatctggttactagcattgtgttcagctagtccagtatttcaacgatgttttcaagatggagctatagtgaagcaaaacccatctaaggaagcagtgacagaggtgtgcttaaaggatgacgtgagcatgataaaaacagaagcaaaatatgtaaaaaacaccacagggacatttgctaataacatagctatgagaaaatggttggtcgcagattggcatgactgtaggccccaaaagtcatcaggtggtcatatcaacgttattgaagttggagatgatctgtcactccacacagagtcatatatttgcagtgcagattgtgttatcacagttgacaaagaaactgctcagatccgtttgcaaactgacaatacaaaccactttgaggttgctgggaccacagtaaaatcaggttggttcaaaagtacaacttatattacacttgatcaaacatgtgagcatcttaaagtatcatgcggaccaaaatcgatacagtttcatgcttgcttcaatcagcatatgtcttgtgtgcgattcttacatagaacaatactaccaggatcgattgctaattctatatgtcaaaatatagaaataattatcttggttactctctcattagtaatcttcatattcttatcaatagtaagtaagacatatgtatgttacttattaatgcctatcttcatcccaatagcttttatctatggatggatatacaataaatcctgcaagaaatgcaaattatgcggcttagtttatcacccattcacagagtgtggaacacactgtgtatgtggtgcaagatatgaaacttctgataggatgaaattgcatagagcatctggattgtgtccagggtacaagagtctcagagcagctagagttatgtgcaaatcaaaaggaccagcttctatcctatctataatgactgcaattctcatactaacatttgtcactcctattagtgccatggttataggtgaatcaagtgaggtgtacacactagatgatttacccgatgatatggtacaaatggcagagagggtgaatatctattatcaaataatcatcattaattatggtgtcacttgggctttcttattgcttggtttaattttggcatacttcttcaaaaaatatcaacataaatttctagacttttatgcaatgtattgtgaggaatgcgatatgtatcacgagaaatctggtttgacacactggggcgactttactaataaatgtagacagtgcacatgcggtcagtttgaagatgttgctggcttgatgatacatagaaaatcttacaattgtttggttaaatacaaagcaagatggataagggacatactcatcatgtatttggctatgattctgatcaaagattcactattattcgttggtgcatcagggacagactttgctgcatgtatagatgagaaagtcgttacatggaactgcactgggccattcctaaatttaggtagatgcgacaaatctcagaagaaaacaaactatgaaggtatagctaatcagttgaagggcttaggagttatatctgttttggatatcccgatgataaaaaatatgccagatgaaatatcaggttcactaaagtatatcgatagcctagagacataccatgagcaattaactgctgaatatgctttcctcaccaggtactgcgactattatacacaatacacggataactctggctatagtaaaacagtatggaggacttacttacgatctcacgattttggtgcatgtgtcgtttatccgaatcaacatttttgtagatgtgtaaagtatggggacaaatgcaatagtgccaagtgggattttgccaatgagatgaaaacattctacacaggccagaaagtgaagtttaataaggatttaaacttggcattattggtattacataaagcatttagaggcactggaactgcatatgtcgcggaagctatggctcggaaagataacggttctatggcacattttgctttggagataagaaaaaagttcccaacaaatgctttgttagcagcattaatagattatatagtttatttacagtcccttgcagaaatagccacatttgaactcgatgaagattgggaagattttaaatataagccagagccaacagaatcaacacctcaagctaggtcacacagaaatgatcagtataacttcaaaaatgctgaaagtaatagtaataccaaagtctgtaagaatgttcagaaagtactatgtatttcacccaggtcaaaagcaaaattcgaaaatattatagcatgtggagagcatgcaaatccatctgtatacatgatgccaaatgtcagtatctaccaatccaattcggaaaggagtcactattgtatagctgactctcattgccttgagaaatatgaagtggtggaaacagaacttttgaatgctttaaagaagtcaaaatgttgggccaaggaaatggatgatattgtcttacataagcagagtgatggcttgaggagttgtagaataaaagatactgggaactgcaatgttcaagaaaatgattggaccattgtcttatgtgaaaatggcaactattactactctgaggtccacaaagactatgataaagatcaggatgtaggtcatttctgtcttagtcctagatgcactacaatacgttatccaataagtagaaggcatataaggaagtgcgaatggcaaatatcacattcaacaattgataaaatctctgttcaagagttagcagacatagagcaatataagaaggccatatcacaaaaattgcaaacaagtctatcaattttcaagtatgtaagaacaaaaaacctcccacatatcaaacccgcatataagtacataactgtagaaggtgtcgaaactattgaaggaatcgaaaacgcctttatagagtctgagattccagcattggcaggtacagctataggtttcaaaataaattcaagagaaggcaactatttaatggatgtgataggatatgttaagagtgcatcatattcagcagtatacacaaaactatatacaactgggcctactataggaataaacaccaaacatgatgaaaaatgcacaggaccttgcccagctgtaatagatcataaggatggttggctaaccttctcaaaagagaggaccagcacttggggttgtgaagagttcggttgcttagcagtcagtgatggttgtgtatttggctcttgccaagatataataaaagatgagttggctgtttacaggaaaaccactgaagaactcactacagtagaactgtgcttgacattttcagataaaacatattgcaccaacttgaatgctataactcctattataacagataaatttgaagtgcagttcaaaactgttgaatcttatacactaccaagggtcattgccataaagaatcatgagattaaagttggacaaatcaatgacttaggtgtctactcaaaaggatgtggaaatgttcaaaaggtcaatggaacaaactatggcaatggttcaccaaggtttgattatctctgccacttggcgagtagaaaggaagtaatcctaaggaaatgttttgacaatgattatcaggcttgtaaattcttgcagagtccttcaagttatcgtttagaagagcaccaggggacagtgacagttatagattataaaaagattttaggcactataaagatgaaggctatattaggggatgtgaaatacaaaaattatcaaaataatatagaaatcaatgctgagggaacatgtgctggatgtattgattgctttgaaaatatacactgtgaatttactatacatactacagttgaagcaagttgtcctataacaacagagtgtgtctcatttcatgatagaatattgatcacaccagatgaacataagtatgcattgaagattgtatgccatgataaaccaaaagtgtctcttaaatttaaaatctgtaacacaaatgttgatgcagctatgactattgtggattctaaaccaattttagaacttgcgccagtagatcaaacaacatatatcagagagaaagatgaaagatgcaagacttggatgtgtagagtccgagatgaagggttccaggtgatattagaaccttttaaaaacctctttggttcgtatattgggatattttatactggtatactgtctattatttgtttactcattgtcgtctatattatattgcccatttgtttcaaattaagggacactttaaggcagcatgaagatgcctatagaaaggaaatgaagataagatga

SEQ ID NO: 4212 - RNA, 4323 nt, synthetic construct
  misc_feature 1..4323: note = derived and/or modified CDS sequence (wt) from LUMV__AF123484.1__GP
  source 1..4323: mol_type = other RNA
atgatacttgttttgtttttcgttgcactaagtgctgcagggccagtttatcagagatgtttccaagatggtgctattgtcaaacagagcccatccaaacaagctgtgacagaagtatgcttaaaggatgatgtcagcatgataaaaacagaggcaagatacttcaagaataccaccgggatttatgctaataacgttgcaattagaaagtggcttgttgcagactggcatgattgtagaccaaaaaaagtctcaggggggcatataaatgttatagaggtgggagatgacctaacactgcatacagaggcttatgtttgcaatgctgattgcataataggtgtagacaaagagactgcacaagtaagattgcaaactgatacaacaaatcactttgaaattgcaggaactacagtcaaatcagggtggtttaagagcactacttatataaccttaggtcaaacttgcgaacatttgaaagtctcctgtggacctaaatctatccaattccatgcatgtttcaatcagcatatgtcttgtgttagatttctacatagaacaatattgccaggatctattgctaattctgtatgccagaatatagaaataataattttaacagtactaaccttacttatctttacattactaagtatattaagcaaaacatatatatgctatatactcatgcctatattcatccccctcgcttatatatatggattaatatataataaatcctgcaaaaagtgtaagctatgtggcctagtataccatccctttacagagtgtggcactcattgtgtatgcggtgcaagatatgatacatctgataggatgaaactgcacagagcttcaggactatgcccagggtataagagtcttagagctgcaagagtcatgtgtaaatccaaaggcccagcttctgttttatccattataactgcggtattaatcctaacatttatcacccctataaatgctatgatagctggagagacgcaagagacttttaaactagaagatttgccagatgatatgttaagtatggcaatgaagataaacatgtactacattatgtgtatgttaaattatgttgccacatggtcattcattttctgtgccttaataatagccttaattttcaaaaaatatcaacataagtttctaagctattacgctatgtactgtcaagaatgtgacatgtatcatgacaggtcaggtctaaaatataacgggggtttcacaaataaatgtaggcaatgcacatgtggacaatatgaggatgctacaggcttgatggctcataggaaaacatataactgtttaattcaatataaatcaaaatggttagttaacttcttaattacatatataattctcatgctcatcaaagattctgtattgatagtgcatgctgagggcacagactttgaaaagtgtagcagcgatataaatattgtgtggaattgtacagggccatttcttagcttaggcaattgcgaaaagaagcagaaaaaggagtcatacaatgatatagcggcccagttaaaaggtctagatgcaatatctgtcttggacatccctatgatttcgaagatacctgaagatatagctggggcattgagattcatagaggaacagaattcgtaccatgttcagctgactgttgagtatgctatgttgactagatattgtgattattatacacaatttagtgacaactctggttatagtcagacaacatggagaacatacttgaggtcacatgattttgaggcatgtatattatatccaaatcagcatttttgtagatgtgtgaaacacggagacaaatgctcaagatccaactgggattttgctaatgagatgaagaattattatagtggtaagcagtcgaagtataataaagatctaaatttagcattaatgtcattccaccatgcatttagagggacatctagcttctatactgcaaaacttttaagagaaaagaaaactgaagaacttaaaaactacattgacaaaattagaactgagtaccctggtaatgcattattaaaggctgtaattgactacataaaatatatgatgggtttgactgaagtaagtaacttcaaacatgacgaaatgtgggatgactttatttttgaaaatccttcaacaagaagttcattgtcaaggaattcagagtcatcgtatgattttaaaactaatataaattcagatccaacaaatacatgtaaaaacattaaggctgttacatgtttatcaccgaaatcaggagtatcatttgattcagtgattgcttgtggcgaatcaaatcaaccaagtatctaccaaaaaccaaggaaacaagtataccagtctaattctgagcaaacgcatttttgtcttctagacacacattgcttggaaggctatgagacagtgggagaagaagtccttagtgcaatcaaaaaatcaaaatgctgggagacagactttacagaatatatccaattcaaacaaagcgatggtgtaagaagttgtaggatgaaagattcaggggaatgcacagtaactactaataagtggcccataatactttgtgaaaacaacagatattattattctgagctacataaagattacgataaagatcaagatataggccatttttgcctcagtcctagatgcaacaccattagatatcctataaatcaaaatcacatctctaattgtacatggcaagttaggcacaacaatatagataaaattgaggtacatgaattagaagatctagagcaatataggaaagctattacgcaaaaactgcaaacaagcttaacactgtttaagtactctagaacaaagaacttaccccatatcaaacctatttacaagtatataactatagaaggaacagagactgctgaaggaatcgaaagtgcttatatagaatcagaaattcctgctctggcaggaacatcgataggattcaaaataacatctaaatctgggaaacatttactagatgttattagttatgtcaaaagcgcgtcttattcagctgtctatacaaaactctatacaacagggcctactataggagtaaatacgaaacacgatgaactgtgcacaggatcatgccctgtcaatgtacctcataatacaggctggctcacatttgctagagaaagaacaagctcatggggatgtgaagagtttggctgcttagcaattagtgatgggtgtgtttttggttcttgccaagacatcataaaggacgagctgactgtctatagggaagaaactgaggaaaccacaaatgtggagctgtgtctgacctttgcagataaaacgtattgcactaatctcaatgccataactcccataataactgatcaatttgaagtccaatttaaaacagtagaagcatatagcttgcctagaattattgcagtacggaatcatgaaatcatggtaggacaaataaatgatataggtgtttattcaaaaggctgtgggaatgtacaaaaaataaataatacgaattatgggaatggtgtgcctaaatttgactacttatgccatttagctagtaggaaggaagtaatcattaggaaatgctttgacaacgattatcaagcttgtaagttcttacagacgcctgcaagctataggctagaagaggaaggaggctcagtaacagtcatagattacaaaaagatccttggcactataaaaatgaaggctatcttaggagatgtcaaatacaaaacatttgctgacaatgtagatataacagtagagggtgcttgcacaggatgtatcaattgctttgacaatatacactgtgagttgacaatacatagtactgtagaagctagctgcccaataacaagctcgtgtacagtattccacgatagaatattaataacaccgaatgagcacaaatatgctataaaagtgatatgcaatggaaagcccgggatatcgctaccattcaaaatttgcaacacaaaagtcgatgctgccatgactttaacagatgcaaagcagatattagaactagctcctgtagatcaaacaacatatattaaagagaaagatgaaaggtgcaaaacttggatgtgcagggttagggatgaaggccttcaagttatatttgaaccatttaaaaacctatttgggtcttatataggaatattttatacatttgtgatatttttagtcgtaatatttatagttatatatatagtgttacccatatgtttcaaacttagggatacattaagacagcatgaggatgcttataagagggaaatgaaaattagatag

SEQ ID NO: 4213 - RNA, 4323 nt, synthetic construct
  misc_feature 1..4323: note = derived and/or modified CDS sequence (wt) from LUMV(SAAr 1881)__KX817325.1__GP
  source 1..4323: mol_type = other RNA
atgatacttgttttgtttttcgttgcactaagtgctgcagggccagtttatcagagatgtttccaagatggtgctattgtcaaacagagcccatccaaacaagctgtgacagaagtatgcttaaaggatgatgtcagcatgataaaaacagaggcaagatacttcaagaataccaccgggatttatgctaataacgttgcaattagaaagtggcttgttgcagactggcatgattgtagaccaaaaaaagtctcagggggccatataaatgttatagaggtgggagatgacctaacactgcatacagaggcttatgtttgcaatgctgattgcataataggtgtagacaaagagactgcacaagtaagattgcaaactgatacaacaaatcactttgaaattgcaggaactacagtcaaatcagggtggtttaagagcactacttatataaccttagatcaaacttgcgaacatttgaaagtctcctgtggacctaaatctatccaattccatgcatgtttcaatcagcatatgtcttgtgttagatttctacatagaacaatattgccaggatctattgctaattctgtatgccagaatatagaaataataattttaacagtactaaccttacttatctttacattactaagtatattaagcaaaacatatatatgctatatactcatgcctatattcatccccctcgcttatatatatggattaatatataataaatcctgcaaaaagtgtaagctatgtggcctagtataccatccctttacagagtgtggcactcattgtgtatgcggtgcaagatatgatacatctgataggatgaaactgcacagagcttcaggactatgcccagggtataagagtcttagagctgcaagagtcatgtgtaaatccaaaggcccagcttctgttttatccattataactgcggtattaatcctaacatttatcacccctataaatgctatgatagctggagagacgcaagagacttttaaactagaagatttgccagatgatatgttaagtatggcaatgaagataaacatgtactacattatgtgtatgttaaattatgttgccacatggtcattcattttctgtgccttaataatagccttaattttcaaaaaatatcaacataagtttctaagctattacgctatgtactgtcaagaatgtgacatgtatcatgacaggtcaggtctaaaatataacgggggtttcacaaataaatgtaggcaatgcacatgtggacaatatgaggatgctacaggcttgatggctcataggaaaacatataactgtttaattcaatataaatcaaaatggttagttaacttcttaattacatatataattctcatgctcatcaaagattctgtattgatagtgcatgctgagggcacagactttgaaaagtgtagcagcgatataaatattgtgtggaattgtacagggccatttcttagcttaggcaattgcgaaaagaagcagaaaaaggagtcatacaatgatatagcggcccagttaaaaggtctagatgcaatatctgtcttggacatccctatgatttcgaagatacctgaagatatagctggggcattgagattcatagaggaacagaattcgtaccatgttcagctgactgttgagtatgctatgttgactagatattgtgattattatacacaatttagtgacaactctggttatagtcagacaacatggagaacatacttgaggtcacatgattttgaggcatgtatattatatccaaatcagcatttttgtagatgtgtgaaacacggagacaaatgctcaagatccaactgggattttgctaatgagatgaagaattattatagtggtaagcagtcgaagtataataaagatctaaatttagcattaatgtcattccaccatgcatttagagggacatctagcttctatactgcaaaacttttaagagaaaagaaaactgaagaacttaaaaactacattgacaaaattagaactaagtaccctggtaatgcattattaaaggctgtaattgactacataaaatatatgatgggtttgactgaagtaagtaacttcaaacatgacgaaatgtgggatgactttatttttgaaaatccttcaacaagaagttcattgtcaaggaattcagagtcatcgtatgattttaaaactaatataaattcagatccaacaaatacatgtaaaaacattaaggctgttacatgtttatcaccgaaatcaggagtatcatttgattcagtgattgcttgtggcgaatcaaatcaaccaagtatctaccaaaaaccaaggaaacaagtataccagtctaattctgagcaaacgcatttttgtcttctagacacacattgcttggaaggctatgagacagtgggagaagaagtccttagtgcaatcaaaaaatcaaaatgctgggagacagactttacagaatatatccaattcaaacaaagcgatggtgtaagaagttgtaggatgaaagattcaggggaatgcacagtaactactaataagtggcccataatactttgtgaaaacaacagatattattattctgagctacataaagattacgataaagatcaagatataggccatttttgcctcagtcctagatgcaacaccattagatatcctataaatcaaaatcacatctctaattgtacatggcaagttaggcacaacaatatagataaaattgaggtacatgaattagaagatctagagcaatataggaaagctattacgcaaaaactgcaaacaagcttaacactgtttaagtactctagaacaaagaacttaccccatatcaaacctatttacaagtatataactatagaaggaacagagactgctgaaggaatcgaaagtgcttatatagaatcagaaattcctgctctggcaggaacatcgataggattcaaaataacatctaaatctgggaaacatttactagatgttattagttatgtcaaaagcgcgtcttattcagctgtctatacaaaactctatacaacagggcctactataggagtaaatacgaaacacgatgaactgtgcacaggatcatgccctgtcaatgtacctcataatacaggctggctcacatttgctagagaaagaacaagttcatggggatgtgaagagtttggctgcttagcaattagtgatgggtgtgtttttggttcttgccaagacatcataaaggacgagctgactgtctataggaaagaaactgaggaaaccacaaatgtggagctgtgtctgacctttgcagataaaacgtattgcactaatctcaatgccataactcccataataactgatcaatttgaagtccaatttaaaacagtagaagcatatagcttgcctagaattattgcagtacggaatcatgaaatcatggtaggacaaataaatgatataggtgtttattcaaaaggctgtgggaatgtacaaaaaataaataatacgaattatgggaatggtgtgcctaaatttgactacttatgccatttagctagtaggaaggaagtaatcattaggaaatgctttgacaacgattatcaagcttgtaagttcttacagacgcctgcaagctataggctagaagaggaaggaggctcagtaacagtcatagattacaaaaagatccttggcactataaaaatgaaggctatcttaggagatgtcaaatacaaaacatttgctgacaatgtagatataacagtagagggtgcttgcacaggatgtatcaattgctttgacaatatacactgtgagttgacaatacatagtactgtagaagctagctgcccaataacaagctcgtgtacagtattccacgatagaatattaataacaccgaatgagcacaaatatgctataaaagtgatatgcaatggaaagcccgggatatcgctaccattcaaaatttgcaacacaaaagtcgatgctgccatgactttaacagatgcaaagcagatattagaactagctcctgtagatcaaacaacatatattaaagagaaagatgaaaggtgcaaaacttggatgtgcagggttagggatgaaggccttcaagttatatttgaaccatttaaaaacctatttgggtcttatataggaatattttatacatttgtgatatttttagttgtaatatttatagttatatatatagtgttacccatatgtttcaaacttagggatacattaagacagcatgaagatgcttataagagggaaatgaaaattagatag

SEQ ID NO: 4214 - RNA, 4329 nt, synthetic construct
  misc_feature 1..4329: note = derived and/or modified CDS sequence (wt) from MELV__U88057.1__GP
  source 1..4329: mol_type = other RNA
atgattgccttaatatttctgattgcaattgctgctgcaagcccagtataccagagatgcttccaggatgggggtatagtgaagcaaaacccatccaaagacgcagttacagaagtctgccttaaagatgatgttagcatgataaagaccgaagcaaaatatatgaaaaatgatacgggaacattttcaaataatgtagctatgagaaagtggttggttgcagactggcatgattgtaggccccaaaaatcatctggagggcacatcaatgtaatagaagttggtgatgatctctcattgcacacagaagcatacatttgtagtgctgattgtatgataagtgttgataaggaaacagcacaaataaggctacaaacagacagcaccacccactttgaaatagctgggacaactgtaaaatcaggttggtttaaaagcacaacttacataacactagatcaaacatgtgaacatctgaaagtctcatgtggcccaaagtccatacaattccatgcatgtttcaatcagcatatgtcttgtgtaagattcctgcatagaacaatattgccaggttctatagcaaactctatatgccaaaatattgagataattatccttgtaacattaacgctattaatctttatatttcttagtatacttagtaagacgtatatctgttacattttaatgcctatgttcatacctgtggcttatatatatggttggatttataacaaatcttgcaagaaatgtaagttatgtggtttagtatatcatccatttactgaatgtggaacccattgtgtgtgtggtgctagatatgaaacatctgatagaatgaagttgcatagatcttctggattatgtccagggtataagagtttaagagctgcaagagtaatgtgtaagtcaaaaggcccagcatcgattctgtcggtactaactgctgttctcatattaacatttgtaacacctatgaatgcattaaccctaggttcttcagaggagaactacaaactggagaatctaccagatgatatgttggacatggctgaaaggatagatatttactatttaagcattatcttaaattatagtataacctggggcttagtaatactcctaggtttaactttcatcctattcagaagattccagcatagattcttaaattgttatgccatgtattgcagtgaatgtgacatgtaccatgataagaatggtttagtaaggaatggtgactttacaaacaagtgtagacaatgcacttgtgggcagtatgaagatgcagctggattaataatccatcaaaaatcatataattgtctgattaaatataaagcaaagtggattcgaaatatactgttaacatatatcatattaatactgattaaagactctgttctactgacatctgcagaaggccctgatttttctgtatgtatagaacaaaaggcaatatcttggaattgcactggccctttcctaaaccttggaagatgcgaaaagactcaaaaaaaagccagctatgctacaattgctacacagttaagaagtatagatgcaatatcagtcttagatatcccaatgattgcaaagataccagaagatatatctggggcactgaaatacatagagagtttaaaaacttaccatgagcaattgacggcagaatatgctatgctgactagatattgtgattattacactcaatttagtgataattctggttatagccagacaagctggaggaaattcttaagatcacacgattttgaatcttgcataatttacccaaatcaacacttttgtagatgtgtcaaacaagatgagaaatgtagcagtgctaaatgggactttgcaagtgaaatgaaaggattttacttgaataaacaagccaaatttaacaaagatttaaatttagccttatctacctttcacaaagctttcagagggactccaatctcttatgtaacagaattgatatcaaagaacaaaaatagctccttgttaatgtatgtatcagaaataaaaagaaaattcccagggaatgcactgctagttgcattattagattttataatgtatttacaatcattgagcgagatctctggcttcgaacttggggatgaatgggaagactttaaatatgatccagaacccacagagccagctttgatgccaagatcgcacaggtccgatcaatataattttaaaaatgctgccagtgttagtaagacaaaaacttgcgaaaatataaaaagagtcttatgtttatctcccagatcaagagcaacatttgatgatgttgtagcatgcggtgagtttgcaaacccctctgtatatatgttaccaaatatcactatataccaatcgaatatagagaggagtcattattgcattgctgattcgcattgtctagaagaattcgaattggtaaagccagagcttctaactgcattaaaaaagtcaacatgttgggctggagaaattgatgatatagttctacataaacaaagtgatggcctgaggagctgtagaataaaagacacaggaacctgcgatgtattaggcaatgaatggactatagttttatgtgaaaacaataatttctattattctgaagtgcatagagattatgataaagatcaagatataggtcatttttgcctaagtccgcgttgtaatataattagatacccaatcaaccctaggcatataagaacctgcaagtggcaaatttcacattctacaatagataaaattaccgtacatgagttggcagatattgaacaatataaaaaagctattacgcaaaaattgcaaaacagtttgtccatattcaaatacaaaaggacaaagaatttaccacatataaagccaatttataaatacattgcaatagaaggtacagaaacagtagaaggtattgaaaatgcttatattgaatccgaaataccagcattggcaggtactgctataggttttaaaatcaattcaaaggatggcaatcacttgatggatgtaataggatatgtaaagagtgcatcttattcatctacatacacaaaattatacacaactgggccaacaatagggatcaacacgaagcatgatgaaaaatgcactgggagctgtcctacacaagtcaagcataaaaccggttggttaacatttgcaaaagaaagaacaagtacatgggggtgcgaagagtttggatgtttggctattagtgatggctgcgtatttgggtcatgtcaggacataataaaggatgaattgaccgtttataggaaaaccactgacgaagtgacagagctggaattgtgcctgacttttgcagacaagacttattgcacaaatttgaatgctgttacacctataataacagataaatttgaggtgcaattcaaaaccgtggaatcttactcattgccaagaattattgctgtcaaaaaccatgaaatcaaggttggacaaattaatgatattggagtctattcaaaaggatgtggtaatgtacaaaaggtaaatggaacaagttatggaaatggtgtaccaaaatttgattatctatgccatctagcaagtagaaaagaagttaccattaggaaatgctttgacaacgattaccaggcttgtaaatttttacagacaccttcaagttataggcttgaagaacatcagggcacagtaacaataatagattacaaaaaaatactgggttctattaaaatgaaggcaatcttaggagatgtcaagtacaaaaattatgctagtaatattgatatcaatgctgaaggttcttgtgctggatgcattaactgttttgagaacatacattgtgagttcacaattcatagcacagtggaaaccagttgtcaaattgaaagcgactgtacaagtttccatgacagggtgttaataacaccaaatgaacataaatatgctttgaaattaatatgccatgacaaacctgcttcttcgcttaaatttaaaatttgtaacacgaaagtcgaggcagctatgactttagtagatgcgagacccataatagagttagcacctgtggatcaaaccgcttatattcgagaaaaagatgaaagatgcaaaacttggatgtgcagagttagggatgaaggaatacaggttatttttgagcctttcaaaaatttatttggctcatatataggtatcttttacgctatagtaatatgtattattgtattatttttaatcgtttatatagtgctaccaatttgcttcaagctcaaagacactctaaagcaacatgaagatgcatacaaaagggaaatgaagattaggtaa

SEQ ID NO: 4215 - RNA, 4326 nt, synthetic construct
  misc_feature 1..4326: note = derived and/or modified CDS sequence (wt) from SAV__AF123486.1__GP
  source 1..4326: mol_type = other RNA
atgatacctttgctgtttttagttacgctggtgtctgcaggcccagtgtttcaacgttgcttccaagatggggctatagtgaagcaaaacccatcgaaagaggcagtgacagaagtatgtataaaagatgatgtaagtatgattaaaacagaggctagatatgtcaggaattcaagtggagtcttctcaaacaatgtggctttacgaaaatggctcgtgtcggattggcatgactgcaaaccaaaaaaagtcagtggagggcatattaatgttatcgaggttggtaacgatttaactttacacacagaatcgtatgtatgtagtgcagattgcacaataggaattgacaaggaaacggcacaaatcagactccaaactgatactacaaatcactttgaagtggcaggaactactgtaaaatctgggtggttcaaaagcactacgtatattacattagaccaaacttgcgagcacttgaaagtatcttgcggtcccaaatccatacagttccatgcatgctttaatcagcatatgtcttgtgtcaggttcctgcatagaaccatactacctggttccatggctaactctatatgccaaaatatagaaataataatcctaaccacactagcattgcttatattcttattattaactattttaagcaaaacatatatctgctacttactaatgcctatatttatcccaatagcacacttatacggattaatttacaataagtcttgtaaaaagtgtcagctatgcggcctagtgtatcatccatttactgagtgcggcacccactgtgtatgtggtgctagatatgaaacatcagatagaatgaaattgcatcgtgcatcaggcctttgcccaggatataagagtttgagagctgctagagttatgtgtaaatctaaaggaccagcatcaaacctatccataatcactgcagtcctcactttgacatttgtgacacctataaatgggttaacaataggggatagtaaggaagttttaaaccctgatgagctcccagatgacatgttagaaatggctcaaaaattaaacatgtatcaactgatatgcattataaattatactgcaacatggtctattataattataggtttagctgtcttttacattttcaaaaagtaccagcatagattctacaattactatgctatgtattgccaagagtgtgatatgtaccatgaaagatctggcctgaagtggaatggagacttcacaaataagtgcagacagtgcacatgtggtgagtatgaagatgcagctggtttaatatctcacaggaaatcttataactgtcttctgcagtacaaggttaagtgggtaatgaactttttaaccatatatgttgccttgatcattctgaaagactcaacattgatagtacaagcagcgggcactgatttctcagattgtatagaaaccgaggaattaaattggaactgcactggccctttcttgaatttaggtaattgcgaaaagaaacagaagaaggaatcatattcaaatattgcagaacagttgaaaggtttgcaagcaatatctgtccttgatatcccattaattgcaagaatacctgaggacatatctggcggattgagatatatcgaatctatcagaactcatcatgcgcaacttaccgctgaatatgcaatgttgactagatactgtgactaccataaactatttggggacaactctggatacagtcaaacaacatggagaatgtatctaagatcacatgactttggagcatgcattttatacccaaatcaacatttttgtaggtgtgttaagcatggagaaaaatgcagcagttcaagctgggactttgccagtgagatgaagaattattactccgggaaacagggaaaatttaacaaagacttaaacttggccttacagtctatccatcatgcattcaggggcacctcatcatcttacatagcaactatcttatcagagaagaggaatgaccaacttgtggaatacatggaaaaactaagggaaaagtttattggaaatgctttactcagagctgtgctagatttcataacatatatgaagtctttaactgaaatgacaaactttaaacatgacgaattttgggatgaatttgtccatctgcctgcaccaacaaaagccccatctatgaggagatctggaaatgagaattacgactttaaagcaccaacatctccagctgggactaaaagttgcaaaaacataaagaacgttgtatgtctctcacctagatccggtgcttcctacgaaggcattgtagcttgtggagaaccttcagccccacaaattttcaaaatgccctctgaatctatctatcataacaatgcagaccagtctatgtattgtattgcagatacccactgcttgcaagattactccccagttgaagatgaagagttgaatgccatcaaaaaatcaaaatgctgggaaacagaatttaccaatgcagtgccatttaaacaaagtgatggaatacgaagctgtagaatgagagattctgggaattgtaatgtgacaacaaacctatggcctgtaatgcagtgtgacgatggtaaattttattattctgagcaccaaaaagattatgacaaggatcaagatataggccatttttgcttgagcccaagatgcaatatggttaggttccctataagcgagaaaaacattttagcatgcgattggatagtcagccatccaaatattgataaaatagatgtccattctcttgaagatctagagcaatataaaaaggcaataacccagaagctccagactagtttgtctatattcaaatatgcaaaaactatgaatttaccacatgttaaaccaatatataagtatatttcaattgaaggcacagagactgcagaaggggttgaaaatgctttcatagaatcagaaataccagcattagcaggaacatcaataggatttaaagtaaattctaaagatgggaagcatattatggatattattggttatgtaaaaactgcatcatattcgtctgtatatactaagctttacacaactagtccaacaacaggggtgaatacaaagcacgatgaattatgcacaggcccgtgtcctaaacagattgaacataaaaatggctggataactttttcaaaggaaaggacaagctcatggggttgtgaagagttcggatgtctagcaataagtgatgggtgcgtatttggatcttgccaagacattattaaagatgaaatgtctgtttacaggaaagaaacagaggaaactacaattgttgaactgtgcctaacattttctgataaaacttattgtgtcgaattaaacccggttacacccataataacagatcttttcgaagtccaattcaaaacagtagagtcatatacactacctagaatcgttgcagtaaaaaatcacgaggtgatggtaggccaaatcaatgatctaggggtttattcaaaaggctgtggcaatgttcaaaaagtgaacgggactgtatatggtaatggtgtaccaaaatttgattacctatgccatctagccagccggaaagaagttataatcaggaagtgttttgacaatgactatcaagcttgtaagttcctacagagcccatccagttacagactagaggaggatgcttctacagtatcaataattgattataaaaaaattcttggaacaataaagatgaaggctatcttgggagatgttaggtacaagacattttcagagtctatagacatttctgcagaggggacatgtacaggatgtgtcaattgctttgagaatatacattgcgaatttaccatacattcaacagtagaagccagctgtcctgttgttagtacatgtactcttttccatgacagaatcttaatagggccagataatcacaagtatgcaatgaaagttatatgtacagaggcgcctaaaacaagcttaagtttcaaaatatgtaatacaaaagtagatgctgctatcaccatagttgactcgaaacctatagttgagttagcaccagtggatcagactgcatatattagggaaaaagatgataggtgcaaaacatggatgtgcagagttagagatgaaggtatgcaagtcttgtcagagccattcaaaaatttattcggatcctatataggaatattctacactggactagctgtgttgataattgccttgatagcagtctacatagtcatgcccatttgctttaaggtaaaagatatattaaagaaacatgatgatgcctacaggcgggagttaaagattaggtaa

SEQ ID NO: 4216 - RNA, 4326 nt, synthetic construct
  misc_feature 1..4326: note = derived and/or modified CDS sequence (wt) from SAV(20230)__KX817331.1__GP
  source 1..4326: mol_type = other RNA
atgatacctttgctgtttttagttacgctggtgtctgcaggcccagtgtttcaacgttgcttccaagatggggctatagtgaagcaaaacccatcgaaagaggcagtgacagaagtatgtataaaagatgatgtaagtatgattaaaacagaggctagatatgtcaggaattcaagtggagtcttctcaaacaatgtggctttacgaaaatggctcgtgtcggattggcatgactgcaaaccaaaaaaagtcagtggagggcatattaatgttatcgaggttggtaacgatttaactttacacacagaatcgtatgtatgtagtgcagattgcacaataggaattgacaaggaaacggcacaaatcagactccaaactgatactacaaatcactttgaagtggcaggaactactgtaaaatctgggtggttcaaaagcactacgtatattacattagaccaaacttgcgagcacttgaaagtatcttgcggtcccaaatccatacagttccatgcatgctttaatcagcatatgtcttgtgtcaggttcctgcatagaaccatactacctggttccatggctaactctatatgccaaaatatagaaataataatcctaaccacactagcattgcttatattcttattattaactattttaagcaaaacatatatctgctacttactaatgcctatatttatcccaatagcatacttatacggattaatttacaataagtcttgtaaaaagtgtcagctatgcggcctagtgtatcatccatttactgagtgcggcacccactgtgtatgtggtgctagatatgaaacatcagatagaatgaaattgcatcgtgcatcaggcctttgcccaggatataagagtttgagagctgctagagttatgtgtaaatctaaaggaccagcatcaatcctatccataatcactgcagtcctcattttgacatttgtgacacctataaatgggttaacaataggggatagtaaggaagtttttaaccttgatgagctcccagatgacatgttagaaatggctcaaaaattaaacatgtatcaactgatatgcattataaattatactgcaacatggtctattataattataggtttagctgtcttttacattttcaaaaagtaccagcatagattctacaattactatgctatgtattgccaagagtgtgatatgtaccatgaaagatctggcctgaagtggaatggagacttcacaaataagtgcagacagtgcacatgtggtgagtatgaagatgcagctggtttaatatctcacaagaaatcttataactgtcttctgcagtacaaggttaagtgggtaatgaactttttaaccatatatgttgccttgatcattctgaaagactcaacattgatagtacaagcagcgggcactgatttctcagattgtatagaaaccgaggaattaaattggaactgcactggccctttcttgaatttaggtaattgcgaaaagaaacagaagaaggaatcatattcaaatattgcagaacagttgaaaggtttgcaagcaatatctgtccttgatatcccattaattgcaagaatacctgaggacatatctggcggattgagatatatcgaatctatcagaactcatcatgcgcaacttaccgctgaatatgcaatgttgactagatactgtgactactataaactatttggggacaactctggatacagtcaaacaacatggagaatgtatctaagatcacatgactttgaagcatgcattttatacccaaatcgacatttttgtaggtgtgttaagcatggagaaaaatgcagcagttcaagctgggactttgccagtgagatgaagaattattactccgggaaacagggaaaatttaacaaagacttaaacttggccttacagtctatccatcatgcattcaggggcacctcatcatcttacatagcaactatcttgtcagagaagaggaatgaccaacttgtggaatacatgaaaaaactaagggaaaagtttattggaaatgctttactcagagctgtgctagatttcataacatatatgaagtctttaactgaaatgacaaactttaaacatgacgaattttgggatgaatttgtccatctgcctgcaccaacaaaagccccatctatgaggagatctggaaatgagaattacgactttaaagcaccaacttctccagctgggactaaaagttgcaaaaacataaagaacgttgtatgtctctcacctagatccggtgcttcctacgaaggcattgtagcttgtggagaaccttcagccccacaaattttcaaaatgccttctgaatctatctatcataacaatgcagaccagtctatgtattgtattgcagatacccactgcttgcaagattattccccagttgaagatgaagagttgaatgccatcaaaaaatcaaaatgctgggaaacagaatttaccaatgcagtgccatttaaacaaagtgatggaatacgaagctgtagaatgagagattctgggaattgtaatgtgacaacaaacctatggcctgtaatgcagtgtgacgatggtaaattttattattctgagcaccaaaaagattatgacaaggatcaagatataggccatttttgcttgagcccaagatgcaatatggttaggttccctataagcgagaaaaacattttagcatgcgattggatagtcagccatccaaatattgataaaatagatgtccattctcttgaagatctagagcaatataaaaaggcaataacccagaagctccagactagtttgtctatattcaaatatgcaaaaactatgaatttaccacatattaaaccaatatataagtatatttcaattgaaggcacagagactgcagaaggggttgaaaatgctttcatagaatcagaaataccagcattagcaggaacatcaataggatttaaagtaaattctaaagatgggaagcatattatggatattattggttatgtaaaaactgcatcatattcgtctgtatatactaagctttacacaactggtccaacaacaggggtgaatacaaagcacgatgaattatgcacaggtccgtgtcctaaacagattgaacataaaaatggctggataactttttcaaaggaaaggacaagctcatggggttgtgaagagttcggatgtctagcaataagtgatgggtgcgtatttggatcttgccaagacattattaaagatgaaatgtctgtttacaggaaagaaacagaggaaactacaattgttgaactgtgcctaacattttctgataaaacttattgtgtcgaattaaacccggttacacccataataacagatcttttcgaagtccaattcaaaacagtagagtcatatacactacctagaatcgttgcagtaaaaaatcacgaggtgatggtaggccaaatcaatgatctaggggtttattcaaaaggctgtggcaatgttcaaaaagtgaacgggactgtatatggtaatggtgtaccaaaatttgattacctatgccatctagccagccggaaagaagttataatcaggaagtgttttgacaatgactatcaagcttgtaagttcttacagagcccatccagttacagactagaggaggatgcttctacagtatcaataattgattataaaaaaattcttggaacaataaagatgaaggctatcttgggagatgttaggtacaagacattttcagagtctatagacatttctgcagaggggacatgtacaggatgtgtcaattgctttgagaatatacattgcgaatttaccatacattcaacagtagaagctagctgtcctgttgttagtacatgtactcttttccatgacagaatcttaatagggccagataatcacaagtatgcaatgaaagttatatgtacagaggcacctaaaacaagcttaagtttcaaaatatgtaatacaaaagtagatgctgctatcaccatagttgactcgaaacctatagttgagttagcaccagtggatcagactgcatatattagggaaaaagatgataggtgcaaaacatggatgtgcagagttagagatgaaggtatgcaagtcttgttagagccattcaaaaatttattcggatcctatataggaatattctacactggactagctgtgttgataattgccttgatagcagtctacatagtcatgcccatttgctttaaggtaaaagatatattaaagaaacatgatgatgcctacaggcgggagttaaagattaggtaa

SEQ ID NO: 4217 - RNA, 4329 nt, synthetic construct
  misc_feature 1..4329: note = derived and/or modified CDS sequence (wt) from SDNV__AF123490.1__GP
  source 1..4329: mol_type = other RNA
atgatatgcatattactcttgatagcacttgcttcagcaagccctgtctatcaaaggtgcttccaagatggagcaattgtcaaacaatacccagcgaaagatgccgtaactgaagtttgtctaaaagatgacgtcagtatgataaagacacaggctaattatatgaaaaataccacagggacattctccaacaatgtagctatgaggaaatggcttgttgctgattggcatgattgtagaccacaaaagtcatctggtggccacataaatgtaatagaagttggagatgatttatcattacacactgaggcatatatttgtagcgcagattgtgttataagcattgacaaagagacagcacagatcaggctgcaaactgatagcacaaaccattttgaagtttcaggcacaactgtaaaatcaggatggtttaaaagtacaacatatatcacattagatcagacttgtgagcatttgaaagtttcatgtggtccaaaatcaatacaattccatgcatgcttcaaccagcatatgtcctgtgtaagattcttacatagaaccatattacctggttccatggcgaactcaatatgccaaaatattgaaatcataatattagtaacacttactttaatgatcttcatattattaactataataagcaaaacttatatctgctacatcttaatgccaatatttatacctatagcttatatctatggttggatttataataaatcatgtaaaaagtgtaaattatgtggtctcgtatatcacccttttactgaatgcggcacccattgtgtttgtggtgcaaggtatgagacctcagacagaatgaaattacatagatcctctggcttatgtcctggttataaaagtttacgagcagctagagttatgtgtaaatcaagaggtcctgcatcaatactttctatactaactgctgtactaatattaacttttgttactcctatgagtgcactagttataggctcatcagaagaattgtacaaattagatgagttgccggatgatatgattgatatggcagaaaaagtaaacctatattatttagtgattgtgttaaattacagtgctacatggggtttgttattacttatgggtattctagcactgttattcaaaaagtatcaacatatattcttaaactattatgcaatgtactgcacagaatgcgatatgtatcatgataaaaaagaattaacttacaatggggattcaccaacaaatgcctggcaatgtacatgcggacagtatgaagatgccacaggccttatcgtacatcagaagtcttacaattgtttagttaaatacaaggttaaatggatcaaaaacatattgataatgtatatcgttctaactttaatcaaagattctgtgttaattgcttcagctgagggcccagattttgcaacttgtattgaagaaaaaactataacatggaattgcacagggccgtttttaaatctaggtagatgtgataaaacacaaaaaaagacagattatgcaacaatagctagtcaactcaaaggcattgatgcaatctctattttagatgtcccaatgatttctaaaataccagaagatatatcaggagcattgaaatatattgaaagtttaaaaacctaccatgaacagttaacagctgagtatgcaatgtttactagatattgtgattattacacacaattctcagataattctggatatagccaaactacatggaggacatatttgcgatctcatgattttgaggtatgtattgcctatcctaatcaacatttttgcagatgcgtgaaaaatggcgaaaagtgtagtagtgcacagtgggactttgctacagaaattaaaggctattatactggaagacaaaataaattcaataaagatttaaatctagcattaatgacattccacacagcatttcgaggtactgcaacatcatatgtaacagagctaatatcaaagggaaaaaatagctctttattaatgtatgcatcagctattaagagtaaattcaatggcaatgcattattgaaagcattacttgacttcatgatgtatcttcagtcactaggggaaatttctggcttcaaactgacagatgaatgggaggattttaaatatgaagaggaacctacagaacagacactaatgcctagaggacatcgaggtgggcaatacaatttcaaaaatgcagcaagcaatggtaaaacaaaagtatgcaaaaatgtgaagaaggtgctgtgcttatcacctagatctagagccacttttgatgatgtcatagcatgcggcgaacatgcaaacccatcagtgtacatgattccaaacacaacaatctaccagtcgaatacagaaagaagtcactattgtattgctgattcacattgtctagaagaatatgagctggttaaaccagaattattaactgcacttaagaaatctagatgttgggctggtgacatagacactatagttttacacaagcaaagtgatgggctaaggagttgtcgcataaaagatactggcagctgcaatgtgatgggaaatgactggacaatagtattatgtgaagataataaatactattactcagaagtacatcaagattatgacaaagatcaagatgttggacatttttgcttgagtccaaggtgtaacacaattagataccctatcagtccgcgacatatcaactcatgtaaatggcaaatctcacattctacaattggtaagatatcagtgcatgaattagctgatatagaacaatacaaaaaagctatatctcagaaactgcaaactagtttatctatcttcaaatatgcaaaaacaaaaaatctaccacatataaaaccagtctataaatacattgcaatagaaggtacagaaacagttgaaggagttgaaaatgcatttatagaatctgaaattccagctctagctggtactgccattggatttaaaataaattcaaaggagggctatcatttgatggatattataggttatgtcaaaagcgcatcttactcttcaacatacacaaaactatacacaacaggaccaaccatagggataaatacaaagcatgatgaaaaatgcactggaagctgtccaggaactattcatcataaaactgggtggttaacattttctaaagaacgaacaagcacatggggttgcgaagaatttgggtgcttagctgtaagcgatggatgtgtttacgggtcatgccaagatataataaaagatgaattaactgtatatagaaaaatctcagatgaagttactgaagttgagttatgtttaacattttcagacaaaacatattgtactaatttaaatgcagtgactccaattattacagataaatttgaggtacaattcaagacagttgagtcatattcactgcctagaatagtgggagtgcgaaaccacaaaattcagatagggcaaatcaatgatataggagtttattctaaaggttgtggcaatgtccagaaagtaaatggcactaattatggtaatggggtgcctaaatttgattatttatgccatttagctagtagaaaagaagtcattattagaaaatgttttgacaatgattatcaagcttgtaaatttctacaaacacctgccagttatagattagaagaacatcaaggaactgtgactatcataaattataaaaagattttgggttccataaaaatgaagccatattgggtgatgttaagatacaaaaattatgcaaatagtctagatatcaatgcagagggaacatgttcagggtgtgtaggttgctttgaaaatattcattgtgaattcacaattcacaccactatagaagctagttgtcagatagaaagtgactgtacaacattccacgataggatattagtaactccaaatgagcacaaatatgccctcaaggtgatctgtcatgacaaacccaaaacaatattcaacttcaaaatatgtaacaccgaaattgaagcagccatagctattgtggatgcaaaacctattatagaattagcacctgtggatcagacagcttatataagagaaaaagatgaacgctgtaagacatggatgtgccgagttagagatgaaggcattcaagttcttctagaaccatttaaaaatttatttggatcctatattggaatattttatactattttaattgtaatcttcatcttggtaattattatttatataattcttcctatatgcttcaaacttcaagacacattaaaacagcatgaagatgcatataagagagagatgaagatcaggtaa

SEQ ID NO: 4218 - RNA, 4329 nt, synthetic construct
  misc_feature 1..4329: note = derived and/or modified CDS sequence (wt) from SDNV(BeAr103645)__KX817334.1__GP
  source 1..4329: mol_type = other RNA
atgatatgcatattactcttgatagcacttgcttcagcaagccctgtctatcaaaggtgcttccaagatggagcaattgtcaaacaatacccagcgaaagatgccgtaactgaagtttgtctaaaagatgacgtcagtatgataaagacacaggctaattatatgaaaaataccacagggacattctccaacaatgtagctatgaggaaatggcttgttgctgattggcatgattgtagaccacaaaagtcatctggtggccacataaatgtaatagaagttggagatgatttatcattacacactgaggcatatatttgtagcgcagattgtgttataagcattgacaaagagacagcacagatcaggctgcaaactgatagcacaaaccattttgaagtttcaggcacaactgtaaaatcaggatggtttaaaagtacaacatatatcacattagatcagacttgtgagcatttgaaagtttcatgtggtccaaaatcaatacaattccatgcatgcttcaaccagcatatgtcctgtgtaagattcttacatagaaccatattacctggttccatggcgaactcaatatgccaaaatattgaaatcataatattagtaacacttactttaatgatcttcatattattaactataataagcaaaacttatatctgctacatcttaatgccaatatttatacctatagcttatatctatggttggatttataataaatcatgtaaaaagtgtaaattatgtggtctcgtatatcacccttttactgaatgcggcacccattgtgtttgtggtgcaaggtatgagacctcagacagaatgaaattacatagatcctctggcttatgtcctggttataaaagtttacgagcagctagagttatgtgtaaatcaagaggtcctgcatcaatactttctatactaactgctgtactaatattaacttttgttactcctatgagtgcactagttataggctcatcagaagaattgtacaaattagatgagttgccggatgatatgattgatatggcagaaaaagtaaacctatattatttagtgattgtgttaaattacagtgctacatggggtttgttattacttatgggtattctagcactgttattcaaaaagtatcaacatatattcttaaactattatgcaatgtactgcacagaatgcgatatgtatcatgataaaaaagaattaacttacaatggggatttcaccaacaaatgcaggcaatgtacatgcggacagtatgaagatgccacaggccttatcgtacatcagaagtcttacaattgtttagttaaatacaaggttaaatggatcaaaaacatattgataatgtatattattctaactttaatcaaagattctgtgttaattgcttcagctgagggcccagattttgcaacttgtattgaagaaaaaactataacatggaattgcacagggccgtttttaaatctaggtagatgtgataaaacacaaaaaaagacagattatgcaacaatagctagtcaactcaaaggcattgatgcaatctctattttagatgtcccaatgatttctaaaataccagaagatatatcaggagcattgaaatatattgaaagtttaaaaacctaccatgaacagttaacagctgagtatgcaatgtttactagatattgtgattattacacacaattctcagataattctggatatagccaaactacatggaggacatatttgcgatctcatgattttgaggtatgtattgcctatcctaatcaacatttttgcagatgcgtgaaaaatggcgaaaagtgtagtagtgcacagtgggactttgctacagaaattaaaggctattatactggaaaacaaaataaattcaataaagatttaaatctagcattaatgacattccacacagcatttcgaggtactgcaacatcatatgtaacagagctaatatcaaagggaaaaaatagctctttattaatgtatgcatcagctattaagagtaaattcaatggcaatgcattattgaaagcattacttgacttcatgatgtatcttcagtcactaggggaaatttctggcttcaaactgacagatgaatgggaggattttaaatatgaagaggaacctacagaacagacactaatgcctagaggacatcgaggtgggcaatacaatttcaaaaatgcagcaagcaatagtaaaacaaaagtatgcaaaaatgtgaagaaggtgctgtgcttatcacctagatctagagccacttttgatgatgtcatagcatgcggcgaacatgcaaacccatcagtgtacatgattccaaacacaacaatctaccagtcgaatacagaaagaagtcactattgtattgctgattcacattgtctagaagaatatgagctggttaaaccagaattattaactgcacttaagaaatctagatgttgggctggtgatatagacactatagttttacacaagcaaagtgatgggctaaggagttgtcgcataaaagatactggcagctgcaatgtgatgggaaatgactggacaatagtattatgtgaagataataaatactattactcagaagtacatcaagattatgacaaagatcaagatgttggacatttttgcttgagtccaaggtgtaacacaattagataccctatcagtccgcgacatatcaactcatgtaaatggcaaatctcacattctacaattggtaagatatcagtgcatgaattagctgatatagaacaatacaaaaaagctatatctcagaaactgcaaactagtttatctatcttcaaatatgcaaaaacaaaaaatctaccacatataaaaccagtctataaatacattgcaatagaaggtacagaaacagttgaaggagttgaaaatgcatttatagaatctgaaattccagctctagctggtactgccattggatttaaaataaattcaaaggaaggcaatcatttgatggatattataggttatgtcaaaagcgcatcttactcttcaacatacacaaaactatacacaacaggaccaaccatagggataaatacaaagcatgatgaaaaatgcactggaagctgtccaggaactattcatcataaaactgggtggttaacattttctaaagaacgaacaagcacatggggttgcgaagaatttgggtgcttagctgtaagcgatggatgtgtttacgggtcatgccaagatataataaaagatgaattaactgtatatagaaaaatctcagatgaagttactgaagttgagttatgtttaacattttcagacaaaacatattgtactaatttaaatgcagtgactccaattattacagataaatttgaggtacaattcaagacagttgagtcatattcactgcctagaatagtgggagtgcgaaaccacaaaattcagatagggcaaatcaatgatataggagtttattctaaaggttgtggcaatgtccagaaagtaaatggcactaattatggtaatggggtgcctaaatttgattatttatgccatttagctagtagaaaagaagtcattattagaaaatgttttgacaatgattatcaagcttgtaaatttctacaaacacctgccagttatagattagaagaacatcaaggaactgtgactatcatagattataaaaagattttgggttccataaaaatgaaggccatattgggtgatgtaagatacaaaaattatgcaaatagtctagatatcaatgcagagggaacatgtgcagggtgtgtaggttgctttgaaaatattcattgtgaattcacaattcacaccactatagaagctagttgtcagatagaaagtgactgtacaacattccacgataggatattagtaactccaaatgagcacaaatatgccctcaaggtgatctgtcatgacaaacccaaaacaatactaaacttcaaaatatgtaacaccaaaattgaagcagccataactattgtggatgcaaaacctattatagaattagcacctgtggatcagacagcttatataagagaaaaagatgaacgctgtaagacatggatgtgccgagttagagatgaaggcattcaagttcttctagaaccatttaaaaatttatttggatcttatattggaatattttatactattttaattgtaatcttcatcttggtaattattatttatataattcttcctatatgcttcaaacttcaagacacattaaaacagcatgaagatgcatataagagagagatgaagatcaggtaa

SEQ ID NO: 4219 - RNA, 4326 nt, synthetic construct
  misc_feature 1..4326: note = derived and/or modified CDS sequence (wt) from SSHV__EU262553.1__GP
  source 1..4326: mol_type = other RNA
atgatttgcatattgatactgtttgcagtcacagctgcaagtccagtgtatcagaggtgtttccaagatggggctatagtgaagcaaaacccatctaaggaagctgttactgaagtatgcctaaaggatgacgttagcatgatcaaaacggaggccagatacataaagaatgcaactggggttttctccaataatgttgcaattcgaaaatggctggtgtctgattggcatgattgcagaccaaagaaaataacaggtggtcatattaatgtcattgaagttggcgatgacctatcattgcacacagaatcgtatgtatgcagtgctgattgtaccataggagttgacaaagaaacagctcaggttcggcttcagacggacacaactaaccatttcgagatagcagggaccacagttaaatctgggtggtttaagagtacaacatatataacccttgaccagacatgtgagcatctaaaagtctcttgtgggcctaagtcgattcagttccatgcatgcttcaatcagcatatgtcctgtgtcagatttttacataggacaatattgcctggttctattgccaattcaatatgccagaatatagaaattataatattagttacgcttactctgttaatattcatactcttaagtgtactaagtaagacatatatatgttacctattaatgcctgtatttatccctatagcgtatgcgtatggcattatatataataagtcttgtaaaaaatgcaaactgtgtggattagtttatcacccattcacagaatgtgggacacattgtgtctgcggtgctcgttatgacacttctgatagaatgaagttacatagggcctctgggctatgtcctggttacaagagcttgagggctgccagagttatgtgcaaatcaaagggtcctgcttcaatactatctgtgatcacagcaatattgatcttaacatttgttactccaatcaattcaatggtagtgggagagagtaaagaagtcttcgagctggaacaacttccagatgacatgctggatatggcactaaggattaatttctattactttgtctgcatcatgaattatgcagtgacctgggggctcataattatcggcctactaattggattgcttttcaagaaataccagcatagattttcgaatctctatgctatgtactgcgaagagtgtgacatgtatcatgatagatctgggctgaaaaggaatggggacttcacaaacaagtgcaggcagtgtacatgtgggcagtatgaggatgcaacaggactaatgacccataggaaaacctataattgcttggtacggtataaggcgaagtgggttatgaacttcttgatagcttatatgcttttaacattgataaaagactcagctatagtagtgcaagctgctggaacagacttcacaacttgtttagaaacagaaaatataaactggaattgcacaggcccctttttaaaccttggaaattgtcaaaaacaacagaaaaaggaaccctacgcaaacatagccactcagctaaaaggtttgcaagcaatttcagtgctcgatatgcccatgatagcaagcatcccagaggatatagcaggggcactaagatacatcgaagaaaaagaaacattccatgttcagctaactgcagaatatgccatgctatctagatactgcgactattacgcccagttttcagataactccggatacagtcagacgacatggagagtttatctaagatcccatgactttgatgcttgcatactctatccaaatcagcatttctgtagatgtgtaaagcatggagataaatgtagtagttctaatagggactttgccaacgagatgaaaaactactactcaggaaagcaaaacaagtttgacaaagatctaaatttggccttaatggcattacatcatgcattccggggcacatcgtctgcatatattgcaacaatgctctcaaagaagtcaaacgatgatctaattgcatatactaataagattaaagaaaagttcccagggaatgcgctactcaaggccattgtggattatatagcgtacatgaaaagtttgtcagaaatgtcaagtttcaagtacgatgaattttgggatgatcttttgtacaaatcagctccaacaaaagctccatctttgtctagaggtagtgagccatcatataatttcaagttagtggtctcatcaagatcaataaaaagttgcaaaaatgttaaaagcgttgtttgtctatctcccagatctggggtgtcatatgattcaatcatagcatgtggtgatcctaatggcccaagtgtatataggaaaccctcagacggtgtatttcaatcaaatgcagatcaatcaacatactgcttagcagacagccattgccttgaagattttgaagtagtcagccaagaagagctggacgcaataaagaaatccaaatgttgggaagcagaatatccagatgtcaaactatcaaagttgacagatggggttaaaagctgcagaatgaaagattctggaaattgcaatgttgcagctaacagatggcctataatacaatgcgaaaatgataaattctattattcagagctgcaaaaggattacgataagacacaagacattggtcacttttgcctaagtcctggatgctctacagttcgcttcccgatcaacccaaagcatatttcaaactgcaactggcaggtaagtcgatctagcatagcaaagattgatgtgcacaatattgaagatattgatcaatacaggaaggccataactcagaaactgcaaacaagcttatctctttttaagtatgcaaaaacaaaaaacttgcctcacatcaaaccaatttacaaatacataaccatagagggaactgaaactgcagagggaatagaaagtgcctatattgagtctgaaatacctgcactagctggaacttccattggtttcaagatcacctccaaagaaggcaagcatttattagatgtcataggctatgtaaaaagtgcttcatactcttctatatatacgaagctttacacaacaggcccaacatcgggaataaacacaaaacatgatgagttatgtacaggaccttgcccagctaaaatcaaccaccagactggatggttgacctttgcgaaagagaggacgagttcatggggctgcgaggagttcgggtgcttagccataagtgacggatgtgtcttcggatcatgtcaagacataataagagatgagttaactgtgtacaggaaggaaacagatgaagtaactgatgtagagttatgtctgacattttcagataagacatattgcacaaatttgaacccaattacaccgattataacagatttgttcgaagtgcaatttaaaactgtcgaaacttacagcctgccaaggatcgttgccatccagaatcacgaaataaagattggccaagtgaatgatttaggagtctactctaagggatgcggaaatgtccaaaaggtaaatgggacagtatatggcaatggggttcccaaattcgattatttgtgtcacctagctagtagaaaggaagttattgttcgaaagtgcttcgataatgattatcaagcatgcaaatttctacaaagcccagctagctacagactagaagaagacagcggaactgttactgtgattgattacaagaagatactaggtacgatcaagatgaaggctatcttaggagatgtcaaatacaaaacatttgctgataatgttgatatgactgcagaagggtcttgtactggatgcataaattgctttgaaaatatccattgcgaattgacgctccacacaaccattgaagctagctgcccaatagtaagcacatgtacggtattccatgatagaatacttgtaactccgaacgagcataaatatgcattaaaagttgtatgcacagagaaaccagggaatacattgaccattaggatatgtaatacaaaagttgaagcttcattagctcttgttgatgctaaacctatactagagttggcaccagtagatcaaactgcttacataagagagaaagatgaaaggtgcaaaacttggatgtgcagagtgagggatgaagggttacaggttatattagagccgtttaagaacctttttggctcttacatagggatattttatacatttataatatccataattgcgctgctgattataatttatattgtgctacccatatgcttcaagctgagagatactctcaggaagcatgaagatgcatacaagagagagatgaagattaggtaa

SEQ ID NO: 4220 - RNA, 4326 nt, synthetic construct
  misc_feature 1..4326: note = derived and/or modified CDS sequence (wt) from SSHV__K02539.1__GP
  source 1..4326: mol_type = other RNA
atgatttgcatattgatactgtttgcagtcacagctgcaagtccagtgtatcagaggtgtttccaagatggggctatagtgaagcaaaacccatctaaggaagctgttactgaagtatgcctaaaggatgacgttagcatgatcaaaacggaggccagatacataaagaatgcaactggggttttctccaataatgttgcaattcgaaaatggctggtgtctgattggcatgattgcagaccaaagaaaataacaggtggtcatattaatgtcattgaagttggcgatgacctatcattgcacacagaatcgtatgtatgcagtgctgattgtaccataggagttgacaaagaaacagctcaggttcggcttcagacggacacaactaaccatttcgagatagcagggaccatagttaaatctgggtggtttaagagtacaacatatataacccttgaccagacatgtgagcatctaaaagtctcttgtgggcctaagtcgattcagttccatgcatgcttcaatcagcatatgtcctgtgtcagatttttacataggacaatattgcctggttctattgccaattcaatatgccagaatatagaaattataatattagttacgcttactctgttaatattcatactcttaagtgtactaagtaagacatatatatgttacctattaatgcctgtatttatccctatagcgtatgcgtatggcattatatataataagtcttgtaaaaaatgcaaactgtgtggattagtttatcacccattcacagaatgtgggacacattgtgtctgcggtgctcgttatgacacttctgatagaatgaagttacatagggcctctgggctatgtcctggttacaagagcttgagggctgccagagttatgtgcaaatcaaagggtcctgcttcaatactatctgtgatcacagcaatattgatcttaacatttgttactccaatcaattcaatggtagtgggagagagtaaagaagtcttcgagctggaacaacttccagatgacatgctggatatggcactaaggattaatttctattactttgtctgcatcatgaattatgcagtgacctgggggctcataattatcggcctactaattggattgcttttcaagaaataccagcatagattttcgaatctctatgctatgtactgcgaagagtgtgacatgtatcatgatagatctgggctgaaaaggaatggggacttcacaaacaagtgcaggcagtgtacatgtgggcagtatgaggatgcaacaggactaatgacccataggaaaacctataattgcttggtacggtataaggcgaagtgggttatgaacttcttgatagcttatatgcttttaacattgataaaagactcagctatagtagtgcaagctgctggaacagacttcacaacttgtttagaaacagaaaatataaactggaattgcacaggcccctttttaaaccttggaaattgtcaaaaacaacagaaaaaggaaccctacgcaaacatagccactcagctaaaaggtttgcaagcaatttcagtgctcgatatgcccatgatagcaagcatcccagaggatatagcaggggcactaagatacatcgaagaaaaagaaacattccatgttcagctaactgcagaatatgccatgctatctagatactgcgactattacgcccagttttcagataactccggatacagtcagacgacatggagagtttatctaaggtcccatgactttgatgcttgcatactctatccaaatcagcatttctgtagatgtgtaaagcgtggagataaatgtagtagttctaatggggactttgccaacgagatgaaaaactactactcaggaaagcaaaacaagtttgacaaagatctaaatttggccttaatggcattacatcatgcattccggggcacatcgtctgcatatattgcaacaatgctctcaaagaagtcaaacgatgatctaattgcatatactaataagattaaagaaaagttcccagggaatgcgctactcaaggccattgtggattatatagcgtacatgaaaagtttgtcagaaatgtcaagtttcaagtacgatgaattttgggatgatcttttgtacaaatcagctccaacaaaagctccatctttgtctagaggtagtgagccatcatataatttcaagttagtggtctcatcaagatcaataaaaagttgcaaaaatgttaaaagcgttgtttgtctatctcccagatctggggtgtcatatgattcaatcatagcatgtggtgatcctaatggcccaagtgtatataggaaaccctcagacggtgtatttcaatcaaatgcagatcaatcaacatactgcttagcagacagccattgccttgaagattttgaagtagtcagccaagaagagctggacgcaataaagaaatccaaatgttgggaagcagaatatccagatgtcaaactatcaaagttgacagatggggttaaaagctgcagaatgaaagattctggaaattgcaatgttgcagctaacagatggcctataatacaatgcgaaaatgataaattctattattcagagctgcaaaaggattacgataagacacaagacattggtcacttttgcctaagtcctggatgctctacagttcgcttcccgatcaacccaaagcatatttcaaactgcaactggcaggtaagtcgatctagcatagcaaagattgatgtgcacaatattgaagatattgatcaatacaggaaggccataactcagaaactgcaaacaagcttatctctttttaagtatgcaaaaacaaaaaacttgcctcacatcaaaccaatttacaaatacataaccatagagggaactgaaactgcagagggaatagaaagtgcctatattgagtctgaaatacctgcactagctggaacttccattggtttcaagatcacctccaaagaaggcaagcatttattagatgtcataggctatgtaaaaagtgcttcatgctcttctatatatacgaagctttacacaacaggcccaacatcgggaataaacacaaaacatgatgagttatgtacaggaccttgcccagctaaaatcaaccaccagactggatggttgacctttgcgaaagagaggacgagttcatggggctgcgaggagttcgggtgcttagccataagtgacggatgtgtcttcggatcatgtcaagacataataagagatgagttaactgtgtacaggaaggaaacagatgaagtaactgatgtagagttatgtctgacattttcagataagacatattgcacaaatttgaacccaattacaccgattataacagatttgttcgaagtgcaatttaaaactgtcgaaacttacagcctgccaaggatcgttgccatccagaatcacgaaataaagattggccaagtgaatgatttaggagtctactctaagggatgcggaaatgtccaaaaggtaaatgggacagtatatggcaatggggttcccaaattcgattatttgtgtcacctagctagtagaaaggaagttattgttcgaaagtgcttcgataatgattatcaagcatgcaaatttctacaaagcccagctagctacagactagaagaagacagcggaactgttactgtgattgattacaagaagatactaggtacgatcaagatgaaggctatcttaggagatgtcaaatacaaaacatttgctgataatgttgatatgactgcagaagggtcttgtactggatgcataaattgctttgaaaatatccattgcgaattgacgctccacacaaccattgaagctagctgcccaatagtaagcacatgtacggtattccatgatagaatacttgtaactccgaacgagcataaatatgcattaaaagttgtatgcacagagaaaccagggaatacattgaccattaggatatgtaatacaaaagttgaagcttcattagctcttgttgatgctaaacctatactagagttggcaccagtagatcaaactgcttacataagagagaaagatgaaaggtgcaaaacttggatgtgcagagtgagggatgaagggttacaggttatattagagccgtttaagaacctttttggctcttacatagggatattttatacatttataatatccataattgcgctgctgattataatttatattgtgctacccatatgcttcaagctgagagatactctcaggaagcatgaagatgcatacaagagagagatgaagattaggtaa

SEQ ID NO: 4221 - RNA, 4335 nt, synthetic construct
  misc_feature 1..4335: note = derived and/or modified CDS sequence (wt) from SORV__AF123488.1__GP
  source 1..4335: mol_type = other RNA
atggaagtcctaagcttgatctggttgctgacattatgctcggctagtccagtattccaaaggtgtttccaagatggagctatagtgaagcaaaatccatcaaaggaagcagtgacagaagtttgccttaaagatgatgtaagtatgattaagactgagacaaaatatgtgaaaaacacaactggtacatttgccaacaacattgcaatgaggaaatggttagttgcagattggcatgattgcagacctcagaaatcatctggtggccatatcaatgttatcgaagtaggagatgatctatcactgcatacagaatcgtacatttgtagtgcagattgtgtgatcacagtggacaaagaaacagctcagatccgtttgcagacagacaacacaaaccactttgaggttgctgggacaactgtgaaatctggatggtttaaaagcacaacgtatataacattggatcaaacttgtgagcatttaaaagtatcatgtggccctaagtcaatacagttccatgcatgctttaaccaacatatgtcttgtgtacgattcttgcataggacaatactcccagggtcaattgcaaattctatatgccaaaatatagaaataataatcttagttacgctgtcattagtaatattcatattcttgactatagtaagtaagacatatatctgttacttattaatgcccatatttatcccaatagcttttatctacggatggatctataataagtcatgtaaaaaatgtaaactttgtggtttagtctatcacccgtttactgaatgcggcacacactgtgtttgtggtgcaagatatgaaacatcggacagaatgaaactgcatagagcatctggtttatgtccaggatacaaaagtctcagagctgctagagtaatgtgcaaatctaaaggcccagcatcaattttatccattttaacagcaatattaatactaacatttgtcacacctatcagtgcaatggtcgttggtgaatcaaatgagatctacaccttagacgacttacctgatgacatggttcagatggcagaaaggataaacatttactaccagatactcataattaattatggggtgacatgggctttcttattgcttggtttagttttagcatacttcttcaaaaaatatcaacataaattcttagattattatgcaatgtactgtgaggagtgtgacatgtaccatgaaaaatcaggtatgacatattggggggattttacaaataagtgtaggcaatgcacatgtgggcaatttgaagatgccactggcttgatggtgcataaaaaatcttacaactgtcttgtaaaatataaggcaaaatggataagaaacattttaattgcatatttgatgataatgttggttaaagattcgctattatttgttggtgcaacaagagctgactttgcatcatgtgtggatgagaaaactgtaacgtggaattgcactgggccatttctgaatctgggtcgatgtgacaaaactcaaaaaaagacaggctataaagacatagctaatcaattgaagggtctgggtgtgatttctatactggatattccgatgattgagaagatgccagatgaaatctcaggatctttaaaatatattgacagtttagaaacatatcatgagcagctgaccgcagaatatgcattcctcaccaggtattgtgattactacacacaatatactgacaattcaggttatagccaaacagtatggcgaacctatttacgatcacatgattttggtgcatgtgttgtgtatccaaaccaacatttttgcagatgtgtaaaatatgatgataaatgtaacagtgctaaatgggattttgctaacgagatgaagacattttacactggccggaaagtaaaattcaataaagatttaaatttagcattactagtgctacataaggcatttaggggtacaggaactgcatatattgcagaagctatggcccgaaaagacaatggttcaatggcacattttgctttagaaattaggaagaagttcccaacaaatgctctactggcagctttaatagactatattgtatatttacagtcacttgcagagatatcaacattcgagctggaagaagattgggaagactttaaatacaaacctgaaccaacagaatctactctacaacctagatctcacagaagtgatcaatataattttaaaaatgcagatagcaatagcaatgtcaaagtctgtaaaaatgtcaaaaaagtattgtgtgtctcacctagatctagagctaaatttgagaatataatagcttgtggagagcatgccaatccatctgtatatatgatgcctaatatcagtatctatcaatccaattctgaaaggagtcattactgtattgcagactcacactgtcttgaggagtatgaaattgtgaacacagagctcttgacagcactaaagaaatctagatgctgggctaaggagatggatgatgtcgtactacataaacagagtgatgggttaagaagttgcagaattaaagatactgggagttgtaatgtattgggcaatgactggaccatagttttatgtgaaaatgggaattactattattcggaaattcataaagattacgacaaagatcaagatgtcgggcatttctgtctaagtcctagatgcagtacaatacgctatccaattaataggagacatattaggaaatgtgactggcagatctcacattcaacaatcgacaaaatttcggtgcaagagctagctgatatagaacaatacaaaaaagctatatcacaaaaattgcagacaagtttgtcgatatttaagtatgtcaaaactaaaaaccttccacatattaaacctgcttataagtatattaccgtagaggggactgagaccatcgaagggatagaaaatgcctttatagagtctgagattcctgcacttgctggaacagctattggatttaaaataaattcaagagagggtaattacttaatggatgttattggttatgttaaaagtgcatcttattcagcaacatatacaaaattgtatacaaccgggccaactataggaataaatactagacatgatgaaaaatgcacaggtccttgtcctgttactatagaccacaaagatggctggttaacattttcaaaggagaggaccagcacatggggttgtgaagaatttggatgcttggcagtaagtgacggatgtgtatttgggtcttgtcaagatattatcaaagatgaattagctgtatatagaaagaccacggaagaattgactactgttgaattgtgtctaacattttcagacaagacttattgcactaacttaaatgctataacccctataataacagacaagtttgaagttcaatttaaaacagtcgaatcatacacattgccaagaataatagctgtgaaaaatcatgaaattaaagttgggcaaattaacgatctaggtgtttattcgaaaggatgtgggaatgttcaaaaagtaaatggaacaaattatggcaatggggtaccaaaattcgactacctatgccatttagcaagtagaaaggaagttattttgaggaagtgctttgataatgattatcaggcctgcaaattcctacaaagtcctgcaagctatcgtttagaagaacaccaagggacagttacagtaatagattacaaaaaaatattgggcagcataaagatgaaagccatattaggtgatgtaaaatataaaaattatcaaagcaatatagaaatcaatgcagaaggaacttgtgctggatgtgtaaattgctttgagaatattcattgtgaatttactatacatactacagttgaaacaagttgtcctatagtaacagattgtgtatcatttcatgataggatactgatcactccagatgagcacaagtacgcattgaaaattgtatgccaagataaacctaaagtgtctctaaaattcaaaatttgcaacacaaatattgatgcttctatgacaatagtggactcaaaaccaattttagaacttgcaccagttgatcaaactgcatacattaaagaaaaagatgaaagatgtaaaacttggatgtgcagagtgagagatgaaggcttccaagttatattagaaccattcaagaatctgtttggttcttacatcggaatattttatactggcatactatcagttatatgccttctcatcgtcatttatattgtattacccatttgctttaaattgagggatactttaaagcaacatgaagatgcttataagaaggaaatgaaaataaggtaa

SEQ ID NO: 4222 - RNA, 4335 nt, synthetic construct
  misc_feature 1..4335: note = derived and/or modified CDS sequence (wt) from SORV(SORV-252)__JN815081.1__GP
  source 1..4335: mol_type = other RNA
atggaagtcctgagcttaatctggctattggcagtgtgctcagctaatccagtattccaaaggtgcttccaagatggagctatagtgaagcagaatccatctaaggaagcagtgacagaagtttgtctcaaggatgatgtaagtatgatcaaaactgaagcaaagtatgttaaaaacacaactggaacattttctaataatgtagcaatgaggaaatggctagttgcagactggcatgattgcaggcctcagaagtcttctggtggtcatattaatgttattgaggtaggagatgacctatcattacatacggaatcatatatttgcagtgcagactgtgtaatcacagtggataaagagacagcacaaatccgcctacaaactgatagcactaaccactttgaagttgctggaacaacagtgaagtctgggtggttcaaaagcacaacatatataacattagatcaaacttgtgagcacttgaaagtatcatgtggtcccaaatcaatacaattccatgcctgttttaaccagcatatgtcttgtgtccgctttttacataggacaatacttccaggttcaattgcaaactctatatgtcaaaatatagaaataattatcctggtcacactttcactaataatatttatatttttaactatagtaagtaaaacatatatctgttacttgttaatgcccatatttataccaatagctttcatttatgggtggatttataataagtcatgcaaaaaatgtaaactctgtggtttagtttaccacccattcacagaatgtggaacacactgtgtttgtggtgcacgatatgagacatctgacagaatgaaactacatagagcatctggattatgcccaggatataagagcctcagagctgctagagtgatgtgcaaatccaaaggtccagcatctattttatcaatactgacagcagtattgatactaacattcgtgacacctattagcgccataattattgatgagtcaaaagaaatctataccctagacgatttgcctgatgatatggtccagatggcagaaaggataaatatctactatcaaatactcttgattaattatggagtaacatgggccttcttattattgggcttaatcttagcatatttttttaagaaatatcaacataaatttctagattattatgcaatgtattgtgaagagtgtgatatgtaccatgaaaaatctggcatgacatactggggagatttcacaaataagtgtagacagtgtacatgcggacaatacgaagacgctgctgggctgatggtacataaaaagtcttacaattgtcttataaagtataaggcaaaatggataaaaaatattttgattctatatttaattatgatattagttaaagattccttgttatttgtcggtgcaacaggaaccgattttgcagcatgcattgatgagaagagtgtgacatggaattgcacaggaccattcttgaatctgggccgatgcgacaaacctcagaagaaggcaagctttaaagatatagctaatcaattaaaaggtttaggtgttatctctgtgttggatatcccaatgattgagaagatgcctgatgacatttcaggctctttaaagtacattgacagtttaagaacatatcacgagcaattgactgcagagtatgcatttctcactagatactgtgattattatgctcagtacactgataattcgggttatagccaaacagtatggcggacatatttgcggtcacatgattttggtgcatgtgttgtataccctaaccagcacttctgtagatgtgtgaaatatggtgataaatgtaatagtgcaaaatgggactttgctaatgagatgaaatcattctatactggtcaaaaagctaagtttaataaagacttgaatttagcactattagtattgcacaaggcattcagaggtacagggactgcatatattgcagaaactttagctcggaaagataatggttcaatggtacactttgcattagagattaggaaaaaattcccaactaatgccttacttgcagctttaatagattatattgtatacttacaatcacttgctgagatatctacattcgaaccagaggaggattgggaagattctaaatatcaaccagagcctacagaatctgttctacaacctagggctcacagaagtgatcaatataattttaaaaatgcagatagtaatagtaatgttaaagtgtgtaaaaatataaaaaaggttttatgtatttcacctagatccagagctaaatttgaaaatataattgcttgcggagagcatgccaacccatctgtgtacatgatgcccaatactagtatctaccaatcaaactcagagaggagtcattattgtattgcagattcacattgccttgaagaatatgaaattgtaaacacagagcttctaacagcattcaagaaatccagatgttgggcaaaagagatagatgatattgtgttacacaagcaaagtgatggtttaagaagctgcagaatcaaggacactggaagctgcaatgtgttgggtaatgactggactatagtcctgtgcgaaaatggcaattattattattcagaagtccataaagattatgataaggatcaagatgttggacatttttgcttaagccccaggtgcaacacaatacgatatccaattagtaggagacatattggagagtgtaattggcaaattacacattccacaattgataagatttcggttcaagagctagctgatatagagcaatataaaaaagccatatcacaaaaattgcaaactagtttgtcaatattcaagtatgtcaaaacaaagaatcttcctcatattaaaccagcctacagatatattactgtaggaggtactgaaactatagaaggggtggaaaatgccttcatagaatctgaaattcctgcacttgctggaacagctattggatttaaaataaactcaagagaaggcaattatttgatggatgttataggttatgttaaaagtgcatcttattcagcaacatacacaaaattatatacaactggtccaactataggaataaacactaagcatgatgagaaatgtacaggttcttgcccagttactataaatcataaagatggttggctgacattttcaaaagaaagaaccagcacatggggttgtgaagaatttggctgtctagcagttagcgatgggtgtgtgtttggttcttgtcaagatattataaaagatgagttagccgtatacaggaaaaccacagaagaattaactactgttgagttgtgtttgacgttttcagataagacttattgtaccgatttaaatgctataacccctataataacagataagtttgaggttcaatttaagacagtagaatcatatacattgccaaggataatagctgtaaagaaccatgaaataagaactgggcagatcaatgacctaggtgtttattcaaaaggttgcggaaatgttcagaaagtaaatggaacaagttatggtaatggtgtgccaaaatttgattatctatgccatttggcaagtagaaaagaggtcattttgagaaagtgctttgataatgattaccaagcctgcaaattcttacaaagtcctgcaagttatcgcctagaagaacatcaagggacagtcacagtaatagattataaaaaaatactaggtagtataaagatgaaagccatgttaggtgatgtaaaatacaaaaattatcaaagcaatatagagataaatgcagaagggacttgtgcaggatgtatagattgttttgagaatatccattgtgaatttacaatacataccactgttgaagcaagctgtcctataacgacagattgtgtttcattccatgatagaatactaataaccccagaagaacataaatatgcattaaagatagtatgtcaagataagcccaaagtatcgttaaaattcaagatttgcaacacaaacgttgaagcatcaatgacaataatagattcaaaaccgattctagaacttgcaccagttgatcagactacgtatattaaagaaaaagatgaaagatgtaagacctggatgtgtagggtgagggatgaaggtttccaagttatactagaacctttcaaaaatttgtttggctcttacatcggaatattctatacaggagtattatcaattatatgtctcctcattgtcatctatataatattacctatttgctacaagttgagagatacactaaaacagcatgaagatgcttataaaaaagaaatgaaaataagatag

SEQ ID NO: 4223 - RNA, 4335 nt, synthetic construct
  misc_feature 1..4335: note = derived and/or modified CDS sequence (wt) from SORV(NJO-94F)__KX817337.1__GP
  source 1..4335: mol_type = other RNA
atggaagtcctaagcttgatctggttgctgacattatgctcggctagtccagtattccaaaggtgtttccaagatggagctatagtgaagcaaaatccatcaaaggaagcagtgacagaagtttgccttaaagatgatgtaagtatgattaagactgagacaaaatatgtgaaaaacacaactggtacatttgccaacaacattgcaatgaggaaatggttagttgcagattggcatgattgcagacctcagaaatcatctggtggccatatcaatgttatcgaagtaggagatgatctatcactgcatacagaatcgtacatttgtagtgcagattgtgtgatcacagtggacaaagaaacagctcagatccgtttgcagacagacaacacaaaccactttgaggttgctgggacaactgtgaaatctggatggtttaaaagcacaacgtatataacattggatcaaacttgtgagcatttaaaagtatcatgtggccctaagtcaatacagttccatgcatgctttaaccaacatatgtcttgtgtacgattcttgcataggacaatactcccagggtcaattgcaaattctatatgccaaaatatagaaataataatcttagttacgctgtcattagtaatattcatattcttgactatagtaagtaagacatatatctgttacttattaatgcccatatttatcccaatagcttttatctacggatggatctataataagtcatgtaaaaaatgtaaactttgtggtttagtctatcacccgtttactgaatgcggcacacactgtgtttgtggtgcaagatatgaaacatcggacagaatgaaactgcatagagcatctggtttatgtccaggatacaaaagtctcagagctgctagagtaatgtgcaaatctaaaggcccagcatcaattttatccattttaacagcaatattaatactaacatttgtcacacctatcagtgcaatggtcgttggtgaatcaaatgagatctacaccttagacgacttacctgatgacatggttcagatggcagaaaggataaacatttactaccagatactcataattaattatggggtgacatgggctttcttattgcttggtttagttttagcatacttcttcaaaaaatatcaacataaattcttagattattatgcaatgtactgtgaggagtgtgacatgtaccatgaaaaatcaggtatgacatattggggggattttacaaataagtgtaggcaatgcacatgtgggcaatttgaagatgccactggcttgatggtgcataaaaaatcttacaactgtcttgtaaaatataaggcaaaatggataagaaacattttaattgcatatttgatgataatgttggttaaagattcgctattatttgttggtgcaacaagagctgactttgcatcatgtgtggatgagaaaactgtaacgtggaattgcactgggccatttctgaatctgggtcgatgtgacaaaactcaaaaaaagacaggctataaagacatagctaatcaattgaagggtctgggtgtgatttctatactggatattccgatgattgagaagatgccagatgaaatctcaggatctttaaaatatattgacagtttagaaacatatcatgagcagctgaccgcagaatatgcattcctcaccaggtattgtgattactacacacaatatactgacaattcaggttatagccaaacagtatggcgaacctatttacgatcacatgattttggtgcatgtgttgtgtatccaaaccaacatttttgcagatgtgtaaaatatggtgataaatgtaacagtgctaaatgggattttgctaacgagatgaagacattttacactggccggaaagtaaaattcaataaagatttaaatttagcattactagtgctacataaggcatttaggggtacaggaactgcatatattgcagaagctatggcccgaaaagacaatggttcaatggcacattttgctttagaaattaggaagaagttcccaacaaatgctctactggcagctttaatagactatattgtatatttacagtcacttgcagagatatcaacattcgagctggaagaagattgggaagactttaaatacaaacctgaaccaacagaatctactctacaacctagatctcacagaagtgatcaatataattttaaaaatgcagatagcaatagcaatgtcaaagtctgtaaaaatgtcaaaaaagtattgtgtgtctcacctagatctagagctaaatttgagaatataatagcttgtggagagcatgccaatccatctgtatatatgatgcctaatatcagtatctatcaatccaattctgaaaggagtcattactgtattgcagactcacactgtcttgaggagtatgaaattgtgaacacagagctcttgacagcactaaagaaatctagatgctgggctaaggagatggatgatgtcgtactacataaacagagtgatgggttaagaagttgcagaattaaagatactgggagttgtaatgtattgggcaatgactggaccatagttttatgtgaaaatgggaattactattattcggaaattcataaagattacgacaaagatcaagatgtcgggcatttctgtctaagtcctagatgcagtacaatacgctatccaattaataggagacatattaggaaatgtgactggcagatctcacattcaacaatcgacaaaatttcggtgcaagagctagctgatatagaacaatacaaaaaagctatatcacaaaaattgcagacaagtttgtcgatatttaagtatgtcaaaactaaaaaccttccacatattaaacctgcttataagtatattaccgtagaggggactgagaccatcgaagggatagaaaatgcctttatagagtctgagattcctgcacttgctggaacagctattggatttaaaataaattcaagagagggtaattacttaatggatgttattggttatgttaaaagtgcatcttattcagcaacatatacaaaattgtatacaaccgggccaactataggaataaatactagacatgatgaaaaatgcacaggtccttgtcctgttactatagaccacaaagatggctggttaacattttcaaaggagaggaccagcacatggggttgtgaagaatttggatgcttggcagtaagtgacggatgtgtatttgggtcttgtcaagatattatcaaagatgaattagctgtatatagaaagaccacggaagaattgactactgttgaattgtgtctaacattttcagacaagacttattgcactaacttaaatgctataacccctataataacagacaagtttgaagttcaatttaaaacagtcgaatcatacacattgccaagaataatagctgtgaaaaatcatgaaattaaagttgggcaaattaacgatctaggtgtttattcgaaaggatgtgggaatgttcaaaaagtaaatggaacaaattatggcaatggggtaccaaaattcgactacctatgccatttagcaagtagaaaggaagttattttgaggaagtgctttgataatgattatcaggcctgcaaattcctacaaagtcctgcaagctatcgtttagaagaacaccaagggacagttacagtaatagattacaaaaaaatattgggcagcataaagatgaaagccatattaggtgatgtaaaatataaaaattatcaaagcaatatagaaatcaatgcagaaggaacttgtgctggatgtgtaaattgctttgagaatattcattgtgaatttactatacatactacagttgaaacaagttgtcctatagtaacagattgtgtatcatttcatgataggatactgatcactccagatgagcacaagtacgcattgaaaattgtatgccaagataaacctaaagtgtctctaaaattcaaaatttgcaacacaaatattgatgcttctatgacaatagtggactcaaaaccaattttagaacttgcaccagttgatcaaactgcatacattaaagaaaaagatgaaagatgtaaaacttggatgtgcagagtgagagatgaaggcttccaagttatattagaaccattcaagaatctgtttggttcttacatcggaatattttatactggcatactatcagttatatgccttctcatcgtcatttatattgtattacccatttgctttaaattgagggatactttaaagcaacatgaagatgcttataagaaggaaatgaaaataaggtaa

SEQ ID NO: 4224 - RNA, 4323 nt, synthetic construct
  misc_feature 1..4323: note = derived and/or modified CDS sequence (wt) from TAHV__AF123485.1__GP
  source 1..4323: mol_type = other RNA
atgatgttcgtattgtttttcattgcactaagtgctgcaagcccagtttatcagaggtgtttccaggatggtgcaatcgtcaagcaaaacccatccaaacaggctgtaacagaggtatgcctaaaggatgacgttagtatgataaaaacagaagctagatatttcagaaatgctaccggaacatatgccaacaatgttgccattagaaagtggctagtctcagattggcatgactgcagaccaaaaaaagtctcagggggtcacataaatgttatagaagttggagatgacttaacgctgcatacagaggcatatgtatgcaatgcagactgcacaataggtgtagataaagaaaccgcacaagtaagattgcaaacagatacaacaaatcattttgagatagcaggaacaacagttaagtcagggtggttcaaaagcacaacttatatcacccttgatcaaacttgcgagcatttgaaagtttcttgtgggcctaaatctatacagttccatgcgtgtttcaatcaacacatgtcttgtgttagattcttacataggacaatcctacctgggtctattgccagctccatatgccaaaatgtagagataataatattaacagtgctaaccctccttatatttatactattaagcatactgagcaaaacttacatatgttatatactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcggataggatgaaattgcacagggcatctgggttgtgcccaggttataaaagtctcagggctgcaagagtcatgtgcaaatccaaagggccagcttctattttatctataatcactgcagtgttaatccttacttttgtcactcccataaatgccatggtagctggggacacccaagaaacatttaagcttgaggacctaccagatgacatgctaagcatggcaatgaaagtaaatatgtactacattatgtgtatgataaattatgctgtgacttggtcatttattttatgcgccctattaattgctttactcttcaagaagtatcagcatagattcttaaacttttatgccatgtactgccacgagtgcgatatgtaccatgatagatctggcctaaaatataatggagacttcacaaacaaatgtagacagtgcacatgcgggcagtacgaagatgccgcaggtctactaacccacagaaaaacatacaactgcctcgtgcagtacaaatcaaaatggctgactaatttcttaattgtatacataatcttgatgcttattaaagattctgtactaatagtgcatgctgatggcacagactttgaaaaatgcagtggtgaggtggatataacatggaattgtacaggaccattcttgaatctaggtaattgtgagaagaagcaaaagaaggagtcatataataatatagcaactcaattaaaagggctagatgccatatcggttttagatatccccatgatatctaaaataccagaggatatagctggagccctaagattcattgaagagcaaagatcataccatgtccaactgactgcagaatatgctatgctaactagatactgcgattattacacccaattcactgacaattctggatacagtcaaaccacatggagggtttacttgagatcccacgattttaaggcatgtattttatatcccaatcagcatttttgcagatgtgtcaagcatggggacaaatgctcaagctccaattgggatttcgccaatgagatgaagaactactacagtggaaaacagtccaaatttgataaagatttaaatttagcattgatgtccttacaccacgcatttagaggaacatctagtttttatattgctaaactcctgaaggaaaagaaaaatgaagaccttgtaacttatgcagaaaagattaaaggcaaatatccaggcaatgccctgctaaaggcaataattgactacataaagtatatggaggatttaaccgagatgaacaatttcaaacatgatgagatgtgggatgacttcatatttgaagttcctcctacaaagagcccatcaataagaagattagagtcttcatatgattttaaaactaatgtaaattcaaacccatcacacatttgcaagaatatcaaaactgtggtctgcttgtcaccaaagtcaggagtgtcatatgattcaataattgcctgtggggagccaagccagccaagcatttacagaaagccagacagccaagttttccaatcaaatgctgaccagacacatttttgtttatcagatacacactgcctggaaaattatgagacagttggagaggaaatcattgatgcaattaaaaaatcgaaatgctgggaaacagaatttactgagtacatccaatttaaacagagtgatggggtaaggagttgcaggatgaaagactcaggagaatgtacagtcaccaccaatagatggcctataatactctgcgataacgataaattctactactctgagttgcagaaagattatgataaggaccaggatataggtcacttctgtctcagcccaagatgcaacacaattaggcaccctataaatcggaaacatatatcaaattgtacgtggcaggttagtcacaacaatatagacaagattgaggtacatgaactggaggatcttgaacagtataagaaggccataacacagaagttgcagacaagcctaactctatttaaatactcaaagacaaaaaacttgccccatatcaagcctatgtacaaatatataacaattgaaggaacagagactgctgagggtttagaaagtgcttatatagaatcagagatacccgctctagcaggaacatcaataggtttcaagatcacatccaagtctggaaagcatttattagatgtcattggttatgttaagagcgcatcttattcggccgtttatacaaaattgtatacaacaggacctactataggtgttaacactaaacatgatgaattatgcacagggccatgtcctgtcaatgtgcctcatggcacaggttggctcacatttgctaaggagaggacaagctcctgggggtgtgaagaatttggctgcctggcaattagcgatgggtgtgtttttggttcctgtcaagatattataaaagatgaaataactgtctataggaaggagactgaggagaccacagatgtggaattgtgcctgacatttgcagacaaaacatattgcactaacctcaatgcaattacccctataatcaccgaccagtttgaagtccaatttaaaactgtagaggcttacagtctgcctagaatcattgcagtgcggaatcatgagattatggttgggcaaataaatgacataggtgtttactcaaaaggctgtggaaatgtacagaaagtaaacaacacaaattatggaaatggtgtgcctaagtttgattacctgtgtcatttagcaagtagaaaagaagtgatagtgaggaaatgctttgataatgactaccaggcctgcaaatttctacaaacaccagcaagttataggctagaagaggagggaggttcagttacagtcatagactacaagaaaatccttggcactataaagatgaaggctatccttggagatgtgaaatataaaacatttgcagacaatgtggacctaaccgttgagggggtatgcactggctgcatcaattgttttgaaaatatacattgtgagttaacaatacacagtacagttgaagccagctgcccggtagtaagttcgtgtacagtatttcatgatagaattttaataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaagatgaaaggtgcaagacttggatgtgcagagtaagagatgaaggttttcaagtaatttttgaaccattcaaaaacttatttggttcttatattgggatattttatacatttataatatctttaatggcaatatttatagttatatatattgtgttgcctatatgtttcaaactcagagacacactgaggcagcatgaagacgcttataagagagagatgaaaattaggtaa

SEQ ID NO: 4225 - RNA, 4323 nt, synthetic construct
  misc_feature 1..4323: note = derived and/or modified CDS sequence (wt) from TAHV__AF229129.1__GP
  source 1..4323: mol_type = other RNA
atgatgttcgtattgtttttcattgcactaagtgctgcaagcccagtttatcagaggtgtttccaggatggtgcaatcgtcaagcaaaacccatccaaacaggctgtaacagaggtatgcctaaaggatgacgttagtatgataaaaacagaagctagatatttcagaaatgctaccggaacatatgccaacaatgttgccattagaaagtggcttgtctcagattggcatgactgcagaccaaaaaaagtctcagggggtcatataaatgttatagaagttggagatgacttaacgctgcatacagaggcatatgtatgcaatgcagactgcacaataggtgtagataaagaaaccgcacaagtaagattgcaaacagatacaacaaatcattttgagattgcaggaacaacagttaagtcagggtggttcaaaagcacaacttatatcacccttgatcaaacttgcgagcatttgaaagtttcttgtgggcctaaatctatacagttccatgcgtgtttcaatcaacatatgtcttgtgttagattcttacataggacaatcctacctgggtctattgccagctccatatgccaaaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcggataggatgaaattgcacagggcatctgggttgtgtccaggttataaaagtctcagggctgcaagagtcatgtgcaaatccaaagggccagcttctattttatctataatcactgcagtgttaatccttacttttgtcactcccataaatgccatggtagctggggacacacaagaaacatttaagcttgaggacctaccagatgacatgctgagcatggcaatgaaagtaaatatgtactacattatgtgtatgataaattatgctgtaacttggtcatttattttatgcgccctattaattgctttactcttcaagaagtatcagcatagattcttaaacttttatgccatgtactgccacgagtgcgatatgtaccatgatagatctggcctaaaatataatggagacttcacaaacaaatgtagacagtgcacatgcgggcagtacggagatgccgcaggtctactaacccacagaaaaacatacaactgcctcgtgcagtacaaatcaaaatggctgactaatttcttaattggatacataatcttgatgcttattaaagattctgtactactagtgcatgctgatggcacagactttgaaaaatgcagtggtgaggcggatataacatggaattgtacaggaccattcttgagtctaggtaattgtgagaagaagcaaaagaaggagtcatataataatatagcaactcaactaaaagggctagatgccatatcggttttagatatccccatgatatctaaaataccagaggatatagctggagccctaagattcattgaagagcaaagatcataccatgtccaactgactgcagaatatgctatgctaactagatactgcgattattatacccaattcactgacaattctggatacagtcagaccacatggagggtttacttgagatcccacgattttgaggcatgtattttatatcccaatcggcatttttgcagatgtgtcaagcatggggacaaatgctcaagctccaattgggatttcgccaatgagatgaagaactattacagtggaaaacagtccaaatttaataaggatttaaatttagcattgatgtccttacaccacgcatttagaggaacatctagtttttatattgctaaactcctgaaggaaaagaaaaatgaagaccttgtaacttatgcagaaaagattaaaggcaaatatccaggcaatgccctgctaaaggcaataattgactacataaagtatatgaagggtttaaccgagatgaacaatttcaaacatgatgagatgtgggatgacttcatatttgaagttcctcctacaaagagcccatcagtaagaagattagagtcttcatatgattttaaaactaatgtaaattcaaacccatcacacatttgcaagaatatcaaaactgtggtctgcttgtcaccaaagtcaggagtgtcatatgattcaataattgcctgtggggagccaagccagccaagcatctacagaaagccagacagtcaagttttccaatcaaatgctgaccagacacatttttgtttatcagatacacactgcctggaaaattatgagacagttggagaggaaatcattgatgcaattaaaaaatcgaaatgctgggaaacagaatttactgagtacacccaacttaaacagagtgatggggtaaggagttgcaggatgaaagactcaggagaatgtacagtcaccaccaatagatggcctataatactctgcgataacgataaattctactactctgagttgcagaaagattatgataaggaccaggatataggtcacttctgtctcagcccaagatgcaacacaattaggcaccctataaatcggaaacatatatcaaattgtacgtggcaggttaatcacaacaatatagacaagattgaggtacatgaactggaggatcttgaacagtataagaaggccataacacagaagttgcagacaagcctaaccctatttaaatactcaaagacaaaaaacttgccccatatcaagcctatgtacaaatatataacaattgaaggaacagagactgctgagggtatagaaagtgcttatatagaatcagagatacccgctctagcaggaacatcaataggtttcaagatcacatccaagtctggaaagcatttattagatgtcattggttatgttaagagcgcatcttattcggccgtttatacaaaattgtatacaacaggacctactataggtgttaacactaaacatgatgaattatgcacagggccatgtcctgtcaatgtgcctcatggcacaggttggctcacatttgctaaggagaggacaagctcctgggggtgtgaagaatttggctgcctggcaattagcgatgggtgtgtttttggttcctgtcaagatattataaaagatgaaataactgtctataggaaggagactgaggagaccacagatgtggaattgtgcctgacatttgcagacaaaacatattgcactaacctcaatgcaattacccctataatcaccgaccagtttgaagtccaatttaaaactgtagaggcttacagtctgcctagaatcattgcagtgcggaatcatgagattatggttgggcaaataaatgacataggtgtttactcaaaaggctgtggaaatgtacagaaagtaaacaacacaaattatggaaatggtgcacctaagtttgattacctgtgtcatttagcaagtagaaaagaagtgatagtgaggaaatgctttgataatgactaccaggcctgcaaatttctacaaacaccagcaagttataggctagaagaagagggaggttcagttacagtcatagactacaagaaaatccttggcactataaagatgaaggctatccttggagatgtgaaatataaaacatttgcagacaatgtggacttaaccgttgagggggtatgcactggctgcgtcaattgttttgaaaatatacattgtgagtcaacaatacacagtacagttgaagccagctgcccggtaataagttcgtgtacagtatttcatgatagaattttaataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaagttgaaaggtgcaagacttggatgtgcagagtaagagatgaaggttttcaagtaatttttgaaccattcaaaaacttatttggttcttatattgggatattttatacatttataatatctttaatggcaatatttatagttatatatattgtgttgcctatatgtttcaaacttagagacacactgaggcagcatgaagacgcttataagagagagatgaaaattaggtaa

SEQ ID NO: 4226 - RNA, 4323 nt, synthetic construct
  misc_feature 1..4323: note = derived and/or modified CDS sequence (wt) from TAHV(22595-6)__HM036218.1__GP
  source 1..4323: mol_type = other RNA
atgatgttcgtattgtttttcattgcactaagtgctgcaagcccagtttatcagaggtgtttccaggatggtgcaatcgtcaagcaaaacccatccaaacaggctgtaacagaggtatgcctaaaggatgacgttagtatgataaaaacagaagctagatatttcagaaatgctaccggaacatatgccaacaatgttgccattagaaagtggctagtctcagattggcatgactgcagaccaaaaaaagtctcagggggtcacataaatgttatagaagttggagatgacttaacgctgcatacagaggcatatgtatgcaatgcagactgcacaataggtgtagataaagaaaccgcacaagtaagattgcaaacagatacaacaaatcattttgagatagcaggaacaacagttaagtcagggtggttcaaaagcacaacttatatcacccttgatcaaacttgcgagcatttgaaagtttcttgtgggcctaaatctatacagttccatgcgtgtttcaatcaacacatgtcttgtgttagattcttacataggacaatcctacctgggtctattgccagctccatatgccaaaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcggataggatgaaattgcacagggcatctgggttgtgcccaggttataaaagtctcagggctgcaagagtcatgtgcaaatccaaagggccagcttctattttatctataatcactgcagtgttaatccttacttttgtcactcccataaatgccatggtagctggggacacccaagaaacatttaagcttgaggacctaccagatgacatgctaagcatggcaatgaaagtaaatatgtactacattatgtgtatgataaattatgctgtgacttggtcatttattttatgcgccctattaattgctttactcttcaagaagtatcagcatagattcttaaacttttatgccatgtactgccacgagtgcgatatgtaccatgatagatctggcctaaaatataatggagacttcacaaacaaatgtagacagtgcacatgcgggcagtacgaagatgccgcaggtctactaacccacagaaaaacatacaactgcctcgtgcagtacaaatcaaaatggctgactaatttcttaattgtatacataatcttgatgcttattaaagattctgtactaatagtgcatgctgatggcacagactttgaaaaatgcagtggtgaggcggatataacatggaattgtacaggaccattcttgaatctaggtaattgtgagaagaagcaaaagaaggagtcatataataatatagcaactcaattaaaagggctagatgccatatcggttttagatatccccatgatatctaaaataccagaggatatagctggagccctaagattcattgaagagcaaagatcataccatgtccaactgactgcagaatatgctatgctaactagatactgcgattattacacccaattcactgacaattctggatacagtcaaaccacattgagggtttacttgagatcccacgattttaaggcatgtattttatatcccaatcagcatttttgcagatgtgtcaagcatggggacaaatgctcaagctccaattgggatttcgccaatgagatgaagaactactacagtggaaaacagtccaaatttgataaagatttaaatttagcattgatgtccttacaccacgcatttagaggaacatctagtttttatattgctaaactcctgaaggaaaagaaaaatgaagaccttgtaacttatgcagaaaagattaaaggcaaatatccaggcaatgccctgctaaaggcaataattgactacataaagtatatggaggatttaaccgagatgaacaatttcaaacatgatgagatgtgggatgacttcatatttgaagttcctcctacaaagagcccatcaataagaagattagagtcttcatatgattttaaaactaatgtaaattcaaacccatcacacatttgcaagaatatcaaaactgtggtctgcttgtcaccaaagtcaggagtgtcatatgattcaataattgcctgtggggagccaagccagccaagcatctacagaaagccagacagccaagttttccaatcaaatgctgaccagacacatttttgtttatcagatacacactgcctggaaaattatgagacagttggagaggaaatcattgatgcaattaaaaaatcggaatgctgggaaacagaatttactgagtacatccaatttaaacagagtgatggggtaaggagttgcaggatgaaagactcaggagaatgtacagtcaccaccaatagatggcctataatactctgcgataacgataaattctactactctgagttgcagaaagattatgataaggaccaggatataggtcacttctgtctcagcccaagatgcaacacaattaggcaccctataaatcggaaacatatatcaaattgtacgtggcaggttagtcacaacaatatagacaagattgaggtacatgaactggaggatcttgaacagtataagaaggccataacacagaagttgcagacaagcctaactctatttaaatactcaaagacaaaaaacttgccccatatcaagcctatgtacaaatatataacaattgaaggaacagagactgctgagggtatagaaagtgcttatatagaatcagagatacccgctctagcaggaacatcaataggtttcaagatcacatccaagtctggaaagcatttattagatgtcattggttatgttaagagcgcatcttattcggccgtttatacaaaattgtatacaacaggacctactataggtgttaacactaaacatgatgaattatgcacagggccatgtcctgtcaatgtgcctcatggcacaggttggctcacatttgctaaggagaggacaagctcctgggggtgtgaagaatttggctgcctggcaattagcgatgggtgtgtttttggttcctgtcaagatattataaaagatgaaataactgtctataggaaggagactgaggagaccacagatgtggaattgtgcctgacatttgcagacaaaacatattgcactaacctcaatgcaattacccctataatcaccgaccagtttgaagtccaatttaaaactgtagaggcttacagtctgcctagaatcattgcagtgcggaatcatgagattatggttgggcaaataaatgacataggtgtttactcaaaaggctgtggaaatgtacagaaagtaaacaacacaaattatggaaatggtgtgcctaagtttgattacctgtgtcatttagcaagtagaaaagaagtgatagtgaggaaatgctttgataatgactaccaggcctgcaaatttctacaaacaccagcaagttataggctagaagaggagggaggttcagttacagtcatagactacaagaaaatccttggcactataaagatgaaggctatccttggagatgtgaaatataaaacatttgcagacaatgtggacctaaccgttgagggggtatgcactggctgcatcaattgttttgaaaatatacattgtgagttaacaatacacagtacagttgaagccagctgcccggtagtaagttcgtgtacagtatttcatgatagaattttaataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaagatgaaaggtgcaagacttggatgtgcagagtaagagatgaaggttttcaagtaatttttgaaccattcaaaaacttatttggttcttatattgggatattttatacatttataatatctttaatggcaatatttatagttatatatattgtgttgcctatatgtttcaaactcagagacacactgaggcagcatgaagacgcttataagagagagatgaaaattaggtaa

SEQ ID NO: 4227 - RNA, 4323 nt, synthetic construct
  misc_feature 1..4323: note = derived and/or modified CDS sequence (wt) from TAHV(92' Bardos)__HM036209.1__GP
  source 1..4323: mol_type = other RNA
atgatgttcgtattgtttttcattgcactaagtgctgcaagcccagtttatcagaggtgtttccaggatggtgcaatcgtcaagcaaaacccatccaaacaggctgtaacagaggtatgcctaaaggatgacgttagtatgataaaaacagaagctagatatttcagaaatgctaccggaacatatgccaacaatgttgccattagaaagtggctagtctcagattggcatgactgcagaccaaaaaaagtctcagggggtcacataaatgttatagaagttggagatgacttaacgctgcatacagaggcatatgtatgcaatgcagactgcacaataggtgtagataaagaaaccgcacaagtaagattgcaaacagatacaacaaatcattttgagatagcaggaacaacagttaagtcagggtggttcaaaagcacaacttatatcacccttgatcaaacttgcgagcatttgaaagtttcttgtgggcctaaatctatacagttccatgcgtgtttcaatcaacacatgtcttgtgttagattcttacataggacaatcctacctgggtctattgccagctccatatgccaaaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcggataggatgaaattgcacagggcatctgggttgtgcccaggttataaaagtctcagggctgcaagagtcatgtgcaaatccaaagggccagcttctattttatctataatcactgcagtgttaatccttacttttgtcactcccataaatgccatggtagctggggacacccaagaaacatttaagcttgaggacctaccagataacatgctaagcatggcaatgaaagtaaatatgtactacattatgtgtatgataaattatgctgtgacttggtcatttattttatgcgccctattaattgctttactcttcaagaagtatcagcatagattcttaaacttttatgccatgtactgccacgagtgcgatatgtaccatgatagatctggcctaaaatataatgaagacttcacaaacaaatgtagacagtgcacatgcgggcagtacgaagatgccgcaggtctactaacccacagaaaaacatacaactgcctcgtgcagtacaaatcaaaatggctgactaatttcttaattgtatacataatcttgatgcttattaaagattctgtactaatagtgcatgctgatggcacagactttgaaaaatgcagtggtgaggcggatataacatggaattgtacaggaccattcttgaatctaggtaattgtgagaagaagcaaaagaaggagtcatataataatatagcaactcaattaaaagggctagatgccatatcggttttagatatctccatgatatctaaaataccagaggatatagctggagccctaagattcattgaagagcaaagatcataccatgtccaactgactgcagaatatgctatgctaactagatactgcgattattacacccaattcactgacaattctggatacagtcaaaccacatggagggtttacttgagatcccacgattttgaggcatgcattttatatcccaatcagcatttttgcagatgtgtcaagcatggggacaaatgctcaagctccaattgggatttcgccaatgagatgaagaacttctacagtggaaaacagtccaaatttgataaagatttaaatttagcattgatgtccttacaccacgcatttagaggaacatctagtttttatattgctaaactcctgaaggaaaagaaaaatgaagaccttgtaacttatgcagaaaagattaaaggcaaatatccaggcaatgccctgctaaaggcaataattgactacataaagtatatggaggatttaaccgagatgaacaatttcaaatatgatgagatgtgggatgacttcatatttgaagttcctcctacaaagagcccatcaataagaagattagagtcttcatatgattttaaaactaatgtaaattcaaacccatcacacatttgcaagaatatcaaaactgtggtctgcttgtcaccaaagtcaggagtgtcatatgattcaataattgcctgtggggagccaagccagccaagcatctacagaaagccagacagccaagttttccaatcaaatgctgaccagacacatttttgtttatcagatacacactgcctagaaaattatgagacagttggagaggaaatcattgatgcaattaaaaaatcgaaatgctgggaaacagaatttactgagtacatccaatttaaacagagtgatggggtaaggagttgcaggatgaaagactcaggagaatgtacagtcaccaccaatagatggcctataatactctgcgataacgataaattctactactctgagttgcagaaagattatgataaggaccaggatataggtcacttctgtctcagcccaagatgcaacacaattaggcaccctataaatcggaaacatatatcaaattgtacgtggcaggttagtcacaacaatatagacaagattgaggtacatgaactggaggatcttgaacagtataagaaggccataacacagaagttgcagacaagcctaactctatttaaatactcaaagacaaaaaacttgccccatatcaagcctatgtacaaatatataacaattgaaggaacagagactgctgagggtatagaaagtgcttatatagaatcagagatacccgctctagcaggaacatcaataggtttcaagatcacatccaagtctggaaagcatttattagatgtcattggttatgttaagagcgcatcttattcggccgtttatacaaaattgtatacaacaggacctactataggtgttaacactaaacatgatgaattatgcacagggccatgtcctgtcaatgtgcctcatggcacaggttggctcacatttgctaaggagaggacaagctcctgggggtgtgaagaatttggctgcctggcaattagcgatgggtgtgtttttggttcctgtcaagatattataaaagatgaaataactgtctataggaaggagactgaggagaccacagatgtggaattgtgcctgacatttgcagacaaaacatattgcactaacctcaatgcaattacccctataatcaccgaccagtttgaagtccaatttaaaactgtagaggcttacagtctgcctagaatcattgcagtgcggaatcatgagattatggttgggcaaataaatgacataggtgtttactcaaaaggctgtggaaatgtacagaaagtaaacaacacaaattatggaaatggtgtgcctaagtttgattacctgtgtcatttagcaagtagaaaagaagtgatagtgaggaaatgctttgataatgactaccaggcctgcaaatttctacaaacaccagcaagttataggctagaagaggagggaggttcagttacagtcatagactacaagaaaatccttggcactataaagatgaaggctatccttggagatgtgaaatataaaacatttgcagacaatgtggacctaaccgttgagggggtatgcactggctgcatcaattgttttgaaaatatacattgtgagttaacaatacacagtacagttgaagccagctgcccggtagtaagttcgtgtacagtatttcatgatagaattttaataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaagatgaaaggtgcaagacttggatgtgcagagtaagagatgaaggttttcaagtaatttttgaaccattcaaaaacttatttggttcttatattgggatattttatacatttataatatctttaatggcaatatttatagttatatatattgtgttgcctatatgtttcaaactcagagacacactgaggcagcatgaagacgcttataagagagagatgaaaattaggtaa

SEQ ID NO: 4228 - RNA, 4323 nt, synthetic construct
  misc_feature 1..4323: note = derived and/or modified CDS sequence (wt) from TAHV(92' Bardos)__HM036212.1__GP
  source 1..4323: mol_type = other RNA
atgatgttcgtattgtttttcattgcactaagtgctgcaagcccagtttatcagaggtgtttccaggatggtgcaatcgtcaagcaaaacccatccaaacaggctgtaacagaggtatgcctaaaggatgacgttagtatgataaaaacagaagctagatatttcagaaatgctaccggaacatatgccaacaatgttgccattagaaagtggctagtctcagattggcatgactgcagaccaaaaaaagtctcagggggtcacataaatgttatagaagttggagatgacttaacgctgcatacagaggcatatgtatgcaatgcagactgcacaataggtgtagataaagaaaccgcacaagtaagattgcaaacagatacaacaaatcattttgagatagcaggaacaacagttaagtcagggtggttcaaaagcacaacttatatcacccttgatcaaacttgcgagcatttgaaagtttcttgtgggcctaaatctatacagttccatgcgtgtttcaatcaacacatgtcttgtgttagattcttacataggacaatcctacctgggtctattgccagctccatatgccaaaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcggataggatgaaattgcacagggcatctgggttgtgcccaggttataaaagtctcagggctgcaagagtcatgtgcaaatccaaagggccagcttctattttatctataatcactgcagtgttaatccttacttttgtcactcccataaatgccatggtagctggggacacccaagaaacaattaagcttgaggacctaccagatgacatgctaagcacggcaatgaaagtaaatatgtactacattatgtgtatgataaattatgctgtgacttggtcatttattttatgcgccctattaattgctttactcttcaagaagtatcagcatagattcttaaacttttatgccatgtactgccacgagtgcgatatgtaccatgatagatctggcctaaaatataatgaagacttcacaaacaaatgtagacagtgcacatgcgggcagtacgaagatgccgcaggtctactaacccacagaaaaacatacaactgcctcgtgcagtacaaatcaaaatggctgactaatttcttaattgtatacataatcttgatgcttattaaagattctgtactaatagtgcatgctgatggcacagactttgaaaaatgcagtggtgaggcggatataacatggaattgtacaggaccattcttgaatctaggtaattgtgagaagaagcaaaagaaggagtcatataataatatagcaactcaattaaaagggctagatgccatatcggttttagatatctccatgatatctaaaataccagaggatatagctggagccctaagattcattgaagagcaaagatcataccatgtccaactgactgcagaatatgctatgctaactagatactgcgattattacacccaattcactgacaattctggatacagtcaaaccacatggagggtttacttgagatcccacgattttaaggcatgtattttatatcccaatcagcatttttgcagatgtgtcaagcatggggacaaatgctcaagctccaattgggattccgccaatgagatgaagaacttctacagtggaaaccagtccaaatttgataaagatttaaatttagcattgatgtccttacaccacgcatttagaggaacatctagtttttatattgctaaactcctgaaggaaaagaaaaatgaagaccttgtaacttatgcagaaaagattaaaggcaaatatccaggcaatgccctgctaaaggcaataattgactacataaagtatatggaggatttaaccgagatgaacaatttcaaatatgatgagatgtgggatgacttcatatttgaagttcctcctacaaagagcccatcaataagaagattagagtcttcatatgattttaaaactaatgtaaattcaaacccatcacacatttgcaagaatatcaaaactgtggtctgcttgtcaccaaagtcaggagtgtcatatgattcaataattgcctgtggggagccaagccagccaagcatctacagaaagccagacagccaagttttccaatcaaatgctgaccagacacatttttgtttatcagatacacactgcctagaaaattatgagacagttggagaggaaatcattgatgcaattaaaaaatcgaaatgctgggaaacagaatttactgagtacatccaatttaaacagagtgatggggtaaggagttgcaggatgaaagactcaggagaatgtacagtcaccaccaatagatggcctataatactctgcgataacgataaattctactactctgagttgcagaaagattatgataaggaccaggatataggtcacttctgtctcagcccaagatgcaacacaattaggcaccctataaatcggaaacatatatcaaattgtacgtggcaggttagtcacaacaatatagacaagattgaggtacatgaactggaggatcttgaacagtataagaaggccataacacagaagttgcagacaagcctaactctatttaaatactcaaagacaaaaaacttgccccatatcaagcctatgtacaaatatataacaattgaaggaacagagactgctgagggtatagaaagtgcctatatagaatcagagatacccgctctagcaggaacatcaataggtttcaagatcacatccaagtctggaaagcatttattagatgtcattggttatgttaagagcgcatcttattcggccgtttatacaaaattgtatacaacaggacctactataggtgttaacactaaacatgatgaattatgcacagggccatgtcctgtcaatgtgcctcatggcacaggttggctcacatttgctaaggagaggacaagctcctgggggtgtgaagaatttggctgcctggcaattagcgatgggtgtgtttttggttcctgtcaagatattataaaagatgaaataactgtctataggaaggagactgaggagaccacagatgtggaattgtgcctgacatttgcagacaaaacatattgcactaacctcaatgcaattacccctataatcaccgaccagtttgaagtccaatttaaaactgtagaggcttacagtctgcctagaatcattgcagtgcggaatcatgagattatggttgggcaaataaatgacataggtgtttactcaaaaggctgtggaaatgtacagaaagtaaacaacacaaattatggaaatggtgtgcctaagtttgattacctgtgtcatttagcaagtagaaaagaagtgatagtgaggaaatgctttgataatgactaccaggcctgcaaatttctacaaacaccagcaagttataggctagaagaggagggaggttcagttacagtcatagactacaagaaaatccttggcactataaagatgaaggctatccttggagatgtgaaatataaaacatttgcagacaatgtggacctaaccgttgagggggtatgcactggctgcatcaattgttttgaaaatatacattgtgagttaacaatacacagtacagttgaagccagctgcccggtagtaagttcgtgtacagtatttcatgatagaattttaataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaagatgaaaggtgcaagacttggatgtgcagagtaagagatgaaggttttcaagtaatttttgaaccattcaaaaacttatttggttcttatattgggatattttatacatttataatatctttaatggcaatatttatagttatatatattgtgttgcctatatgtttcaaactcagagacacactgaggcagcatgaagacgcttataagagagagatgaaaattaggtaa

SEQ ID NO: 4229 - RNA, 4323 nt, synthetic construct
  misc_feature 1..4323: note = derived and/or modified CDS sequence (wt) from TAHV(Souche D C14019-29)__HM036215.1__GP
  source 1..4323: mol_type = other RNA
atgatgttcgtattgtttttcattgcactaagtgctgcaagtccagtttatcagaggtgtttccaggatggtgcaattgtcaagcaaaacccatccaaacaggctgtaacagaggtatgcctaaaggatgacgttagtatgataaaaacagaagctagatatttcaaaaatgctaccggaacatatgccaacaatgttgccattagaaagtggcttgtctcagattggcatgactgcagaccaaaaaaagtctcagggggtcatataaatgttatagaagttggagatgacttaacgctgcatacagaggcatatgtatgcaatgcagactgcacaataggtgtagataaagaaaccgcacaagtaagattgcaaacagatacaacaaatcattttgagattgcaggaacaacagttaagtcagggtggttcaaaagcacaacttatatcacccttgatcaaacttgcgagcatttgaaagtttcttgtgggcctaaatctatacagttccatgcgtgtttcaatcaacacatgtcttgtgttagattcttacataggacaatcctacctgggtctattgccagctccatatgccaaaatgtagagataataatattgacagtgttaaccctccttatatttatactattaagcatactgagtaaaacttacatatgttatatactcatgccaatatttatcccgcttgcttatatatatggtgtaatatataataaatcgtgtaaaaaatgtaagctatgtgggttagtttaccatcccttcactgagtgcggcactcattgcgtatgtggtgctagatacgagacatcagataggatgaagttgcacagggcatctgggttgtgtccaggttataaaagtctcagggccgcaagagtcatgtgcaaatccaaagggccagcttctattttatctataatcactgcagtgttaatccttacttttgtcactcccataaatgccatggtagctggggacacacaagaaacatttaagcttgaggacctaccagatgacatgctgagcatggcaatgaaagtaaatatgtactacattatgtgtatgataaactatgctgtgacttggtcatttattttatgcgccctattaattgccttactcttcaagaagtatcagcatagattcttgaacttttatgccatgtactgccacgagtgcgatatgtaccatgatagatctggcctaaaatataatggagacttcacaaacaaatgtagacagtgcacatgcgggcagtacgaagatgctgcaggtctactaacccacagaaaaacatacaactgtctcgtgcagtacaaatcaaaatggttgactaatttcttaattgtgtacataatcttgatgcttattgaagattctgtactaatagtgcatgctgatggcacagactttgaaaaatgcagtggtgaggcggatataacatggaattgtacaggaccattcttgaatctaggtaactgtgagaagaagcaaaagaaggagtcatataataatatagcaactcaactaaaagggctagatgccatatcggttttagatatccccatgatatctaaaataccagaggatatagctggagccctaagattcattgaagaacaaagatcgtaccatgttcaactgactgcagaatatgctatgctaactagatactgcgactattatacccaattcactgacaattctggatacagtcagactacatggagggtttacttgaggtcccacgattttgaggcatgtattttatatcccaatcggcatttttgcagatgtgtcaagcatggggacaaatgctcaagctccaattgggatttcgccaatgagatgaagaactattacagtggaaagcagtccaaatttaataaagatttaaatttagcattgatgtccttacaccacgcatttagaggaacatctagtttttatattgctaaactcctgaaggaaaagaaaaatgaggaccttgtaacttatgcagaaaagattaaaggcaaatacccaggcaatgccttgctaaaggcaataattgactacataaagtatatgaaggatttaaccgagatgaacaatttcaaacatgatgagatgtgggaggacttcatatttgaagttcctcctacaaagagcccatcagtgagaagattagagtcttcatatgattttaaaactaatgtaaattcaaacccatcacatatttgcaagaatatcaaaactgtggtctgcttgtcaccaaagtcaggagtgtcatatgattcaataattgcctgtggggagccaagtcagccaagcatctacagaaagccagacagtcaagtttttcaatcaaatgctgaccaaacacatttttgtttatcagatacacactgcctagaaaattatgagacagttggagaggaaatcattgatgcaattaaaaaatcaaaatgctgggaaacagaatttaccgagtacatccaatttaaacagagtgatggggtaaggagttgcaggatgaaagactcaggagaatgtacagtcgccaccaatagatggcctataatactctgtgataacaacaaattctactactctgagttgcaggaagattatgataaagaccaggatataggtcacttctgtctcagcccaagatgcaacacaattaggcaccctataaatcggaaacatatatcaaattgtacatggcaggttagtcacaacaatatagataagattgaggtacatgaactggaggatcttgaacagtataagaaggccataacacagaagttgcagacaagcctaaccttatttaaatactcaaagacaaaaaacttgccccatatcaagcctatgtacaaatatataacaattgaaggaacagagactgctgagggtatagaaagtgcttatatagaatcagagatacccgctctagcaggaacatcaataggtttcaagatcacatccaagtctggaaagcatttattagatgtcattggttatgttaagagcgcatcttattcagccgtttatacaaaattgtatacaacaggacctactataggtgttaacactaaacatgatgaattatgcacagggccatgtcctgtcaatgtgcctcacggcacaggttggctcacatttgctaaggagaggacaagctcctgggggtgtgaagaatttggctgcctggcaattagcgatgggtgtgtttttggttcctgtcaagatattataaaagatgaaataactgtctataggaaggagactgaggagaccacagatgtggaattgtgcctgacatttgcagacaaaacatattgcaccaacctcaatgcaattacccctataatcaccgaccagtttgaagtccaatttaaaactgtagaggcttacagtctgcctagaatcatcgcagtgcggaatcatgagattatggttgggcaaataaatgacataggtgtttactcaaaaggctgtggaaatgtacagaaagtaaacaacacaaattatggaaatggtgtgcctaagtttgattacctgtgtcatttagcaagtagaaaagaagtgatagttaggaaatgctttgataatgactaccaggcctgcaaatttctacaaacaccagcgagttataggctagaagaggagggaggctcagttacagtcatagactacaagaaaatccttggcactataaagatgaaggctatccttggagatgtgaaatataaaacatttgcagacaatgtagacttaaccgttgagggggtatgcactggctgcatcaattgttttgaaaatatacattgtgagttaacaatacacagtacagttgaagccagctgtccggtagtaagttcgtgtacagtatttcatgatagaattttaataaccccaaatgagcacaagtatgctataaaggtgatctgcaatgaaaagccagggcctatattgccgttcaagatctgcagtgcaaagacagatgctgcaatgacactggcagatgctaagccaatattagagctagcacctgtagaccaaacaacatatattaaggagaaagatgaaaggtgcaaaacttggatgtgcagagtaagagatgagggtttccaagtaatttttgaaccattcaaaaacttatttggttcttatattgggatattttatacatttataatatctttaatggcaatatttatagttatatatattgtgttgcctatatgtttcaaaattagagacacactgaggcagcatgaagacgcttataagagagagatgaaaattaggtaa

SEQ ID NO: 4230 - RNA, 4323 nt, synthetic construct
  misc_feature 1..4323: note = derived and/or modified CDS sequence (wt) from TAHV(1014)__GQ386833.1__GP
  source 1..4323: mol_type = other RNA
atgatgttcgtattgtttttcattgcactaagtgctgcaagcccagtttatcagaggtgtttccaggatggtgcaattgttaagcaaaacccatccaaacaggctgtaacagaggtatgcctaaaggatgacgttagtatgataaaaacagaagctagatatttcagaaatgctaccggaacatatgccaacaatgttgccattagaaagtggcttgtctcagattggcatgactgcagaccaaaaaaagtctcagggggtcatataaatgttatagaagttggagatgacttaacgctgcatacagaggcatatgtatgcaatgcagactgcacaataggtgtagataaagaaaccgcacaagtaagattgcaaacagatacaacaaatcattttgagattgcaggaacaacagttaagtcagggtggttcaaaagcacaacttatatcacccttgatcaaacttgcgagcatttgaaagtttcttgtgggcctaaatctatacagttccatgcgtgtttcaatcaacacatgtcttgtgttagattcttacataggacaatcctacctgggtctattgccagctccatatgccaaaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcccttcactgaatgcggcacccattgcgtatgtggtgctagatacgagacatcggataggatgaaattgcacagggcatctgggttgtgtccaggttataaaagtctcagggctgcaagagtcatgtgcaaatccaaagggccagcttctattttatctataatcacagcagtgttaatccttacttttgtcactcccataaatgccatggtagctggggacacacaagaaacatttaagcttgaggacctaccagatgacatgctgagcatggcaatgaaagtaaatatgtactacattatgtgtatgataaattatgctgtaacttggtcatttattttatgcgccctattaattgctttactcttcaagaagtatcagcatagattcttaaacttttatgccatgtactgccacgagtgcgatatgtaccatgatagatctggcctaaaatataatggagacttcacaaacaaatgtagacagtgcacatgcgggaagtacgaagatgccgcaggtctactaactcacagaaaaacatacaactgcctcgtgcagtacaaatcaaaatggctgactaatttcttaattgtatacataatcttgatgcttattaaagattctgtactaatagtgcatgctgatggcacagactttgaaaaatgcagtggtgaggcggatataacatggaattgtacaggaccattcttgaatctaggtaattgtgagaagaagcaaaagaaggagtcatataataatatagcaactcaactaaaagggctagatgccatatcggttttagatatccccatgatatctaaaataccagaggatatagctggagccctaagattcattgaagagcaaagatcataccatgtccaactgactgcagaatatgctatgctaactagatactgcgattattatacccaattcactgacaattctggatacagtcagaccacatggagggtttacttgagatcccacgattttgaggcatgtattttatatcccaatcagcatttttgcagatgtgtcaagcatggggacaaatgctcaagctccaattgggatttcgccaatgagatgaagaactattacagtggaaaacagtccaaatttgataaagatttaaatttagcattgatgtccttacaccacgcatttagaggaacatctagtttttatattgctaaactcctgagggaaaagaaaaatgaagaccttgtaacttatgtagaaaagattaaaggcaaatacccaggcaatgccctgctaaaggcaataattgactacataaagtatatgaagggtttaaccgagatgaacaattccaaacatgatgagatgtgggatgacttcatatttgaagttcctcctacaaagagcccatcagtaagaagattagagtcttcatatgattttaaaactaatgtaaattcaaacccatcacacatttgcaagaatatcaaaactgtggtctgcttgtcaccaaagtcaggagtgtcatatgattcaataattgcctgtggggagccaagccagccaagcatctacagaaagccagacagtcaagttttccaatcaaatgctgaccagacacatttttgtttatcagatacacactgcctggaaaattttgagacagttggagaggaaatcattgatgcaattaaaaaatcgaaatgctgggaaacagaatttactgagtacatccaatttaaacagagtgatggggtaaggagttgcaggatgaaagactcaggagaatgtacagtcaccaccaatagatggcctataatactctgcgataacgataaattctactactctgagttgcagaaagattatgataagggccaggatataggtcacttctgtctcagcccaagatgcaacacaattaggcaccctataaatcggaaacatatatcaaattgtacgtggcaggttaatcacaacaatatagacaagattgaggtacatgaactggaggatcttgaacagtataagaaggccataacacagaagttgcagacaagcctaaccctatttaaatactcaaagacaaaaaacttgccccatatcaagcctatgtacaaatatataacaattgaaggaacagagactgctgagggtatagaaagtgcttatatagaatcagagatacccgctctagcaggaacatcaataggtttcaagatcacatccaagtctggaaagcatttattagatgtcattggttatgttaagagcgcatcttattcggccgtttatacaaaattgtatacaacaggacctactataggtgttaacactaaacatgatgaattatgcacagggccatgtcctgtcaatgtgcctcatggcacaggttggctcacatttgctaaggagaggacaagctcctgggggtgtgaagaatttggctgcctggcaattagcgatgggtgtgtttttggttcctgtcaagatattataaaagatgaaataactgtctataggaaggagactgaggagaccacagatgtggaattgtgcctgacatttgcagacaaaacatattgcactaacctcaatgcaattacccctataatcaccgaccagtttgaagtccaatttaaaactgtagaggcttacagtctgcctagaatcattgcagtgcggaatcatgagattatggttgggcaaataaatgacataggtgtttactcaaaaggctgtggaaatgtacagaaagtaaacaacacaaattatggaaatggtgtgcctaagtttgattacctgtgtcatttagcaagtagaaaagaagtgatagtgagaaaatgcattgataatgactaccaggcctgcaaatttctacaaacaccagcaagttataggctagaagaagagggaggttcagttacagtcatagactacaagaaaatccttggcactataaagatgaaggctatccttggagatgtgaaatataaaacatttgcagacaatgtggacttaaccgttgagggggtatgcactggctgcatcaattgttttgaaaatatacattgtgagttaacaatacacagtacagttgaagccagctgcccggtagtaagttcgtgtacagtatttcatgatagaattttaataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaagatgaaaggtgcaagacttggatgtgcagagtaagagatgaaggttttcaagtaatttttgaaccattcaaaaacttatttggttcttatattgggatattttatacatttataatatctttaatggcaatatttatagttatatatattgtgttgcctatatgtttcaaacttagagacacactgaggcagcatgaagacgcttataagagagagatgaaaattaggtaa

SEQ ID NO: 4231 - RNA, 4323 nt, synthetic construct
  misc_feature 1..4323: note = derived and/or modified CDS sequence (wt) from TAHV(105)__GQ386829.1__GP
  source 1..4323: mol_type = other RNA
atgatgttcgtattgtttttcattgcactaagtgctgcaagcccagtttatcagaggtgtttccaggatggtgcaattgtcaagcaaaacccatccaaacaggctgtaacagaggtatgcctaaaggatgacgttagtatgataaaaacagaagctagatatttcagaaatgctaccggaacatatgccaacaatgttgccattagaaagtggcttgtctcagattggcatgactgcagaccaaaaaaagtctcagggggtcatataaatgttatagaagttggagatgacttaacgctgcatacagaggcatatgtatgcaatgcagactgcacaataggtgtagataaagaaaccgcacaggtaagattgcaaacagatacaacaaatcattttgagattgcaggaacaacagttaagtcagggtggttcaaaagcacaacttatatcacccttgatcaaacttgcgagcatttgaaagtttcttgtgggcctaaatctatacagttccatgcgtgtttcaatcaacacatgtcttgtgttagattcttacataggacaatcctacctgggtctattgccagctccatatgccaaaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcggataggatgaaattgcacagggcatctgggttgtgtccaggttataaaagtctcagggctgcaagagtcatgtgcaaatccaaagggccagcttctattttatctataatcactgcagtgttaatccttacttttgtcactcccataaatgccatggtagctggggacacacaagaaacatttaagcttgaggacctaccagatgacatgctgagcatggcaatgaaagtaaatatgtactacattatgtgtatgataaattatgctgtaacttggtcatttattttatgcgccctattaattgctttactcttcaagaagtatcagcatagattcttaaacttttatgccatgtactgccacgagtgcgatatgtaccatgatagatctggcctaaaatataatggagacttcacaaacaaatgtagacagtgcacatgcgggcagtacgaagatgccgcaggtctactaacccacagaaaaacatacaactgcctcgtgcagtacaaatcaaaatggctgactaatttcttaattgtatacataatcttgatgcttattaaagattctgtactaatagtgcatgctgatggcacagactttgaaaaatgcagtggtgaggcggatataacatggaattgtacaggaccattcttgaatctaggtaattgtgagaagaagcaaaagaaggagtcatataataatatagcaactcaactaaaagggctagatgccatatcggttttagatatccccatgatatctaaaataccagaggatatagctggagccctaagattcattgaagagcaaagatcataccatgtccaactgactgcagaatatgctatgctaactagatactgcgattattatacccaattcactgacaattctggatacagtcagaccacatggagggtttacttgagatcccacgattttgaggcatgcattttatatcccaatcagcatttttgcagatgtgtcaagcatggggacaaatgctcaagctccaattgggatttcgccaatgagatgaagaactattacagtggaaaacagtccaaatttgataaagatttaaatttagcattgatgtccttacaccacgcatttagaggaacatctagtttttatattgctaaactcctgaaggaaaagaaaaatgaagaccttgtaacttatgcagaaaagattaaaggcaaatacccaggcaatgccctgctaaaggcaataattgactacataaagtatatgaaggatttaaccgagatgaacaatttcaaacatgatgagatgtgggatgacttcatatttgaagttcctcctacaaagagcccatcagtaagaagattagagtcttcatatgattttaaaactaatgtaaattcaaacccatcacacatttgcaagaatatcaaaactgtggtctgcttgtcaccaaagtcaggagtgtcatatgattcaataattgcctgtggggagccaagccagccaagcatctacagaaagccagacagtcaagttttccaatcaaatgctgaccagacacatttttgtttatcagatacacactgcctggaaaattatgagacagttggagaggaaatcattgatgcaattaaaaaatcgaaatgctgggaaacagaatttactgagtacatccaatttaaacagagtgatggggtaaggagttgcaggatgaaagactcaggagaatgtacagtcaccaccaatagatggcctataatactctgcgataacgataaattctactactctgagttgcagaaagattatgataaggaccaggatataggtcacttctgtctcagcccaagatgcaacacaattaggcaccctataaatcggaaacatatatcaaattgtacgtggcaggttagtcacaacaatatagacaagattgaggtacatgaactggaggatcttgaacagtataagaaggccataacacagaagttgcagacaagcctaaccctatttaaatactcaaagacaaaaaacttgccccatatcaagcctatgtacaaatatataacaattgaaggaacagagactgctgagggtatagaaagtgcttatatagaatcagagatacccgctctagcaggaacatcaataggtttcaagatcacatccaagtctggaaagcatttattagatgtcattggttatgttaagagcgcatcttattcggccgtttatacaaaattgtatacaacaggacctactataggtgttaacactaaacatgatgaattatgcacagggccatgtcctgtcaatgtgcctcatggcacaggttggctcacatttgctaaggagaggacaagctcctgggggtgtgaagaatttggctgcctggcaattagcgatgggtgtgtttttggttcctgtcaagatattataaaagatgaaataactgtctataggaaggagactgaggagaccacagatgtggaattgtgcctgacatttgcagacaaaacatattgcactaacctcaatgcaattacccctataatcaccgaccagtttgaagtccaatttaaaactgtagaggcttacagtctgcctagaatcattgcagtgcggaatcatgagattatggttgggcaaataaatgacataggtgtttactcaaaaggctgtggaaatgtacagaaagtaaacaacacaaattatggaaatggtgtgcctaagtttgattacctgtgtcatttagcaagtagaaaagaagtgatagtgaggaaatgctttgataatgactaccaggcctgcaaatttctacaaacaccagcaagttataggctagaagaagagggaggttcagttacagtcatagactacaagaaaatccttggcactataaagatgaaggctatccttggagatgtgaaatataaaacatttgcagacaatgtggacttaaccgttgagggggtatgcactggctgcatcaattgttttgaaaatatacattgtgagttaacaatacacagtacagttgaagccagctgcccggtagtaagttcgtgtacagtatttcatgatagaattttaataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaagatgaaaggtgcaagacttggatgtgcagagtaagagatgaaggttttcaagtaatttttgaaccattcaaaaacttatttggttcttatattgggatattttatacatttataatatctttaatggcaatatttatagttatatatattgtgttgcctatatgtttcaaacttagagacacactgaggcagcatgaagacgcttataagagagagatgaaaattaggtaa

SEQ ID NO: 4232 - RNA, 4323 nt, synthetic construct
  misc_feature 1..4323: note = derived and/or modified CDS sequence (wt) from TAHV(106)__GQ386830.1__GP
  source 1..4323: mol_type = other RNA
atgatgttcgtattgtttttcattgcactaagtgctgcaagcccagtttatcagaggtgtttccaggatggtgcaattgtcaagcaaaacccatccaaacaggctgtaacagaggtatgcctaaaggatgacgttagtatgataaaaacagaagctagatatttcagaaatgctaccggaacatatgccaacaatgttgccattagaaagtggcttgtctcagattggcatgactgcagaccaaaaaaagtctcagggggtcatataaatgttatagaagttggagatgacttaacgctgcatacagaggcatatgtatgcaatgcagactgcacaataggtgtagataaagaaaccgcacaagtaagattgcaaacagatacaacaaatcattttgagattgcaggaacaacagttaagtcagggtggttcaaaagcacaacttatatcacccttgatcaaacttgcgaacatttgaaagtttcttgtgggcctaaatctatacagttccatgcgtgtttcaatcaacacatgtcttgtgttagattcttacataggacaatcctacccgggtctattgccagctccatatgccaaaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcggataggatgaaattgcacagggcatctgggttgtgtccaggttataaaagtctcagggctgcaagagtcatgtgcaaatccaaagggccagcttctattttatctataatcactgcagtgttaatccttacttttgtcactcctataaatgccatggtagctggggacacacaagaaacatttaagcttgaggacctaccagatgacatgctgagcatggcaatgaaagtaaatatgtactacattatgtgtatgataaattatgctgtaacttggtcatttattttatgcgccctattaattgctttactcttcaagaagtatcagcatagattcttaaacttttatgccatgtactgccacgagtgcgatatgtaccatgatagatctggcctaaaatataatggagacttcacaaataaatgtagacagtgcacatgcgggcagtacgaagatgccgcaggtctactaacccacagaaaaacatacaactgcctcgtgcagtacaaatcaaaatggctgactaatttcttaattgtatacataatcttgatgcttattaaagattctgtactaatagtgcatgctgatggcacagactttgaaaaatgcagtggtgaggcggatataacatggaattgtacaggaccattcttgaatctaggtaattgtgagaagaagcaaaagaaggagtcatataacaatatagcaactcaactaaaagggctagatgccatatcggttttagatatccccatgatatctaaaataccagaggatatagctggagccctaagattcattgaagagcaaagatcataccatgtccagctgactgcagaatatgctatgctaactaggtactgcgattattatacccaattcactgacaattctggatacagtcagaccacatggagggtttacttgagatcccacgattttgaggcatgtattttatatcccaatcagcatttttgcagatgtgtcaagcatggggacaaatgctcaagctccaattgggatttcgccaatgagatgaagaactattacagtggaaaacagtccaaatttgataaagatttaaatttagcattgatgtccttacaccacgcatttagaggaacatctagtttttatattgctaaactcctgaaggaaaagaaaaatgaagaccttgtaacttatgcagaaaagattaaaggcaaatacccaggcaatgccctgctaaaggcaataattgactacataaagtatatgaagggtttaaccgagatgaacaatttcaaacatgatgagatgtgggatgacttcatatctgaagttcctcctacaaagagcccatcagtaagaagattagagtcttcatatgattttaaaactaatgtaaattcaaacccatcacacatctgcaagaatatcaaaactgtggtctgcttgtcaccaaagtcaggagtgtcatatgattcaataattgcctgtggggagccaagccagccaagcatctacagaaagccagacagtcaagttttccaatcaaatgctgaccagacacatttttgtttatcagatacacactgcctggaaaattatgagacagttggagaggaaatcattgatgcaattaaaaaatcgaaatgctgggaaacagaatttactgagtacattcaatttaaacagagtgatggggtaaggagttgcaggatgaaagactcaggagaatgtacagtcaccaccaatagatggcctataatactctgcgataacgataaattctactactctgagttgcagaaagattatgataaggaccaggatataggtcacttctgtctcagcccaagatgcaacacaattaggcaccctataaatcggaaacatatatcaaattgtacgtggcaggttagtcacaacaatatagacaagattgaggtacatgaactggaggatcttgaacagtataagaaggccataacacagaagttgcagacaagcctaaccctatttaaatactcaaagacaaaaaacttgccccatatcaagcctatgtacaaatatataacaattgaaggaacagagactgctgagggtatagaaagtgcttatatagaatcagagatacccgctttagcaggaacatcaataggtttcaagatcacgtccaagtctggaaagcatttattagatgtcattggttatgttaagagcgcatcttattcagccgtttatacaaaattgtatacaacaggacctactatagatgttaacactaaacatgatgaattatgcacagggccatgtcctgtcaatgtgcctcatggcacaggttggctcacatttgctaaggagaggacaagctcctgggggtgtgaagaatttggctgcttggcaattagcgatgggtgtgtttttggttcctgtcaagatattataaaagatgaaataactgtctataggaaggagactgaggagaccacagatgtggaattgtgcctgacatttgcagacaaaacatattgcactaacctcaatgcaattacccctataatcaccgaccagtttgaagtccaatttaaaactgtagaggcttacagtctgcctagaatcattgcagtgcggaatcatgagattatggttgggcaaataaatgacataggtgtttactcaaaaggctgtggaaatgtacagaaagtaaacaacacaaattatggaaatggtgtgcctaagtttgattacctgtgtcatttagcaagtagaaaagaagtgatagtgaggaaatgctttgataatgactaccaggcctgcaaatttctacaaacaccagcaagttacaggctagaagaggagggaggttcagttacagtcatagactacaagaaaatccttggcactataaagatgaaggctatccttggagatgtgaaatataaaacatttgcagacaatgtggacttaaccgttgagggggtatgcactggctgcatcaattgttttgaaaatatacattgtgagttaacaatacacagtacagttgaagccagctgcccggtagtaagttcgtgtacagtatttcatgatagaattttaataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaagatgaaaggtgcaagacttggatgtgcagagtaagagatgaaggttttcaagtaatttttgaaccattcaaaaacttatttggttcttatattgggatattttatacatttataatatctttaatggcaatatttatagttatatatattgtgttgcctatatgtttcaaacttagagacacactgaggcagcatgaagacgcttataagagagagatgaaaattaggtaa

SEQ ID NO: 4233 - RNA, 4323 nt, synthetic construct
  misc_feature 1..4323: note = derived and/or modified CDS sequence (wt) from TAHV(181)__GQ386831.1__GP
  source 1..4323: mol_type = other RNA
atgatgttcgtattgtttttcattgcactaagtgctgcaagcccagtttatcagaggtgtttccaggatggtgcaattgtcaagcaaaacccatccaaacaggctgtaacagaggtatgcctaaaggatgacgttagtatgataaaaacagaagctagatatttcagaaatgctaccggaacatatgccaacaatgttgccattagaaagtggcttgtctcagattggcatgactgcagaccaaaaaaagtctcagggggtcatataaatgttatagaagttggagatgacttaacgctgcatacagaggcatatgtatgcaatgcagactgcacaataggtgtagataaagaaaccgcacaagtaagattgcaaacagatacaacaaatcattttgagattgcaggaacaacagttaagtcagggtggttcaaaagcacaacttatatcacccttgatcaaacttgcgagcatttgaaagtttcttgtgggcctaaatctatacagttccatgcgtgtttcaatcaacatatgtcttgtgttagattcttacataggacaatcctacctgggtctattgccagctccatatgccaaaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcggataggatgaaattgcacagggcatctgggttgtgtccaggttataaaagtctcagggctgcaagagtcatgtgcaaatccaaagggccagcttctattttatctataatcactgcagtgttaatccttacttttgtcactcccataaatgccatggtagctggggacacacaagaaacatttaagcttgaggacctaccagatgacatgctgagcatggcaatgaaagtaaatatgtactacattatgtgtatgataaattatgctgtaacttggtcatttattttatgcgccctattaattgctttactcttcaagaagtatcagcatagattcttaaacttttatgccatgtactgccacgagtgcgatatgtaccatgatagatctggcctaaaatataatggagacttcacaaacaaatgtagacagtgcacatgcgggcagtacggagatgccgcaggtctactaacccacagaaaaacatacaactgcctcgtgcagtacaaatcaaaatggctgactaatttcttaattggatacataatcttgatgcttattaaagattctgtactaatagtgcatgctgatggcacagactttgaaaaatgcagtggtgaggcggatataacatggaattgtacaggaccattcttgaatctaggtaattgtgagaagaagcaaaagaaggagtcatataataatatagcaactcaactaaaagggctagatgccatatcggttttagatatccccatgatatctaaaataccagaggatatagctggagccctaagattcattgaagagcaaagatcataccatgtccaactgactgcagaatatgctatgctaactagatactgcgattattatacccaattcactgacaattctggatacagtcagaccacatggagggtttacttgagatcccacgattttgaggcatgtattttatatcccaatcggcatttttgcagatgtgtcaagcatggggacaaatgctcaagctccaattgggatttcgccaatgagatgaagaactattacagtggaaaacagtccaaatttgataaagatttaaatttagcattgatgtccttacaccacgcatttagaggaacatctagtttttatattgctaaactcctgaaggaaaagaaaaatgaagaccttgtaacttatgcagaaaagattaaaggcaaatatccaggcaatgccctgctaaaggcaataattgactacataaagtatatgaagggtttaaccgagatgaacaatttcaaacatgatgagatgtgggatgacttcatatttgaagttcctcctacaaagagcccatcagtaagaagattagagtcttcatatgattttaaaactaatgtaaattcaaacccatcacacatttgcaagaatatcaaaactgtggtctgcttgtcaccaaagtcaggagtgtcatatgattcaataattgcctgtggggagccaagccagccaagcatctacagaaagccagacagtcaagttttccaatcaaatgctgaccagacacatttttgtttatcagatacacactgcctggaaaattatgagacagttggagaggaaatcattgatgcaattaaaaaatcgaaatgctgggaaacagaatttactgagtacatccaatttaaacagagtgatggggtaaggagttgcaggatgaaagactcaggagaatgtacagtcaccaccaatagatggcctataatactctgcgataacgataaattctactactctgagttgcagaaagattatgataaggaccaggatataggtcacttctgtctcagcccaagatgcaacacaattaggcaccctataaatcggaaacatatatcaaattgtacgtggcaggttaatcacaacaatatagacaagattgaggtacatgaactggaggatcttgaacagtataagaaggccataacacagaagttgcagacaagcctaaccctatttaaatactcaaagacaaaaaacttgccccatatcaagcctatgtacaaatatataacaattgaaggaacagagactgctgagggtatagaaagtgcttatatagaatcagagatacccgctctagcaggaacatcaataggtttcaagatcacatccaagtctggaaagcatttattagatgtcattggttatgttaagagcgcatcttattcggccgtttatacaaaattgtatacaacaggacctactataggtgttaacactaaacatgatgaattatgcacagggccatgtcctgtcaatgtgcctcatggcacaggttggctcacatttgctaaggagaggacaagctcctgggggtgtgaagaatttggctgcctggcaattagcgatgggtgtgtttttggttcctgtcaagatattataaaagatgaaataactgtctataggaaggagactgaggagaccacagatgtggaattgtgcctgacatttgcagacaaaacatattgcactaacctcaatgcaattacccctataatcaccgaccagtttgaagtccaatttaaaactgtagaggcttacagtctgcctagaatcattgcagtgcggaatcatgagattatggttgggcaaataaatgacataggtgtttactcaaaaggctgtggaaatgtacagaaagtaaacaacacaaattatggaaatggtgtacctaagtttgattacctgtgtcatttagcaagtagaaaagaagtgatagtgaggaaatgctttgataatgactaccaggcctgcaaatttctacaaacaccagcaagttataggctagaagaagagggaggttcagttacagtcatagactacaagaaaatccttggcactataaagatgaaggctatccttggagatgtgaaatataaaacatttgcagacaatgtggacttaaccgttgagggggtatgcactggctgcatcaattgttttgaaaatatacattgtgagttaacaatacacagtacagttgaagccagctgcccggtagtaagttcgtgtacagtatttcatgatagaattttaataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaagatgaaaggtgcaagacttggatgtgcagagtaagagatgaaggttttcaagtaatttttgaaccattcaaaaacttatttggttcttatattgggatattttatacatttataatatctttaatggcaatatttatagttatatatattgtgttgcctatatgtttcaaacttagagacacactgaggcagcatgaagacgcttataagagagagatgaaaattaggtaa

SEQ ID NO: 4234 - RNA, 4323 nt, synthetic construct
  misc_feature 1..4323: note = derived and/or modified CDS sequence (wt) from TAHV(236)__GQ386832.1__GP
  source 1..4323: mol_type = other RNA
atgatgttcgtattgtttttcattgcactaagtgctgcaagcccagtttatcagaggtgtttccaggatggtgcaattgtcaagcaaaacccatccaaacaggctgtaacagaggtatgcctaaaggatgacgttagtatgataaaaacagaagctagatatttcagaaatgctaccggaacatatgccaacaatgttgccattagaaagtggcttgtctcagattggcatgactgcagaccaaaaaaagtctcagggggtcatataaatgttatagaagttggagatgacttaacgctgcatacagaggcatatgtatgcaatgcagactgcacaataggtgtagataaagaaaccgcacaagtaagattgcaaacagatacaacaaatcattttgagattgcaggaacaacagttaagtcagggtggttcaaaagcacaacttatatcacccttgatcaaacttgcgagcatttgaaagtttcttgtgggcctaaatctatacagttccatgcgtgtttcaatcaacacatgtcttgtgttagattcttacataggacaatcctacctgggtctattgccagctccatatgccaaaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcagataggatgaaattgcacagggcatctgggttgtgtccaggttataaaagtctcagggctgcaagagtcatgtgcaaatccaaagggccagcttctattttatctataatcactgcggtgttaatccttacttttgtcactcccataaatgccatggtagctggggacacacaagaaacatttaagcttgaggacctaccagatgacatgctgagcatggcaatgaaagtaaatatgtactacattatgtgtatgataaattatgctataacttggtcatttattttatgcgccctattaattgctttactcttcaagaagtatcagcatagattcttaaacttttatgccatgtactgccacgagtgcgatatgtaccatgatagatctggcctaaaatataatggagacttcacaaacaaatgtagacagtgcacatgcgggcagtacgaagatgccgcaggtctactaacccacagaaaaacatacaactgcctcgtgcagtacaaatcaaaatggctgactaatttcttaattgtatacataatcttgatgcttattaaagattctgtactaatagtgcatgctgatggcacagactttgaaaaatgcagtggtgaggcggatataacatggaattgtacaggaccattcttgaatctaggtaattgtgagaagaagcaaaagaaggagtcatataataatatagcaactcaattaaaagggctagatgccatatcggttttagatatgcccatgatatctaaaataccagaggatatagctggagccctaagattcattgaagagcaaagatcataccatgtccaactgactgcagaatatgctatgctaactagatactgcgattattacacccaattcactgacaattctggatacagtcaaaccacatggagggtttacttgagatcccacgattttgaggcatgtattttatatcccaatcagcatttttgcagatgtgtcaagcatggggacaaatgctcaagctccaattgggatttcgccaatgagatgaagaactactacagtggaaaacagtccaaatttgataaagatttaaatttagcattgatgtccttacaccacgcatttagaggaacatctagtttttatattgctaaactcctgaaggaaaagaaaaatgaagaccttgtaacttatgcagaaaagattaaaggcaaatacccaggcaatgccctgctaaaggcaataattgactacataaagtatatgaaggatttaaccgagatgaacaatttcaaacatgatgagatgtgggatgacttcatatttgaagttcctcctacaaagagcccatcagtaagaagattagaatcttcatatgattttaaaactaatgtaaattcaaacccatcacacatttgcaagaatatcaaaactgtgatctgcttgtcaccaaagtcaggagtgtcatatgattcaataattgcctgtggggagccaagccagccaagcatctacagaaagccagacagccaagttttccaatcaaatgctgaccagacacatttttgtttatcagatacacactgcctggaaaattatgagacagttggagaggaaatcattgatgcaattaaaaaatcgaaatgctgggaaacagaacttactgagtacatccaatttaaacagagtgatggggtaaggagttgcaggatgaaagactcaggagaatgtacagtcaccaccaatagatggcctataatactctgcgataacgataaattctactactctgagttgcagaaagattatgataaggaccaggatataggtcacttctgtctcagcccaagatgcaacacaattaggcaccctataaatcggaaacatatatcaaattgtacgtggcaggttagtcacaacaatatagacaagattgaggtacatgaactggaggatcttgaacagtataagaaggccataacacagaagttgcagacaagcctaaccctatttaaatactcaaagacaaaaaacttgccccatatcaagcctatgtacaaatatataacaattgaaggaacagagactgccgagggtatagaaagtgcttatatagaatcagagatacccgctctagcaggaacatcaataggtttcaagatcacatccaagtctggaaagcatttattagatgtcattggttatgttaagagcgcatcttattcggctgtttatacaaaattgtatacaacaggacctactataggtgttaacactaaacatgatgaattatgcacagggccatgtcctgtcaatgtgcctcatggcacaggttggctcacatttgctaaggagaggacaagctcctgggggtgtgaagaatttggctgcctggcaattagcgatgggtgtgtttttggctcctgtcaagatattataaaagatgaaataactgtctataggaaggagactgaggagaccacagatgtggaattgtgcctgacatttgcagacaaaacatattgcactaacctcaatgcaattacccctataatcaccgaccagtttgaagtccaatttaaaactgtagaggcttacagtctgcctagaatcattgcagtgcggaatcatgagattatggttgggcaaataaatgacataggtgtttactcaaaaggctgtggaaatgtacagaaagtaaacaacacaaattatggaaatggtgtgcctaagtttgattacctgtgtcatttagcaagtagaaaagaagtgatagtgaggaaatgctttgataatgactaccaggcctgcaaatttctacaaacaccagcaagttataggctagaagaggagggaagttcagttacagtcatagactacaagaaaatccttggcactataaagatgaaggctatccttggagatgtgaaatataaaacatttgcagacaatgtggacttaaccgttgagggggtatgcactggctgcatcaattgttttgaaaatatacattgtgagttaacaatacacagtacagttgaagccagctgcccggtagtaagttcgtgtacagtatttcatgatagaattttaataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaagatgaaaggtgcaagacttggatgtgcagagtaagagatgaaggtttccaagtaatttttgaaccattcaaaaacttatttggttcttatattgggatattttatacatttataatatctttaatggcaatatttatagttatatatattgtgttgcctatatgtttcaaactcagagacgcactgaggcagcatgaagacgcttataagagagagatgaaaattaggtaa

SEQ ID NO: 4235 - RNA, 4323 nt, synthetic construct
  misc_feature 1..4323: note = derived and/or modified CDS sequence (wt) from TAHV(29)__GQ386823.1__GP
  source 1..4323: mol_type = other RNA
atgatgttcgtattgtttttcattgcactaagtgctgcaagcccagtttatcagaggtgtttccaggatggtgcaattgtcaagcaaaacccatccaaacaggctgtaacagaggtatgcctaaaggatgacgttagtatgataaaaacagaagctagatatttcagaaatgctaccggaacatatgccaacaatgttgccattagaaagtggcttgtctcagattggcatgactgcagaccaaaaaaagtctcagggggtcatataaatgtcatagaagttggagatgacttaacgctacatacagaggcatatgtatgcaatgcagactgcacaataggtgtagataaagaaaccgcacaagtaagattgcaaacagatacaacaaatcattttgagattgcaggaacaacagttaagtcagggtggttcaaaagcacaacttatatcacccttgatcaaacttgcgagcatttgaaagtttcttgtgggcccaaatctatacagttccatgcgtgtttcaatcaacacatgtcttgtgttagattcttacataggacaatcctacctgggtctattgccagctccatatgccaaaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcctttcactgagtgcggcacccattgcgtatgtggtgctagatacgagacatcggataggatgaaattgcacagggcatctgggttgtgtccaggttataaaagtctcagggctgcaagagtcatgtgcaaatccaaagggccagcttctattttatctataatcactgcagtgttaatccttacttttgtcactcccataaatgccatggtagctggggacacacaagaaacatttaagcttgaggacctaccagatgacatgctgagcatggcaatgaaagtaaatatgtactacattatgtgtatgataaattatgctgtaacttggtcatttattttatgcgccctattaattgctttactcttcaagaagtatcagcatagattcttaaacttttatgccatgtactgccacgagtgcgatatgtaccatgatagatctggcctaaaatataatggagacttcacaaacaaatgtagacagtgcacatgcggacagtacgaagatgccgcaggtctactaacccacagaaaaacatacaactgcctcgtgcagtacaaatcaaaatggctgactaatttcttaattgtatacataatcttgatgcttattaaagattctgtactaatagtgcatgctgatggcacagactttgaaaaatgcagtggtgaggcggatataacatggaattgtacaggaccattcttgaatctaggtaattgtgagaagaagcaaaagaaggagtcatatgataatatagcaactcaactaaaagggctagatgccatatcggttttagatatccccatgatatctaaaataccagaggatatagctggagccctaagattcattgaagagcaaagatcataccatgtccaactgactgcagaatatgctatgctaactagatactgcgattattatacccaattcactgacaattctggatacagtcagaccacatggagggtttacttgagatcccacgattttgaggcatgtattttatatcccaatcagcatttttgcagatgtgtcaagcatggggacaaatgctcaagctccaattgggatttcgccaatgagatgaagaactattacagtggaaaacagtccaaatttgataaagatttaaatttagcattgatgtccttacaccacgcatttagaggaacatctagtttttatattgctaaactcctgaaggaaaagaaaaatgaagaccttgtaacttatgcagaaaagattaaaggcaaatacccaggcaatgccttgctaaaggcaataattgactacataaagtatatgaaggatttaaccgagatgaacaatttcaaacatgatgagatgtgggatgacttcatatttgaagttcctcctacaaagagcccatcagtaagaagattagagtcttcatatgattttaaaactaatgtaaattcaaacccatcacacatttgcaagaatatcaaaactgtggtctgcttgtcaccaaagtcaggagtgtcatatgattcaataattgcctgtggggagccaagccagccaagcatctacagaaagccagacagtcaagttttccaatcaaatgcagaccagacacatttttgtttatcagatacacactgcctggaaaattatgagacagttggagaggaaatcattgatgcaattaaaaaatcgaaatgctgggaaacagaatttactgagtacatccaatttaaacagagtgatggggtaaggagttgcaggatgaaagattcaggagaatgtacagtcaccaccaatagatggcctataatactctgcgataacgataaattctactactctgagttgcagaaagattatgataaggaccaggatataggtcacttctgtctcagcccaagatgcaacacaattaggcaccctataaatcggaaacatatatcaaattgtacgtggcaggttagtcacaacaatatagacaagattgaggtacatgaactggaggatcttgaacagtataagaaggccataacacagaagttgcagacaagcctaaccctatttaaatactcaaagacaaaaaacttgccccatatcaagcctatgtacaaatatataacaattgaaggaacagagactgctgagggtatagaaagtgcttatatagaatcagagatacccgctctagcaggaacatcaataggtttcaagatcacatccaagtctggaaagcatttattagatgtcattggttatgttaagagcgcatcttattcagccgtttatacaaaattgtatacaacaggacctactataggtgttaacactaaacatgatgaattatgcacagggccatgtcctgtcaatatgcctcatggcacaggttggctcacatttgctaaggagaggacaagctcctgggggtgtgaagaatttggctgcctggcaattagcgatgggtgtgtttttggttcctgtcaagatattataaaagatgaaataactgtctataggaaggagactgaggagaccacagatgtggaattgtgcctgacatttgcagataaaacatattgcactaacctcaatgcaattacccctataatcaccgaccagtttgaagtccaatttaaaactgtagaggcttacagtctgcctagaatcattgcagtgcggaatcatgagattatggttgggcaaataaatgacataggtgtttactcaaaaggctgtggaaatgtacagaaagtaaacaacacaaattatggaaatggtgtgcctaagtttgattacctgtgtcatttagcaagtagaaaagaagtgatagtgaggaaatgctttgataatgactaccaggcctgcaaatttctacaaacaccagcaagttataggctagaagaggagggaggttcagttacagtcatagactacaagaaaatacttggcactataaagatgaaggctatccttggagatgtgaaatataaaacatttgcagacaatgtggacttaaccgttgagggggtatgcactggctgcatcaattgttttgaaaatatacattgtgagttaacaatacacagtacagttgaagccagctgcccggtagtaagttcgtgtacagtatttcatgatagaattttaataaccccaaatgagcacaagtatgctataaaggtgatctgcaatgaaaagccaggtcctacattgccgttcaagatctgcagtgcaaagacagatgttgcaatgacactggcagatgctaagccaatattagagctagcacctgtagaccaaacaacatatattaaggagaaagatgaaaggtgcaagacttggatgtgcagagtaaaagatgaaggttttcaagtaatttttgaaccattcaaaaacttatttggttcttatattgggatattttatacatttataatatctttaatggcaatatttatagttatatatattgtgttgcctatatgtttcaaacttagagacacactgaggcagcatgaagacgcttataagagagagatgaaaattaggtaa

SEQ ID NO: 4236 - RNA, 4323 nt, synthetic construct
  misc_feature 1..4323: note = derived and/or modified CDS sequence (wt) from TAHV(4019)__GQ386834.1__GP
  source 1..4323: mol_type = other RNA
atgatgttcgtattgttttttattgcactaagtgctgcaagcccagtttatcagaggtgtttccaggatggtgcaattgtcaagcaaaacccatccaaacaggctgtaacagaggtatgcctaaaggatgacgttagtatgataaaaacagaagctagatatttcagaaatgctaccggaacatatgccaacaatgttgccattagaaagtggcttgtctcagattggcatgactgcagaccaaaaaaagtctcagggggtcatataaatgttatagaagttggagatgacttaacgctgcatacagaggcatatgtatgcaatgcagactgcacaataggtgtagataaagaaaccgcacaagtaagattgcaaacagatacaacaaatcattttgagattgcaggaacaacagttaagtcagggtggttcaaaagcacaacttatatcacccttgatcaaacttgcgagcatttgaaagtttcttgtgggcctaaatctatacagttccatgcgtgtttcaatcaacacatgtcttgtgttagattcttacataggacaatcctaccagggtctattgccagctccatatgccaaaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcggataggatgaaattgcacagggcatctgggttgtgtccaggttataaaagtctcagggctgcaagagtcatgtgcaaatccaaagggccagcttctattttatctataatcactgcagtgttaatccttacttttgtcactcccataaatgctatggtagctggggacacacaagaaacatttaagcttgaggacctaccagatgacatgctgagcatggcaatgaaagtaaatatgtactacattatgtgtatgataaattatgctgtaacttggtcatttattttatgcgccctattaattgctttactcttcaagaagtatcagcatagattcttaaacttttatgccatgtactgccacgagtgcgatatgtaccatgatagatctggcctaaaatataatggagacttcacaaacaaatgtagacagtgcacatgcgggcagtacgaagatgccgcaggtctactaacccacagaaaaacatacaactgcctcgtgcagtacaaatcaaaatggctgactaatttcttaattgtatacataatcttgatgcttattaaagattctgtactaatagtgcatgctgatggcacagactttgaaaaatgcagtggtgaggcggatataacatggaattgtacaggaccattcttgaatctaggtaattgtgagaagaagcaaaagaaggagtcatataataatatagcaactcaactaaaagggctagatgccatatcggttttagatatccccatgatatctaaaataccagaggatatagctggagccctaagattcattgaagagcaaagatcataccatgtccaactgactgcagaatatgctatgctaactagatattgcgattattatacccaattcactgacaattctggatacagtcagaccacatggagggtttacttgagatcccacgattttgaggcatgtattttatatcccaatcggcatttttgcagatgtgtcaagcatggggacaaatgctcaagctccaattgggatttcgctaatgagatgaagaactattacagtggaaaacagtccaaatttgataaagatttaaatttagcattgatgtccttacaccacgcatttagaggaacatctagtttttatattgccaaactcctgaaggaaaagaaaaatgaagaccttgtaacttatgcagaaaagattaaaggcaaatacccaggcaatgccttgctaaaggcaataattgactacataaagtatatgaaggatttaaccgagatgaacaatttcaaacatgatgagatgtgggatgactccatatttgaagttcctcctacaaagagcccatcagtaagaagattagagtcttcatatgattttaaaactaatgtaaattcaaacccatcacacatttgcaagaatatcaaaactgtggtctgcttgtcaccaaagtcaggagtgtcatatgattcaataattgcctgtggggagccaagccagccaagcatctacagaaagccagacagtcaagttttccaatcaaatgctgaccagacacatttttgtttatcagatacacactgcctggaaaattatgaggcagttggagaggaaatcattgatgcaattaaaaaatcgaaatgctgggaaacagaatttactgagtacatccaatttaaacagagtgatggggtaaggagttgcaggatgaaagactcaggagaatgtacagtcaccaccaatagatggcctataatactctgcgataacgataaattctactactctgagttgcagaaagattatgataaggaccaggatataggtcacttctgtctcagcccaagatgcaacacaattaggcaccctataaatcggaaacatatatcaaattgtacatggcaggttagtcacaacaatatagacaagattgaggtacatgaactggaggatcttgaacagtataagaaggccataacacagaagttgcagacaagcctaaccctatttaaatactcaaagacaaaaaacttgccccatatcaagcctatgtacaaatatataacaattgaaggaacagagactgctgagggtatagaaagtgcttatatagaatcagagatacccgctctagcaggaacatcaataggtttcaagatcacatccaagtctggaaagcatttattagatgtcattagttatgttaagagcgcatcttattcagccgtttatacaaaattgtatacaacaggacctactataggtgttaacactaaacatgatgaattatgcacagggccatgtcctgttaatgtgcctcatggcacaggttggatcacatttgctaaggagaggacaagctcctggggatgtgaagaatttggctgcctggcaattagcgatgggtgtgtttttggttcctgtcaagatattataaaagatgaaataactgtctataggaaggagactgaagagaccacagatgtggaattgtgcctgacatttgcagacaaaacatattgcactaacctcaatgcaattacccctataatcaccgaccagtttgaagtccaatttaaaactgtagaggcttacagtctgcctagaatcattgcagtgcggaatcatgagattatggttgggcaaataaatgacataggtgtttactcaaaaggctgtggaaatgtacagaaagtaaacaacacaaattatggaaatggtgtgcctaagtttgattacctgtgtcatttagcaagtagaaaagaagtgatagtgaggaaatgctttgataatgactaccaggcctgcaaatttctacaaacaccagcgagttataggctagaagaggagggaggttcagttacagtcatagactacaagaaaatccttggcactataaagatgaaggctatccttggagatgtgaaatataaaacatttgcagacaatgtggacttaaccgttgagggggtatgcactggctgcatcaattgttttgaaaatatacattgtgagttaacaatacacagtacagttgaagccagctgcccggtagtaagttcgtgtacagtatttcatgatagaattttaataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaagatgaaaggtgcaagacttggatgtgcagagtaagagatgaaggttttcaagtaatttttgaaccattcaaaaacttatttggttcttatattgggatattttatacatttataatatctttaatggcaatatttatagttatatatattgtgttgcctatatgtttcaaacttagagacacactgaggcagcatgaagacgcttataagagagagatgaaaattaggtaa

SEQ ID NO: 4237 - RNA, 4323 nt, synthetic construct
  misc_feature 1..4323: note = derived and/or modified CDS sequence (wt) from TAHV(4020)__GQ386835.1__GP
  source 1..4323: mol_type = other RNA
atgatgttcgtattgtttttcattgcactaagtgctgcaagcccagtttatcagaggtgtttccaggatggtgcaattgtcaagcaaaacccatccaaacaggctgtaacagaggtatgcctaaaggatgacgttagtatgataaaaacagaagctagatatttcagaaatgctaccggaacatatgccaacaatgttgccattagaaagtggcttgtctcagattggcatgactgcagaccaaaaaaagtctcagggggtcatataaatgttatagaagttggagatgacttaacgctgcatacagaggcatatgtatgcaatgcagactgcacaataggtgtagataaagaaaccgcacaagtaagattgcaaacagatacaacaaatcattttgagattgcaggaacaacagttaagtcagggtggttcaaaagcacaacttatatcacccttgatcaaacttgcgagcatttgaaagtttcttgtgggcctaaatctatacagttccatgcgtgtttcaatcaacacatgtcttgtgttagattcttacataggacaatcctacctgggtctattgccagctccatatgccaaaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcggataggatgaaattgcacagggcatctgggttgtgtccaggttataaaagtctcagggctgcaagagtcatgtgcaaatccaaagggccagcttctattttatctataatcactgcagtgttaatccttacttttgtcactcctataaatgccatggtagctggggacacacaagaaacatttaagcttgaggacctaccagatgacatgctgagcatggcaatgaaagtaaatatgtactacattatgtgtatgataaattatgctgtaacttggtcatttattttatgcgccctattaattgctttactcttcaagaagtatcagcatagattcttaaacttttatgccatgtactgccacgagtgcgacatgtaccatgatagatctggcctaaaatataatggagacttcacaaacaaatgtagacagtgcacatgcgggcagtacgaagatgccgcaggtctactaacccacagaaaaacatacaactgcctcgtgcagtacaaatcaaaatggctgactaatttcttaattgtatacataatcttgatgcttattaaagattctgtactaatagtgcatgctgatggcacagactttgaaaaatgcagtggtgaggcggatataacatggaattgtacaggaccattcttgaatctaggtaattgtgagaagaagcaaaagaaggagtcatataacaatatagcaactcaactaaaagggctagatgccatatcggttttagatatccccatgatatctaaaataccagaggatatagctggagccctaagattcattgaagagcaaagatcataccatgtccagctgactgcagaatatgctatgctaactagatactgcgattattatacccaattcactgacaattctggatacagtcagaccacatggagggtttacttgagatcccacgattttgaggcatgtattttatatcccaatcagcatttttgcagatgtgtcaagcatggggacaaatgctcaagctccaattgggacttcgccaatgagatgaagaactattacagtggaaaacagtccaaatttgataaagatttaaatttagcattgatgtccttacaccacgcatttagaggaacatctagtttttatattgctaaactcctgaaggaaaagaaaaatgaggaccttgtaacttatgcagaaaagattaaaggcaaatactcaggcaatgccttgctaaaagcaataattgactacataaagtatatgaagggtttaaccgagatgaacaatttcaaacatgatgagatgtgggatgatttcatatttgaagttcctcctccaaagagcccatcagtaagaagattagagtcttcatatgattttaaaactaatgtaaattcaaacccatcacacatctgcaagaatatcaaaactgtggtctgcttgtcaccaaaatcaggagtgtcatatgattcaataattgcctgtggggagccaagccagccaagcatctacagaaagccagacagtcaagttttccaatcaaatgctgaccagacacatttttgtttatcagatacacactgcctggaaaattatgagacagttggagaggaaatcattgatgcaattaaaaaatcgaaatgctgggaaacagaatttactgagtacatccaatttaaacagagtgatggggtaaggagttgcaggatgaaagactcaggagaatgtacagtcaccaccaatagatggcctataatactctgcgataacgataaattctactactctgagttgcagaaagattatgataaggaccaggatataggtcacttctgtctcagcccaagatgcaacacaattaggcaccctataaatcggaaacatatatcaaattgtacgtggcaggttagtcacaacaatatagacaagattgaggtacatgaactggaggatcttgaacagtataagaaggccataacacagaagttgcagacaagcctaaccctatttaaatactcaaagacaaaaaacttgccccatatcaagcctatgtacaaatatataacaattgaaggaacagagactgctgagggtatagaaagtgcttatatagaatcagagatacccgctctagcaggaacatcaataggtttcaagatcacgtccaagtctggaaagcatttattagatgtcattggttatgttaagagcgcatcttattcagccgtttatacaaaattgtatacaacaggacctactataggtgttaacactaaacatgatgaattatgcacagggccatgtcctgtcaatgtgcctcatggcacaggttggctcacatttgctaaggagaggacaagctcctgggggtgtgaagaatttggctgcttggcaattagcgatgggtgtgtttttggttcctgtcaagatattataaaagatgaaataactgtctataggaaggagactgaggagaccacagatgtggaattgtgcctgacatttgcagacaaaacatattgcactaacctcaatgcaattacccctataatcaccgaccagtttgaagtccaatttaaaactgtagaggcttacagtctgcctagaatcattgcagtgcggaatcatgagattatggttgggcaaataaatgacataggtgtttactcaaaaggctgtggaaatgtacagaaagtaaacaacacaaattatggaaatggtgtgcctaagtttgattacctgtgtcatttagcaagtagaaaagaagtgatagtgaggaaatgctttgataatgactaccaggcctgcaaatttctacaaacaccagcgagttacaggctagaagaggagggaggttcagttacagtcatagactacaagaaaatccttggcactataaagatgaaggctatccttggagatgtgaaatataaaacatttgcagacaatgtggacttaaccgttgagggggtatgcactggctgcatcaattgttttgaaaatatacattgtgagttaacaatacacagtacagttgaagccagctgcccggtagtaagttcgtgtacagtatttcatgatagaattttaataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaagatgaaaggtgcaagacttggatgtgcagagtaagagatgaaggttttcaagtaatttttgaaccattcaaaaacttatttggttcttatattgggatattttatacatttataatatctttaatggcaatatttatagttatatatattgtgttgcctatatgtttcaaacttagagacacactgaggcagcatgaagacgcttataagagagagatgaaaattaggtaa

SEQ ID NO: 4238 - RNA, 4323 nt, synthetic construct
  misc_feature 1..4323: note = derived and/or modified CDS sequence (wt) from TAHV(4030)__GQ386836.1__GP
  source 1..4323: mol_type = other RNA
atgatgttcgtattgtttttcattgcactaagtgctgcaagcccagtttatcagaggtgtttccaggatggtgcaattgtcaagcaaaacccatccaaacaagctgtaacagaggtatgcctaaaggatgacgttagtatgataaaaacagaagctagatatttcagaaatgctaccggaacatatgccaacaatgttgccattagaaagtggcttgtctcagattggcatgactgcagaccaaaaaaagtctcagggggtcatataaatgttatagaagttggagatgacttaacgctgcatacagaggcatatgtatgcaatgcagactgcacaataggtgtagataaagaaaccgcacaagtaagattgcaaacagatacaacaaatcattttgagattgcaggaacaacagttaagtcagggtggttcaaaagcacaacttatatcacccttgatcaaacttgcgagcatttgaaagtttcttgtgggcctaaatctatacagttccatgcgtgtttcaatcaacacatgtcttgtgttagattcttacataggacaatcctacctgggtctattgccagctccatatgccaaaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcggataggatgaaattgcacagggcatctgggttgtgtccaggttataaaagtctcagggctgcaagagtcatgtgcaaatctaaagggccagcttctattttatctataatcactgcagtgttgatccttacttttgtcactcccataaatgccatggtagctggggacacacaagaaacatttaagcttgaggacctaccagatgacatgctgagcatggcaatgaaagtaaatatgtactacattatgtgtatgataaattatgctgtaacttggtcatttattttatgcgccctattaattgctttactcttcaagaagtatcagcatagattcttaaacttttatgccatgtactgcaacgagtgcgatatgtaccatgatagatctggcctaaaatataatggagacttcacaaacaaatgtagacagtgcacatgcgggcagtacgaagatgccgcaggtctactaacccacagaaaaacatacaactgcctcgtgcagtacaaatcaaaatggctgactaatttcttaattgtatacataatcttgatgcttattaaagattctgtactaatagtgcatgctgatggcacagactttgaaaaatgcagtggtgaggcggatataacatggaattgtacaggaccattcttgaatttaggtaattgtgagaagaagcaaaagaaggagtcatataataatatagcaactcaactaaaagggctagatgccatatcggttttagatatccccatgatatctaaaataccagaggatatagctggagccctaagattcattgaagagcaaagatcataccatgtccaactgactgcagaatatgctatgctaactagatactgcgattattatacccaattcactgataattctggatacagtcagaccacatggagggtttacttgagatcccacgattttgaggcatgtattttatatcccaatcagcatttttgcagatgtgtcaagcatggggacaaatgctcaagctccaattgggatttcgccaatgagatgaagaactattacagtggaaaacagtccaaatttgataaagatttaaatttagcattgatgtccttacaccacgcatttagaggaacatctagtttttatattgctaaactcctgaaggaaaagaaaaatgaagaccttataacttatgcagaaaagattaaaggcaaatacccaggcaatgccttgctaaaggcaataattgactacataaagtatatgaaggatttaactgagatgaacaatttcaaacatgatgagatgtgggatgacttcatatttgaagttcctcctacaaagagcccatcagtaagaagattagagtcttcatatgattttaaaactaatgtaaattcaaacccatcacacatttgcaagaatatcaaaactgtggtctgcttgtcaccaaagtcaggagtgtcatatgattcaataattgcctgtggggagccaagccagccaagcatctacagaaagccagacagtcaagttttccaatcaaatgctgaccagacacatttttgtttatcagatacacactgcctggaaaattatgagacagttggagaggaaatcattgatgcaattaaaaaatcgaaatgctgggaaacagaatttactgagtacatccaatttaaacagagtgatggggtaaggagttgcaggatgaaagactcaggagaatgtacagtcaccaccaatagatggcctataatactctgcgataacgataaattctactactctgagttgcagaaagattatgataaggaccaggatataggtcacttctgtctcagcccaagatgcaacacaattaggcaccctataaatcggaaacatatatcaaattgtacgtggcaggttagtcacaacaatatagacaagattgaggtacatgaactggaggatcttgaacagtataagaaggccataacacagaagttgcagacaagcctaaccctatttaaatactcaaagacaaaaaacttgccccatatcaagcctatgtacaaatatataacaattgaaggaacagagactgctgagggtatagaaagtgcttatatagaatcagagatacccgctctagcaggaacatcaataggtttcaagatcacatccaagtctggaaagcatttattagatgtcattggttatgttaagagcgcatcttattcagccgtttatacaaaattgtatacaacaggacccactataggtgttaacactaaacatgatgaattatgcacagggccatgtcctgtcaatgtgcctcatggcacaggctggctcacatttgctaaggagaggacaagctcctgggggtgtgaagaatttggctgcctggcaattagtgatgggtgtgtttttggttcctgtcaagatattataaaagatgaaataattgtctataggaaggagactgaggagaccacagatgtggaattgtgcctgacatttgcagacaaaacatattgcactaacctcaatgcaattacccctataatcaccgaccagtttgaagtccaatttaaaactgtggaggcttacagtctgcctagaatcattgcagtgcggaatcatgagattatggttgggcaaataaatgacataggtgtttactcaaaaggctgtggaaatgtacagaaagtaaacaacacgaattatggaaatggtgtgcctaagtttgattacctgtgtcatttagcaagtagaaaagaagtgatagtgaggaaatgctttgataatgactaccaggcctgcaaatttctacaaacaccagcgagttataggctagaagaggagggaggttcagttacagtcatagactacaagaaaatccttggcactataaagatgaaggctatccttggagatgtgaaatataaaacatttgcagacaatgtggacttaaccgttgagggggtatgcactggctgcgtcaattgttttgaaaatatacattgtgagttaacaatacacagtacagttgaagccagctgctcggtagtaagttcgtgtacagtatttcatgatagaattttgataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaagatgaaaggtgcaagacttggatgtgcagagtaagagatgaaggttttcaagtaatttttgaaccattcaaaaacttatttggttcttatattgggatattttatacatttataatatctttaatggcaatatttatagttatatatattgtgttgcctatatgtttcaaacttagagacacactgaggcagcatgaagacgcttataagagagagatgaaaattaggtaa

SEQ ID NO: 4239 - RNA, 4323 nt, synthetic construct
  misc_feature 1..4323: note = derived and/or modified CDS sequence (wt) from TAHV(4033)__GQ386837.1__GP
  source 1..4323: mol_type = other RNA
atgatgttcgtattgtttttcattgcactaagtgctgcaagcccagtttatcagaggtgtttccaggatggtgcaattgtcaagcaaaacccatccaaacaggctgtaacagaggtatgcctaaaggatgacgttagtatgataaaaacagaagctagatatttcagaaatgctaccggaacatatgccaacaatgttgccattagaaagtggcttgtctcagattggcatgactgcagaccaaaaaaagtctcagggggtcatataaatgttatagaagttggagatgacttaacgctgcatacagaggcatatgtatgcaatgcagactgcacaataggtgtagataaagaaaccgcacaagtaagattgcaaacagatacaacaaatcattttgagattgcaggaacaacagttaagtcagggtggttcaaaagcacaacttatatcacccttgatcaaacttgcgagcatttgaaagtttcttgtgggcctaaatctatacagttccatgcgtgtttcaatcaacacatgtcttgtgttagattcttacataggacaatcctacctgggtctattgccagctccatatgccaaaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcggataggatgaaattgcacagggcatctgggttgtgtccaggttataaaagtctcagggctgcaagagtcatgtgcaaatccaaagggccagcttctattttatctataatcactgcggtgttaatccttacttttgtcactcccataaatgccatggtagctggggacacacaagaaacatttaagcttgaggacctaccagatgacatgctgagcatggcaatgaaagtaaatatgtactacattatgtgtatgataaattatgctgtaacttggtcatttattttatgcgccctattaattgctttactcttcaagaagtatcagcatggattcttaaacttttatgccatgtactgccacgagtgcgatatgtaccatgatagatctggcctaaaatataatggagacttcacaaacaaatgtagacagtgcacatgcgggcagtacgaagatgccgcaggtctactaacccacagaaaaacatacaactgcctcgtgcagtacaaatcaaaatggctgactaatttcttaattgtatacataatcttgatgcttattaaagattctgtactaatagtgcatgctgatggcacagactttgaaaaatgcagtggtgaggcggatataacatggaattgtacaggaccattcttgagtctaggtaattgtgagaagaagcaaaagaaggagtcatataataatatagcaactcaattaaaagggctagatgccatatcggttttagatatccccatgatatctaaaataccagaggatatagctggagccctaagattcattgaagagcaaagatcataccatgtccaactgactgcagaatatgctatgctaactagatactgcgattattacacccaattcactgacaattctggatacagtcaaaccacatggagggtttacttgagatcccacgattttgaggcatgtattttatatcccaatcagcatttttgcagatgtgtcaagcatggggacaaatgctcaagctccaattgggatttcgccaatgagatgaagaactactacagtggaaaacagtccaaatttgataaagatttaaatttagcattgatgtccttacaccacgcatttagaggaacatctagtttttatattgctaaactcctgaaggaaaagaaaaatgaagaccttgtaacttatgcagaaaagattaaaggcaaatacccaggcaatgccctgctaaaggcaataattgactacataaagtatatgaaggatttaaccgagatgaacaatttcaaacatgatgagatgtgggatgacttcatatttgaagttcctcctacaaagagcccatcagtaagaagattagaatcttcatatgattttaaaactaatgtaaattcaaacccatcacacatttgcaagaatatcaaaactgtggtctgcttgtcaccaaagtcaggagtgtcatatgattcaataattgcctgtggggagccaagccagccaagcatctacagaaagccagacagtcaagttttccaatcaaatgctgaccagacacatttttgtttatcagatacacactgcctggaaaattatgagacagttggagaggaaatcattgatgcaattaaaaaatcgaaatgctgggaaacagaatttactgagtacatccaatttaaacagagtgatggggtaaggagttgcaggatgaaagactcaggagaatgtacagtcaccaccaatagatggcctataatactctgcgataacgataaattctactactctgagttgcagaaagattatgataaggaccaggatataggtcacttctgtctcagcccaagatgcaacacaattaggcaccctataaatcggaaacatatatcaaattgcacgtggcaggttagtcacaacaatatagacaagattgaggtacatgaactggaggatcttgaacagtataagaaggccataacacagaagttgcagacaagcctaaccctatttaaatactcaaagacaaaaaacttgccccatatcaagcctatgtacaaatatataacaattgaaggaacagagactgctgagggtatagaaagtgcttatatagagtcagagatacccgctctagcaggaacatcaataggtttcaagatcacatccaagtctggaaagcatttattagatgtcattggttatgttaagagcgcatcttattcggccgtttatacaaaattgtatacaacaggacctactataggtgttaacactaaacatgatgaattatgcacagggccatgtcctgtcaatgtgcctcatggcacaggttggctcacatttgctaaggagaggacaagctcctgggggtgtgaagaatttggctgcctggcaattagcgatgggtgtgtttttggctcctgtcaagatattataaaagatgaaataactgtctataggaaggagactgaggagaccacagatgtggaattgtgcctgacatttgcagacaaaacatattgcactaacctcaatgcaattacccctataatcaccgaccagtttgaagtccaatttaaaactgtagaggcttatagtctgcctagaatcattgcagtgcggaatcatgagattatggttgggcaaataaatgacataggtgtttactcaaaaggctgtggaaatgtacagaaagtaaacaacacaaattatggaaatggtgtgcctaagtttgattacctatgtcatttagcaagtagaaaagaagtgatagtgaggaaatgctttgataatgactaccaggcctgcaaatttctacaaacaccagcaagttataggctagaagaggagggaggttcagttacagtcatagactacaagaaaatccttggcactataaagatgaaggctatccttggagatgtgaaatataaaacatttgcagacaatgtggacttaaccgttgagggggtatgcactggctgcatcaattgttttgaaaatatacattgtgagttaacaatacacagtacagttgaagccagctgcccggtagtaagttcgtgtacagtatttcatgatagaattttaataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaagatgaaaggtgcaagacttggatgtgcagagtaagagatgaaggttttcaagtaatttttgaaccattcaaaaacttatttggttcttatattgggatattttatacatttataatatctttaatggcaatatttatagttatatatattgtgttgcctatatgtttcaaacttagagacacactgaggcagcatgaagacgcttataagagagagatgaaaattaggtaa

SEQ ID NO: 4240 - RNA, 4323 nt, synthetic construct
  misc_feature 1..4323: note = derived and/or modified CDS sequence (wt) from TAHV(4034)__GQ386838.1__GP
  source 1..4323: mol_type = other RNA
atgatgttcgtattgtttttcattgcactaagtgctgcaagcccagtttatcagaggtgtttccaggatggtgcaattgtcaagcaaaacccatccaaacaggctgtaacagaggtatgcctaaaggatgacgttagtatgataaaaacagaagctagatatttcagaaatgctaccggaacatatgccaacaatgttgccattagaaagtggcttgtctcagattggcatgactgcagaccaaaaaaagtctcagggggtcatataaatgttatagaagttggagatgacttaacgctgcatacagaggcatatgtatgcaatgcagactgcacaataggtgtagataaagaaaccgcacaagtaagattgcaaacagatacaacaaatcattttgagattgcaggaacaacagttaagtcagggtggttcaaaagcacaacttatatcacccttgatcaaacttgcgagcatttgaaagtttcttgtgggcctaaatctatacagttccatgcgtgtttcaatcaacacatgtcttgtgttagattcttacataggacaatcctacctgggtctattgccagctccatatgccaaaatgtagagataataatattaacagtgctaaccctccttatatttatactattaagcatactgagtaaaacttacatatgttatacactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcggataggatgaaattgcacagggcatctgggttgtgtccaggttataaaagtctcagggctgcaagagtcatgtgcaaatccaaagggccagcttctattttatctataatcactgcagtgttaatccttacttttgtcactcccataaatgctatggtagctggggacacacaagaaacatttaagcttgaggacctaccagatgacatgctgagcatggcaatgaaagtaaatatgtactacattatgtgtatgataaattatgctgtaacttggtcatttattttatgcgctctattaattgctttactcttcaagaagtatcagcatagattcttaaacttttatgccatgtactgccacgagtgcgatatgtaccatgatagatctggcctaaaatataatggagacttcacaaacaaatgtagacagtgcacatgcgggcagtatgaagatgccgcaggtctactaacccacagaaaaacatacaactgcctcgtgcagtacaaatcaaaatggctgactaatttcttaattgtatacataatcttgatgcttattaaagattctatactaatagtgcatgctgatggcacagactttgaaaaatgcagtggtgaggcggatataacatggaattgtacaggaccattcttgaatctaggtaattgtgagaagaagcaaaagaaggagtcatataataatatagcaactcaactaaaagggctagatgccatatcggttttagatatccccatgatatctaaaataccagaggatatagctggagccctaagattcattgaagagcaaagatcataccatgtccaactgactgcagaatatgctatgctaactagatgctgcgattattatacccaattcactgacaattctggatacagtcagaccacatggagggtttacttgagatcccacgattttgaggcatgtattttatatcccaatcagcatttttgcagatgtgtcaagcatgggaacaaatgctcaagctccaattgggatttcgctaatgagatgaagaactattacagtggaaaacagtccaaatttgataaagatttaaatttagcattgatgtccttacaccacgcatttagaggaacatctagtttttatattgccaaactcctgaaggaaaagaaaaatgaagaccttgtaacttatgcagaaaagattaaaggcaaatacccaggcaatgccttgctaaaggcaataattgactacataaagtatatgaaggatttaaccgagatgaacaatttcaaacatgatgagatgtgggatgacttcatatttgaagttcctcctaccaagagcccatcagtaagaagattagagtcttcatatgattttaaaactaatgtaaattcaaacccatcacacatttgcaagaatatcaaaactgtggtctgcttgtcaccaaagtcaggagtatcatatgattcaataattgcctgtggggagccaagccagccaagcatctacagaaagccagacagtcaagttttccaatcaaatactgaccagacacatttttgtttatcagatacacactgcctggaaaattatgaggcagttggagaggaaatcattgatgcaattaaaaaatcgaaatgctgggaaacagaatttactgagtacatccaatttaaacagagtgatggggtaaggagttgcaggatgaaagactcaggagaatgtacagtcaccaccaatagatggcctataatactctgcgataacgataaattctactactctgagttgcagaaagattacgataaggaccaggatataggtcacttctgtctcagcccaagatgcaacacaattaggcaccctataaatcggaaacatatatcaaattgtacatggcaggttaatcacaacaatatagacaagattgaggtacatgaactggaggatcttgaacagtataagaaggccataacacagaagttgcagacaagcctaaccctatttaaatactcaaagacaaaaaacttgccccatatcaagcctatgtacaaatatataacaattgaaggaacagagactgctgagggtatagaaagtgcttatatagaatcagagatacccgctctagcaggaacatcaataggtttcaagatcacatccaagtctggaaagcatttattagatgtcattggttatgttaagagcgcatcttattcggccgtttatacaaaattgtatacaacaggacctactataggtgttaacactaaacatgatgaattatgcacagggccatgtcctgttaatgtgcctcatggcacaggttggctcacatttgctaaggagaggacaagctcctggggatgtgaagaatttggctgcctggcaattagcgatgggtgtgtttttggttcctgtcaagatattataaaagatgaaataactgtctataggaaggagactgaggagaccacagatgtggaattgtgcctgacatttgcagacaaaacatattgcactaacctcaatgcaattacccctataatcaccgaccagtttgaagtccaatttaaaactgtagaggcttacagtctgcctagaatcattgcagtgcggaatcatgagattatggttgggcaaataaatgacataggtgtttactcaaaaggctgtggaaatgtacagaaagtaaacaacacaaattatggaaatggtgtgcctaagtttgattacctgtgtcatttagcaagtagaaaagaagtgatagtgaggaaatgctttgataatgactaccaggcctgcaaatttctacaaataccagcgagttataggctagaagaggagggaggttcagttacagtcatagactacaagaaaatccttggcactataaagatgaaggctatccttggagatgtgaaatataaaacatttgcagacaatgtggacttaaccgttgagggggtatgcactggctgcatcaattgttttgaaaatatacattgtgagttaacaatacacagtacagttgaagccagctgcccggtagtaagttcgtgtacagtatttcatgatagaattttaataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaagatgaaaggtgcaagacttggatgtgcagagtaagagatgaaggttttcaagtaatttttgaaccattcaaaaacttatttggttcttatattgggatattttatacatttataatatctttaatggcaatatttatagttatatatattgtgttgcctatatgtttcaaacttagagacacactgaggcagcatgaagacgcttacaagagagagatgaaaattaggtaa

SEQ ID NO: 4241 - RNA, 4323 nt, synthetic construct
  misc_feature 1..4323: note = derived and/or modified CDS sequence (wt) from TAHV(4057)__GQ386839.1__GP
  source 1..4323: mol_type = other RNA
atgatgttcgtattgtttttcattgcactaagtgctgcaagcccagtttatcagaggtgtttccaggatggtgcaattgtcaagcaaaacccatccaaacaggctgtaacagaggtatgcctaaaggacgacgttagtatgataaaaacagaagctagatatttcagaaatgctaccggaacatatgccaacaatgttgccattagaaagtggcttgtctcagattggcatgactgcagaccaaaaaaagtctcagggggtcatataaatgttatagaagttggagatgacttaacgctgcatacagaggcatatgtatgcaatgcagactgcacaataggcgtagataaagaaaccgcacaagtaagattgcaaacagatacaacaaatcattttgagattgcaggaacaacagttaagtcagggtggttcaaaagcacaacttatatcacccttgatcaaacttgcgagcatttgaaaggttcttgtgggcctaaatctatacagttccatgcgtgtttcaatcaacacatgtcttgtgttagattcttacataggacaatcctacctgggtctattgccagctccatatgccaaaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcggataggatgaaattgcacagggcatctgggttgtgtccaggttataaaagtctcagggctgcaagagtcatgtgcaaatccaaagggccagcttctattttatctataatcactgcagtgttaatccttacttttgtcactcccataaatgccatggtagctggggacacacaagaaacatttaagcttgaggacctaccagatgacatgctgagcatggcaatgaaagtaaatatgtactacattatgtgtataataaattatgctgtaacttggtcatttattttatgcgctctattaattgctttactcttcaagaagtatcagcatagattcttaaacttttatgccatgtactgccacgagtgcgatatgtaccatgatagatctggcctaaaatataatggagacttcacaaacaaatgtagacagtgcacatgcgggcagtacgaagatgccgcaggtctactaacccacagaaaaacatacaactgcctcgtgcagtacaaatcaaaatggctgactaatttcttaattgtatacataatcttgatgcttattaaagattctgtactaatagtgcatgctgatggcacagactttgaaaaatgcagtggtgaggcggatataacatggaattgtacaggaccattcttgaatctaggtaattgtgagaagaagcaaaagaaggagtcatataataatatagcaactcaactaaaagggctagatgccatatcggttttagatatccccatgatatctaaaataccagaggatatagctggagccctaagattcattgaagagcaaagatcataccatgtccaattgactgcagaatatgctatgctaactagatactgcgattattatacccaattcactgacaattctggatacagtcagaccacatggagggtttacttgagatcccatgattttgaggcatgtattttatatcccaatcagcatttttgcagatgtgtcaagcatggggacaaatgctcaagctccaattgggattttgccaatgagatgaagaactattacagtggaaaacagtctaaatttgataaagatttaaatttagcattgatgtccttacaccacgcatttagaggaacatctagtttttatattgctaaactcctgaaggaaaagaaaaatggagaccttgtaacttatgcagaaaagattaaaggaaaatacccaggcaatgccttgctaaaggcaataattgactacataaagtatatgaaggatttaaccgagatgaacaatttcaaacatgatgagatgtgggatgacttcatatttgaagttcctcctacaaagagcccatcagtaagaagattggagtcttcatatgattttaaaactaatgtaaattcaaacccatcacacatttgcaagaatatcaaaactgtggtctgcttgtcaccaaagtcaggagtgtcatatgattcaataattgcctgtggggagccaagccagccaagcatctacagaaagccagacagtcaagtcttccaatcaaatgctgaccagacacatttttgtttatcagatacacactgcctggaaaattatgagacagttggagaggaaatcattgatgcaattaaaaaatcgaaatgctgggaaacagaatttactgagtacatccaatttaaacagagtgatggggtaaggagttgcaggatgaaagactcaggagaatgtacagtcaccaccaataaatggcctataatactctgcgataacgataaattctactactctgagttgcagaaagattatgataaggaccaggatataggtcacttctgtctcagcccaagatgcaacacaattaggcaccctataaatcggaaacatatatcaaattgtacatggcaggttagtcacaacaatatagacaagattgaggtacatgaactggaggatcttgaacagtataagaaggccataacacagaagttgcagacaagcctaaccctatttaaatactcaaagacaaaaaacttgccccatatcaagcctatgtacaaatatataacaattgaaggaacagagactgctgagggtatagaaagtgcttatatagaatcagagatacccgctctagcaggaacatcaataggtttcaagatcacatccaagtctggaaggcatttattagatgtcattggctatgttaagagcgcatcttattcagccgtttatacaaaattgtatacaacaggacctactataggtgttaacactaaacatgatgaattatgcacagggccatgtcctgtcaatgtgcctcatggcacaggttggctcacatttgctaaggagaggacaagctcctgggggtgtgaagaatttggctgcctggcaattagcgatgggtgtgtttttggttcctgtcaagatattataaaagatgaaataactgtctataggaaggagactgaggagaccacagatgtggaattgtgcctgacatttgcagacaaaacatattgcactaacctcaatgcaattacccctataattaccgaccagtttgaagtccaatttaaaactgtagaggcttacagtctgcctagaatcattgcagtgcggaaccatgagattatggttgggcaaataaatgacataggtgtttactcaaaaggctgtggaaatgtacagaaagtaaacaacacaaattatggaaatggtgtgcctaagtttgattacctgtgtcatttagcaagtagaaaagaagtgatagtgaggaaatgctttgataatgactaccaggcctgcaaatttctacaaacaccagcaagttataggctagaagaggagggaggttcagttacagtcatagactacaagaaaatccttggcactataaagatgaaggctatccttggagatgtgaaatataaaacatttgcagacaatgtggatttaaccgttgagggggtatgcactggctgcgtcaattgttttgaaaatatacattgtgagtcaacaatacacagtacagttgaagccagctgcccggtagtaagttcgtgtacagtatttcatgatagaattttaataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaagatgaaaggtgcaagacttggatgtgcagagtaagagatgaaggttttcaagtaatttttgaaccattcaaaaacttatttggttcttatattgggatattttatacatttataatatctttgatggcaatatttatagttatatatattgtgttgcctatatgtttcaaacttagagacacactgaggcagcatgaagacgcttataagagagagatgaaaattaggtaa

SEQ ID NO: 4242 - RNA, 4323 nt, synthetic construct
  misc_feature 1..4323: note = derived and/or modified CDS sequence (wt) from TAHV(4060)__GQ386840.1__GP
  source 1..4323: mol_type = other RNA
atgatgttcgtattgtttttcatcgcactaagtgctgcaagcccagtttatcagaggtgtttccaggatggtgcaattgtcaagcaaaacccatccaaacaggctgtaacagaagtatgcctaaaggatgacgttagtatgataaaaacagaagctagatatttcagaaatgctaccggaacatatgccaacaatgttgccattaggaagtggcttgtctcagattggcatgactgcagaccaaaaaaagtctcagggggtcatataaatgttatagaagttggagatgacttaacgctgcatacagaggcatatgtatgcaatgcagactgcacaataggtgtagataaagaaaccgcacaagtaagattgcaaacagatacaacaaatcattttgagattgcaggaacaacagttaagtcagggtggttcaaaagcacaacttatatcacccttgatcaaacttgcgagcatttgaaagtttcttgtgggcctaaatctatacagttccatgcgtgtttcaatcaacacatgtcttgtgttagattcttacataggacaatcctacctggatctattgccagctccatatgccaaaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcggataggatgaaattgcacagggcatctgggttgtgtccaggttataaaagtctcagggctgcaagagtcatgtgcaaatccaaagggccagcttctattttatctataatcactgcaatattaatccttacttttgtcactcccataaatgccatggtagctggggacacacaagaaacatttaagcttgaggacctaccagatgacatgctgagcatggcaatgaaagtaaatatgtactacattatgtgtatgataaattatgctgtaacttggtcatttattttatgcgccctattaattgccttactcttcaagaagtatcagcatagattcttaaacttttatgccatgtactgccacgagtgcgatatgtaccatgatagatctggcctaaaatataatggagacttcacaaacaaatgtagacagtgcacatgcgggcagtacgaagatgccgcaggtctacaaacccacagaaaaacatacaactgccttgtgcagtacaaatcaaaatggctgactaatttcttaatagtatatataatcttgatgcttattaaagattctgtactaatagtgcatgccgatggcacagactttgaaaaatgcagtggtgaggcggatataacatggaattgtacaggaccattcttgaatctaggtaactgtgagaagaagcaaaagaaggagtcatataataatatagcaactcaactaaaagggctagatgccatatcggttttagatatccccatgatatctaaaataccagaggatatagctggagctctaagattcattgaagagcaaagatcataccatgtccaactgactgcagaatatgctatgctaactagatactgcgattattatacccaattcactgacaattctggatacagtcagaccacatggagggtttacttgaggtcccacgattttgaggcatgtattttatatcccaatcagcatttttgtagatgtgtcaagcatggggacaaatgctcaagctccaattgggatttcgccaatgagatgaagaactattacagtggaaagcagtccaaatttgataaagatttaaatttagcattgatgtccttacaccacgcattcagaggaacatctagtttttatattgctaaactcctgaaggaaaagaaaaatgaggatcttgtaacttatgcagaaaagattaaaggcaaatacccaggcaatgccttgctaaaggcaataattgactacataaagtatatgaaggatttaaccgagatgaacaatttcaaacatgatgagatgtgggatgacttcatatttgaagttcctcctacaaagagcccatcagtgagaagattagagtcttcatatgattttaaaaccaatgtaaattcaaacccatcacatatttgcaagaatatcaaaactgtggtctgcttgtcaccaaagtcaggagtgtcatatgattcaataattgcctgtggggagccaagccagccaagcatctacagaaagccagacagtcaagtttttcaatcaaatgctgaccagacacatttttgtttatcagatacacactgcctggaaaattatgagacagttggagaggaaatcattgatgcaattaaaaaatcaaaatgctgggaaacagaatttactgagtacacccaatttaaacagagtgatggggtaaggagttgcaggatgaaagactcaggagaatgtacagtcaccaccaatagatggcctataatactctgcgataacgataaattctactactctgagttgcagaaagattatgataaggaccaggatataggtcacttctgtctcagcccaagatgcaatacaattaggcaccctataaatcggaaacatatatcaaattgtacgtggcaggttagtcacaacaatatagacaagattgaggtacatgaactggaggatcttgaacagtataagaaggccataacacagaaattgcagacaagcctaaccctatttaaatactcaaagacaaaaaacttgccccatatcaagcctatgtacaaatatataacaattgaaggaacagagactgctgagggtatagaaagtgcttatatagaatcagagatacccgctctagcaggaacatcaataggtttcaagatcacatccaagtctggaaagcatttattagatgtcattggttatgttaagagcgcatcttattcagccgtttatacaaaattgtatacaacaggacctactataggtgttaacactaaacatgatgaattatgcacagggccatgtcctgtcaatgtgcctcatggcacaggttggctcacatttgctaaggagaggacaagctcctgggggtgcgaagaatttggctgcctggcaattagcgatgggtgtgtttttggttcttgtcaagatattataaaagatgaaataactgtctataggaaggagactgaggagaccacagatgtggaattgtgcctgacatttgcagacaaaacatactgcaccaacctcaatgcaattacccctataatcaccgaccagtttgaagtccaatttaaaactgtagaggcttacagtctgcctagaatcatcgcagtgcggaatcatgagattatggttgggcaaataaatgacataggtgtttactcaaaaggctgtggaaatgtacagaaagtaaacaacacaaattatggaaatggtgtgcctaaatttgattacctgtgtcatttagcaagtagaaaagaagtgatagttaggaaatgctttgataatgactaccaggcctgcaaatttctacaaacaccagcgagttataggctagaagaggagggaggttcagttacagtcatagactacaagaaaatccttggcactataaagatgaaggctatccttggagatgtgaaatataaaacatttgcagacaatgtggacttaaccgttgagggggtatgcactggctgcatcaattgttttgaaaatatacattgtgagttaacaatacacagtacagttgaagccagctgcccggtagttagttcgtgtacagtatttcatgatagaattttaataaccccaaatgagcacaagtatgctataaaggtgatctgcaatgaaaagccagggcctacattaccgttcaagatctgcagcgcaaagacagatgctgcaatgacactggcagatgctaagccaatattagagctagcacctgtagaccaaacaacatatattaaggagaaagatgaaaggtgcaagacttggatgtgcagagtaagagatgaaggttttcaagtgatttttgaaccattcaaaaacttatttggttcttatattgggatattttatacatttataatatctttaatagcaatatttatagttatatatattgtgttgcctatatgtttcaaacttagagacacactgaggcagcatgaagacgcctataagagagagatgaaaattaggtaa

SEQ ID NO: 4243 - RNA, 4323 nt, synthetic construct
  misc_feature 1..4323: note = derived and/or modified CDS sequence (wt) from TAHV(5060)__GQ386841.1__GP
  source 1..4323: mol_type = other RNA
atgatgttcgtattgtttttcattgcactaagtgctgcaagcccagtttatcagaggtgtttccaggatggtgcaattgtcaagcaaaacccatccaaacaggctgtaacagaggtatgcctaaaggacgacgttagtatgataaaaacagaagctagatatttcagaaatgctaccggaacatatgccaacaatgttgccattagaaagtggcttgtctcagattggcatgactgcagaccaaaaaaagtctcagggggtcatataaatgttatagaagttggagatgacttaacgctgcatacagaagcatatgtatgcaatgcagactgcacaataggtgtagataaagaaactgcacaagtaagattgcaaacagatacaacaaatcattttgagattgcaggaacaacagttaagtcagggtggttcaaaagcacaacttatatcacccttgatcaaacttgcgagcatttgaaagtttcttgtgggcctaaatctatacagttccatgcgtgtttcaatcaacacatgtcttgtgttagattcttacataggacaatcctacctgggtctattgccagctccatatgccaaaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcggataggatgaaattgcacagggcatctgggttgtgtccaggttataaaagtctcagggctgcaagagtcatgtgcaaatccaaagggccagcttctattttatctataatcactgcagtgttaatccttacttttgtcactcccataaatgccatggtagctggggacacacaagaaacatttaagcttgaggacctaccagatgacatgctgagcatggcaatgaaagtaaatatgtactacattatgtgtataataaattatgctgtaacttggtcatttattttatgcgctctattaattgctttactcttcaagaagtatcagcataggttcttaaacttttatgccatgtactgccacgagtgcgatatgtaccatgatagatctggcctaaaatataatggagacttcacaaacaaatgtagacagtgcacatgcgggcagtacgaagatgccgcaggtctactaacccacagaaaaacatacaactgcctcgtgcagtacaaatcaaaatggctgactaatttcttaattgtatacataatcttgatgcttattaaagattctgtactaatagtgcatgctgatggcacagactttgaaaaatgcagtggtgaggcggatataacatggaattgtacaggaccattcttgaatctaggtaattgtgagaagaagcaaaagaaggagtcatataataatatagcaactcaactaaaagggctagatgccatatcggttttagatatccccatgatatctaaaataccagaggatatagctggagccctaagattcattgaggagcaaagatcataccatgtccaattgactgcagaatatgctatgctaactagatactgcgattattatacccagttcactgacaattctggatacagtcagaccacatggagggtttacttgagatcccatgattttgaggcatgtattttatatcccaatcagcatttttgcagatgtgtcaagcatggggataaatgctcaagctccaattgggatttcgccaatgagatgaagaactattacagtggaaaacagtctaaatttgataaagatttaaatttagcattgatgtccttacaccacgcatttagaggaacatctagtttttatattgctaaactcctgaaggaaaagaaaaatggagaccttgtaacttatgcagaaaagattaaaggcaaatatccaggcaatgccttgctaaaggcaataattgactacataaagtatatgaaggatttaaccgagatgaacaatttcaaacatgatgagatgtgggatgacttcatatttgaagtttctcctacaaagagcccatcagtaagaagattggagtcttcatatgattttaaaactaatgtaaattcaaacccatcacacatttgcaagaatatcaaaactgtggtctgtttgtcaccaaagtcaggagtgtcttacgattcaataattgcctgtggggagccaagccagccaagcatctacagaaagccagacagtcaagtcttccaatcaaatgctgaccagacacatttttgtttatcagatacacactgcctggaaaattatgagacagttggagaggaaatcattgatgcaattaaaaaatcgaaatgctgggaaacagaatttactgagtacatccaatttaaacagagtgatggggtaaggagttgcaggatgaaagactcaggagaatgtacagtcaccaccaataaatggcctataatactctgcgataacgataaattctactactctgagttgcagaaagattatgataaggaccaggatataggtcacttctgtctcagcccaagatgcaacacaattaggcaccctataaatcggaaacatatatcaaattgtacatggcaggttagtcacagcaatatagacaagattgaggtacatgaactggaggatcttgaacagtataagaaggccataacacagaagttgcagacaagcctaaccctatttaaatactcaaagacaaaaaacttgccccatatcaagcctatatacaaatatataacaattgaaggaacagagactgctgagggtatagaaagtgcttatatagaatcagagatacccgctctagcaggaacatcaataggtttcaagatcacatccaagtctggaaagcatttattagatgtcattggttatgttaagagcgcatcttattcagccgtttatacaaaattgtatacaacaggacctactataggtgttaacactaaacatgatgaattatgcacagggccatgtcctgtcaatgtgcctcatggcacaggttggctcacatttgctaaggagaggacaagctcctgggggtgtgaagaatttggctgcctggcgattagcgatgggtgtgtttttggttcctgtcaagatattataaaagatgaaataactgtctataggaaggagactgaggagaccacagatgtggaattgtgcctgacatttgcagacaaaacatattgcactaacctcaatgcaattacccctataatcaccgaccaatttgaagtccaatttaaaactgtagaggcttacagtctgcctagaatcattgcagtgcggaaccatgagattatggttgggcaaataaatgacataggtgtttactcaaaaggctgtggaaatgtacagaaagtaaacaacacaaattatggaaatggtgtgcctaagtttgattacctatgtcatttagcaagtagaaaagaagtgatagtgaggaaatgctttgataatgactatcaggcctgcaaatttctacaaacaccagcaagttataggctagaagaagagggaggttcagttacagtcatagactacaagaaaatccttggcactataaagatgaaggctatccttggagatgtgaaatacaaaacatttgcagacaatgtggacttaaccgttgagggggtatgcactggctgcatcaattgttttgaaaatatacattgtgagttaacaatacacagtacagttgaagccagctgcccggtagtaagttcgtgtacagtatttcatgatagaattttaataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaagatgaaaggtgcaagacttggatgtgcagagtaagagatgaaggttttcaagtaatttttgaaccattcaaaaacttatttggttcttatattgggatattttatacatttataatatctttaatggcaatatttatagttatatatattgtgttgcctatatgtttcaaacttagagacacactgaggcagcatgaagacgcttataagagagagatgaaaattaggtaa

SEQ ID NO: 4244 - RNA, 4323 nt, synthetic construct
  misc_feature 1..4323: note = derived and/or modified CDS sequence (wt) from TAHV(76)__GQ386824.1__GP
  source 1..4323: mol_type = other RNA
atgatgttcgtattgttttttattgcactaagtgctgcaagcccagtttatcagaggtgtttccaggatggtgcaattgtcaagcaaaacccatccaaacaggctgtaacagaggtatgcctaaaggatgacgttagtatgataaaaacagaagctagatatttcagaaatgctaccggaacatatgccaacaatgttgccattagaaagtggcttgtctcagattggcatgactgcagaccaaaaaaagtctcagggggtcatataaatgttatagaagttggagatgacttaacgctgcatacagaggcatatgtatgcaatgcagactgcacaataggtgtagataaagaaaccgcacaagtaagattgcaaacagatacaacaaatcattttgagattgcaggaacaacagttaagtcagggtggttcaaaagcacaacttatatcacccttgatcaaacttgcgagcatttgaaagtttcttgtgggcctaaatctatacagttccatgcgtgtttcaatcaacacatgtcttgtgttagattcttacataggacaatcctaccagggtctattgccagctccatatgccaaaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcggataggatgaaattgcacagggcatctgggttgtgtccaggttataaaagtctcagggctgcaagagtcatgtgcaaatccaaagggccagcttctattttatctataatcactgcagtgttaatccttacttttgtcactcccataaatgctatggtagctggggacacacaagaaacatttaagcttgaggacctaccagatgacatgctgagcatggcaatgaaagtaaatatgtactacattatgtgtatgataaattatgctgtaacttggtcatttattttatgcgccctattaattgctttactcttcaagaagtatcagcatagattcttaaacttttatgccatgtactgccacgagtgcgatatgtaccatgatagatctggcctaaaatataatggagacttcacaaacaaatgtagacagtgcacatgcgggcagtacggagatgccgcaggtctactaacccacagaaaaacatacaactgcctcgtgcagtacaaatcaaaatggctgactaatttcttaattgtatacataatcttgatgcttattaaagattctgtactaatagtgcatgctgatggcacagactttgaaaaatgcagtggtgaggcggatataacatggaattgtacaggaccattcttgaatctaggtaattgtgagaagaagcaaaagaaggagtcatataataatatagcaactcaactaaaagggctagatgccatatcggttttagatatccccatgatatctaaaataccagaggatatagctggagccctaagattcattgaagagcaaagatcataccatgtccaactgactgcagaatatgctatgctaactagatattgcgattattatacccaattcactgacaattctggatacagtcagaccacatggagggtttacttgagatcccacgattttgaggcatgtattttataccccaatcagcatttttgcagatgtgtcaagcatggggacaaatgctcaagctccaattgggatttcgctaatgagatgaagaactattacagtggaaaacagtccaaatttgataaagatttaaatttagcattgatgtccttacaccacgcatttagaggaacatctagtttttatattgccaaactcctgaaggaaaagaaaaatgaagaccttgtaacttatgcagaaaagattaaaggcaaatacccaggcaatgccttgctaaaggcaataattgactacataaagtatatgaaggatttaaccgagatgaacaatttcaaacatgatgagatgtgggatgacttcatatttgaagttcctcctacaaagagcccatcagtaagaagattagagtcttcatatgattttaaaactaatgtaaattcaaacccatcacacatttgcaagaatatcaaaactgtggtctgcttgtcaccaaagtcaggagtgtcatatgattcaataattgcctgtggggagccaagccagccaagcatctacaggaagccagacagtcaagttttccaatcaaatgctgaccagacacatttttgtttatcagatacacactgcctggaaaattatgaggcagttggagaggaaatcattgatgcaattaaaaaatcgaaatgctgggaaacagaatttactgagtacatccaatttaaacagagtgatggggtaaggagttgcaggatgaaagactcaggagaatgtacagtcaccaccaatagatggcctataatactctgcgataacgataaattctactactctgagttgcagaaagattatgataaggaccaggatataggtcacttctgtctcagcccaagatgcaacacaattaggcaccctataaatcggaaacatatatcaaattgtacatggcaggttagtcacaataatatagacaagattgaggtacatgaactggaggatcttgaacagtataagaaggccataacacagaagttgcagacaagcctaaccctatttaaatactcaaagacaaaaaacttgccccatatcaagcctatgtacaaatatataacaattgaaggaacagagactgctgagggtatagaaagtgcttatatagaatcagagatacccgctctagcaggaacatcaataggtttcaagatcacatccaagtctggaaagcatttattagatgtcattagttatgttaagagcgcatcttattcagccgtttatacaaaattgtatacaacaggacctactataggtgttaacactaaacatgatgaattatgcacagggccatgtcctgttaatgtgcctcatggcacaggttggatcacatttgctaaggagaggacaagctcctggggatgtgaagaatttggctgcctggcaattagcgatgggtgtgtttttggttcctgtcaagatattataaaagatgaaataactgtctataggaaggagactgaagagaccacagatgtggaattgtgcctgacatttgcagacaaaacatattgcactaacctcaatgcaattacccctataatcaccgaccagtttgaagtccaatttaaaactgtagaggcttacagtctgcctagaatcattgcagtgcggaatcatgagattatggttgggcaaataaatgacataggtgtttactcaaaaggctgtggaaatgtacagaaagtaaacaacacaaattatggaaatggtgtgcctaagtttgattacctgtgtcatttagcaagtagaaaagaagtgatagtgaggaaatgctttgataatgactaccaggcctgcaaatttctacaaacaccagcgagttataggctagaagaggagggaggttcagttacagtcatagactacaagaaaatccttggcactataaagatgaaggctatccttggagatgtgaaatataaaacatttgcagacaatgtggacttaaccgttgagggggtatgcactggctgcatcaattgttttgaaaatatacattgtgagttaacaatacacagtacagttgaagccagctgcccggtagtaagttcgtgtacagtatttcatgatagaattttaataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaagatgaaaggtgcaagacttggatgtgcagagtaagagatgaaggttttcaagtaatttttgaaccattcaaaaacttatttggttcttatattgggatattttatacatttataatatctttaatggcaatatttatagttatatatattgtgttgcctatatgtttcaaacttagagacacactgaggcagcatgaagacgcttacaagagagagatgaaaattaggtaa

SEQ ID NO: 4245 - RNA, 4323 nt, synthetic construct
  misc_feature 1..4323: note = derived and/or modified CDS sequence (wt) from TAHV(83)__GQ386825.1__GP
  source 1..4323: mol_type = other RNA
atgatgttcgtattgtttttcattgcactaagtgctgcaagcccagtttatcagaggtgtttccaggatggtgcaattgtcaagcaaaacccatccaaacaggctgtaacagaggtatgcctaaaggatgacgttagtatgataaaaacagaagctagatatttcagaaatgctaccggaacatatgccaacaatgttgccattagaaagtggcttgtctcagattggcatgactgcaggccaaaaaaagtctcagggggtcatataaatgttatagaagttggagatgacttaacgctgcatacagaggcatatgtatgtaatgcagactgcacaataggtgtagataaagaaaccgcacaggtaagattgcaaacagatacaacaaatcattttgagattgcaggaacaacagttaagtcagggtggttcaaaagcacaacttatatcacccttgatcaaacttgcgagcatttgaaagtttcttgtgggcctaaatctatacagttccatgcgtgtttcaatcaacacatgtcttgtgttagattcttacataggacaatcctacctgggtctattgccagctccatatgccaaaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcggataggatgaaattgcacagggcatctgggttgtgtccaggttataaaagtctcagggctgcaagagtcatgtgcaaatccaaagggccagcttctattttatctataatcactgcagtgttaatccttacttttgtcactcccataaatgccatggtagctggggacacacaagaaacatttaagcttgaggacctaccagatgacatgctgagcatggcaatgaaagtaaatatgtactacattatgtgtatgataaattatgctgtaacttggtcatttattttatgcgccctattaattgctttactcttcaagaagtatcagcatagattcttaaacttttatgccatgtactgccacgagtgcgatatgtaccatgatagatctggcctaaaatataatggagacttcacaaacaaatgtagacagtgcacatgcgggcagtacgaagatgccgcaggtctactaacccacagaaaaacatacaactgcctcgtgcagtacaaatcaaaatggctgactaatttcttaattgtatacataatcttgatgcttattaaagattctgtactaatagtgcatgctgatggcacagactttgaaaaatgcagtggtgaggcggatataacatggaattgtacaggaccattcttgaatctaggtaattgtgagaagaagcaaaagaaggagtcatataataatatagcaactcaactaaaagggctagatgccatatcggttttagatatccccatgatatctaaaataccagaggatatagctggagccctaagattcattgaagagcaaagatcataccatgtccaactgactgcagaatatgctatgctaactagatactgcgattattatacccaattcactgacaattctggatacagtcagaccacatggagggtttacttgagatcccacgattttgaggtatgcattttatatcccaatcagcatttttgcaggtgtgtcaagcatggggacaaatgctcaagctccaattgggatttcgccaatgagatgaagaactattacagtggaaaacagtccaaatttgataaagatttaaatttagcattgatgtccttacaccacgcatttagaggaacatctagtttttatattgctaaactcctaaaggaaaagaaaaatgaagatcttgtaacttatgcagaaaagattaaaggcaaatacccaggcaatgccttgctaaaggcaataattgactacataaagtatatgaagggtttaaccgagatgaacaatttcaaacatgatgaggtgtgggatgacttcatatttgaagttcctcctacaaagagcccatcagtaagaagattagagtcttcatatgattttaaaactaatgtaaattcaaacccatcacacatttgcaagaatatcaaaactgtggtctgcttgtcaccaaagtcaggagtgtcatatgattcaataattgcctgtggggagccaagccagccaagcatctacagaaagccagacagtcaagttttccaatcaaatgctgaccagacacatttttgtttatcagatacacactgcctggaaaattatgagacagttggagaggaaatcattgatgcaattaaaaaatcgaaatgctgggaaacagaatttactgagtacatccaatttaaacagagtgatggggtaaggagttgcaggatgaaagactcaggagaatgtacagtcaccaccaatagatggcctataatactctgcgataacgataaattctattactctgagttgcagaaagattatgataaggaccaggatataggtcacttctgtcttagcccaagatgcaacacaattaggcaccctataaatcggaaacatatatcaaattgtacgtggcaggttagtcacaacaatatagacaagattgaggtacatgaactggaggatcttgaacagtataagaaggccataacacagaagttgcagacaagcctaaccctatttaaatactcaaagacaaaaaacttgccccatatcaagcctatgtacaaatatataacaattgaaggaacagagactgctgagggtatagaaagtgcttatatagaatcagagatacccgctctagcaggaacatcaataggtttcaagatcacatccaagtctggaaagcatttattagatgtcattggttatgttaagagcgcatcttattcagccgtttatacaaaattgtatacaacaggacctactataggtgttaacactaaacatgatgaattatgcacagggccatgtcctgtcaatgtgcctcatggcacaggttggctcacatttgctaaggagaggacaagctcctgggggtgtgaagaatttggctgcctggcaattagcgatgggtgtgtttttggttcctgtcaagatattataaaagatgaaataactgtctataggaaggaaactgaggagaccacagatgtggaattgtgcctgacatttgcagacaaaacatattgcactaacctcaatgcaattacccctataatcaccgaccagtttgaagtccaatttaaaactgtagaggcttacagtctgcctagaatcattgcagtgcggaatcatgagattatggttgggcaaataaatgacataggtgtttactcaaaaggctgtggaaatgtacagaaagtaaacaacacaaattatggaaatggtgtgcctaagtttgattacctgtgtcatttagcaagtagaaaagaagtgatagtgaggaaatgctttgataatgactaccaggcctgcaaatttctacaaacaccagcgagttataggctagaagaggagggaggttcagttacagtcatagactacaagaaaatccttggcactataaagatgaaggctatccttggagatgtgaaatataaaacatttgcagacaatgtggacttaaccgttgagggggtatgcactggctgcatcaattgttttgaaaatatacattgtgagttaacaatacacagtacggttgaagccagctgcccggtagtaagttcgtgtacagtatttcatgatagaattttaataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaagatgaaaggtgcaagacttggatgtgcagagtaagagatgaaggttttcaagtaatttttgaaccattcaaaaacttatttggttcttatattgggatattttatacatttataatatctttaatggcaatatttatagttatatatattgtgttgcctatatgtttcaaacttagagacacactgaggcagcatgaagacgcttataagagagagatgaaaattaggtaa

SEQ ID NO: 4246 - RNA, 4323 nt, synthetic construct
  misc_feature 1..4323: note = derived and/or modified CDS sequence (wt) from TAHV(89)__GQ386826.1__GP
  source 1..4323: mol_type = other RNA
atgatgttcgtattgtttttcattgcactaagtgctgcaagcccagtttatcagaggtgtttccaggatggtgcaattgtcaagcaaaacccatccaaacaggctgtaacagaggtatgcctaaaggatgacgttagtatgataaaaacagaagctagatatttcagaaatgctaccggaacatatgccaacaatgttgccattagaaagtggcttgtctcagattggcatgactgcagaccaaaaaaagtctcagggggtcatataaatgttatagaagttggagatgacttaacgctgcatacagaagcatatgtatgcaatgcagactgcacaataggtgtagataaagaaaccgcacaagtaagattgcaaacagatacaacaaatcattttgagattgcaggaacaacagttaagtcagggtggttcaaaagcacaacttatatcacccttgaccaaacttgcgagcatttgaaagtttcttgtgggcctaaatctatacagttccatgcgtgtttcaatcaacacatgtcttgtgttagattcttacataggacaatcctacctgggtctattgccagctccatatgccagaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcggataggatgaaattgcacagggcatctgggttgtgtcctggttataaaagtctcagggctgcaagagtcatgtgcaaatccaaagggccagcttctattttatctataatcactgcagtgttaatccttacttttgtcactcccataaatgccatggtagctggggacacacaagaaacatttaagcttgaggacctaccagatgacatgctgagcatggcaatgaaagtaaatatgtactacattatgtgtatgataaattatgctgtaacttggtcatttattttatgcgccctattaattgctttactcttcaagaagtatcagcatagattcttaaacttttatgccatgtactgccacgagtgcgatatgtaccatgatagatctggcctaaaatataatggagacttcacaaacaaatgtagacagtgcacatgcgggcagtacgaagatgccgcaggtctactaacccacagaaaaacatacaactgcctcgtgcagtacaaatcaaaatggctgactaatttcttaattggatacataatcttgatgcttattaaagattctgtactaatagtgcatgctgatggcacagactttgaaaaatgcagtggtgaggcggatataacatggaattgtacaggaccattcttgaatctaggtaattgtgagaagaagcaaaagaaggagtcatataataatatagcaactcaactaaaagggctagatgccatatcggttttagatatccccatgatatctaaaataccagaggatatagctggagccctaagattcattgaagagcaaagatcataccatgtccaactgactgcagaatatgctatgctaactagatactgcgattattatacccaattcactgacaattctggatacagtcagaccacatggagggtttacttgagatcccacgattttgaggcatgtattttatatcccaatcagcatttttgcagatgtgtcaagcatggggacaaatgctcaagctccaattgggatttcgccaatgagatgaagaactattacagtggaaaacagtccaaatttgataaagatttaaatttagcattgatgtccttacaccacgcatttagaggaacatctagtttttatattgctaaactcctgaaggaaaagaaaaatgaagaccttgtaacttatgcagaaaagattaaaggcaaatatccaggcaatgccctgctaaaggcaataattgactacataaagtatatgaagggtttaaccgagatgaacaatttcaaacatgatgagatgtgggatgacttcatatttggagttcctcctacaaagagcccatcagtaagaagattagagtcctcatatgattttaaaactaatgtaaattcaaacccatcacacatttgcaagaatatcaaaactgtggtctgcttgtcaccaaagtcaggagtgtcatatgattcaataattgcctgtggggagccaagccagccaagcatctacagaaagccagacagtcaagttttccaatcaaatgctgaccagacacatttttgtttatcagatacacactgcctggaaaattatgagacagttggagaggaaatcattgatgcaattaaaaaatcgaaatgctgggaaacagaatttactgagtacatccaatttaaacagagtgatggggtaaggagttgcaggatgaaagactcaggagaatgtacagtcaccaccaatagatggcctataatactctgcgataacgataaattctactactctgagttgcagaaagattatgataaggaccaggatataggtcacttctgtctcagcccaagatgcaacacaattaggcaccctataaatcggaaacatatatcaaattgtacgtggcaggttaatcacaacaatatagacaagattgaggtacatgaactggaggatcttgaacagtataagaaggccataacacagaagttgcagacaagcctaaccctatttaaatactcaaagacaaaaaacttgccccatatcaagcctatgtacaaatatataacaattgaaggaacagagactgctgagggtatagaaagtgcttatatagaatcagagatacccgctctagcaggaacatcaataggtttcaagatcacatccaagtctggaaagcatttattagatgtcattggttatgttaagagcgcatcttattcggccgtttatacaaaattgtatacaacaggacctactataggtgttaacactaaacatgatgaattatgcacagggccatgtcctgtcaatgtgcctcatagcacaggttggctcacatttgctaaggagaggacaagctcctgggggtgtgaagaatttggctgcctggcaattagcgatgggtgtgtttttggttcctgtcaagatattataaaagatgaaataactgtctataggaaggagactgaggagaccacagatgtggaattgtgcctgacatttgcagacaaaacatattgcactaacctcaatgcagttacccctataatcaccgaccagtttgaagtccaatttaaaactgtagaggcttacagtctgcctagaatcattgcagtgcggaatcatgagattatggttgggcaaataaatgacataggtgtttactcaaaaggctgtggaaatgtacagaaagtaaacaacacaaattatggaaatggtgtgcctaagtttgattacctgtgtcatttagcaagtagaaaagaagtgatagtgaggaaatgctttgataatgactaccaggcctgcaaatttctacaaacaccagcaagttataggctagaagaagagggaggttcagttacagtcatagactacaagaaaatccttggcactataaagatgaaggctatccttggagatgtgaaatataaaacatttgcagacaatgcggacttaaccgttgagggggtatgcactggctgcatcaattgttttgaaaatatacattgtgagttaacaatacacagtacagttgaagccagctgcccggtagtaagttcgtgtacagtatttcatgatagaattttaataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaaggtgaaaggtgcaagacttggatgtgcagagtaagagatgaaggttttcaagtaatttttgaaccattcaaaaacttatttggttcttatattgggatattttatacatttataatatctttaatggcaatatttatagttatatatattgtgttgcctatatgtttcaaacttagagacacactgaggcagcatgaagacgcttataagagagagatgaaaattaggtaa

SEQ ID NO: 4247 - RNA, 4323 nt, synthetic construct
  misc_feature 1..4323: note = derived and/or modified CDS sequence (wt) from TAHV(90)__GQ386827.1__GP
  source 1..4323: mol_type = other RNA
atgatgttcgtattgtttttcattgcactaagtgctgcaagcccagtttatcagaggtgtttccaggatggtgcaattgtcaagcaaaacccatccaaacaggctgtaacagaggtatgcctaaaggatgacgttagtatgataaaaacagaagctagatatttcagaaatgctaccggaacatatgccaacaatgttgccattagaaagtggcttgtctcagattggcatgactgcagaccaaaaaaagtcgcagggggtcatataaatgttatagaagttggagatgacttgacgctgcatacagaggcatatgtatgcaatgcagactgcacaataggtgtagataaagaaaccgcacaagtaagattgcaaacagatacaacaaatcattttgagattgcaggaacaacagttaagtcagggtggttcaaaagcacaacttatatcacccttgatcaaacttgcgagcatttgaaagtttcttgtgggcctaaatctatacagttccatgcgtgtttcaatcaacacatgtcttgtgttagattcttacataggacaatcctacctgggtctattgccagctccatatgccaaaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcggataggatgaaattgcacagggcatctgggttgtgtccaggttataaaagtctcagggctgcaagagtcatgtgcaaatccaaagggccagcttctattttatctataatcactgcagtgttaatccttacttttgtcactcccataaatgccatggtagctggggacacacaagaaacatttaagcttgaggacctaccagacgacatgctgagcatggcaatgaaagtaaatatgtactacattatgtgtatgataaattatgctgtaacttggtcatttattttatgtgccctattaattgctttactcttcaagaagtatcagcatagattcttaaacttttatgccatgtactgccacgagtgcgatatgtaccatgatagatctggcctaaaatataatggagacttcacaaacaaatgtagacagtgcacatgcgggcagtacgaagatgccgcaggtctactaacccacagaaaaacatacaactgcctcgtgcagtacaaatcaaaatggctgactaatttcttaattggatacataatcttgatgcttattaaagattctgtactaatagtgcatgctgatggcacagactttgaaaaatgcagtggtgaggcggatataacatggaattgtacaggaccattcttgaatctaggtaattgtgagaagaagcaaaagaaggagtcatataataatatagcaactcaactaaaagggctagatgccatatcggttttagatatccccatgatatctaaaataccagaggatatagctggagccctaagattcattgaagagcaaagatcataccatgtccaactgactgcagaatatgctatgctaactagatactgcgattattatacccaattcactgacaattctggatacagtcagaccacatggagggtttacttgagatcccacgattttgaggcatgtattttatatcccaatcagcatttttgcagatgtgtcaagcatggggacaaatgctcaagctccaattgggatttcgccaatgagatgaagaactattacagtggaaaacagtccaaatttgataaagatttaaatttagcattgatgtccttacaccacgcatttagaggaacatctagtttttatattgctaaactcctgaaggaaaagaaaaatgaagaccttgtaacttatgcagaaaagattaaaggcaaatatccaggcaatgccctgctaaaggcaataattgactacataaagtatatgaagggtttaaccgagatgaacaatttcaaacatgatgagatgtgggatgacttcatatttgaagttcctcctacaaagagcccatcagtaagaagattagagtcttcatatgattttaaaactgatgtaaattcaaacccatcacacatttgcaagaatatcaaaactgtggtctgcttgtcaccaaagtcaggagtgtcatatgattcaataattgcctgtggggagccaagccagccaagcatctacagaaaaccagacagtcaagttttccaatcaaatgctgaccagacacatttttgtttatcagatacacactgcctggaaaattatgagacagttggagaggaaatcattgatgcaattaaaaaatcgaaatgctgggaaacagaatttactgagtacatccaatttaaacagagtgatggggtaaggagttgcaggatgaaagactcaggagaatgtacagtcaccaccaatagatggcctataatactctgcgataacaataaattctactactctgagttgcagaaagattatgataaggaccaggatataggtcacttctgtctcagcccaagatgcaacacaattaggcaccctataaatcggaaacatatatcaaattgtacgtggcaggttaatcacaacaatatagacaagattgaggtacatgaactggaggatcttgaacagtataagaaggccataacacagaagttgcagacaagcctaaccctatttaaatactcaaagacaaaaaacttgccccatatcaagcctatgtacaaatatataacaattgaaggaacagagactgctgagggtatagaaagtgcttatatagaatcagagatacccgctctagcaggaacatcaataggtttcaagatcacatccaagtctggaaagcatttattggatgtcattggttatgttaagagcgcatcttattcggccgtttatacaaaattgtatacaacaggacctactataggtgttaacactaaacatgatgaattatgcacagggccatgtcctgtcaatgtgcctcatggcacaggttggctcacatttgctaaggagaggacaagctcctgggggtgtgaagaatttggctgcctggcaattagcgatgggtgtgtttttggttcctgtcaagatattataaaagatgaaataactgtctataggaaggagactgaggagaccacagatgtggaattgtgcctgacatttgcagacaaaacatattgcactaacctcaatgcagttacccctataattaccgaccagtttgaagtccaatttaaaactgtagaggcttacagtctgcctagaatcattgcagtgcggaatcatgagattatggttgggcaaataaatgacataggtgtttactcaaaaggctgtggaaatgtacagaaagtaaacaacacaaattatggaaatggtgtgcctaagtttgattacctgtgtcatttagcaagtagaaaagaagtgatagtgaggaaatgctttgataatgactaccaggcctgcaaatttctacaaacaccagcaagttataggctagaagaagagggaggttcagttacagtcatagactacaagaaaatccttggcactataaagatgaaggctatccttggagatgtgaaatataaaacatttgcagacaatgtggacttaaccgttgagggggtatgcactggctgcatcaattgttttgaaaatatacattgtgagttaacaatacacagtacagttgaagccagctgcccggtagtaagttcgtgtacagcatttcatgatagaattttaataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaagatgaaaggtgcaagacttggatgtgcagagtaagagatgaaggttttcaagtaatttttgaaccattcaaaaacttatttggttcttatattgggatattttatacatttataatatctttaatggcaatatttatagttatatatattgtgttgcctatatgtttcaaacttagagacacactgaggcagcatgaagacgcttataagagagagatgaaaattaggtaa

SEQ ID NO: 4248 - RNA, 4323 nt, synthetic construct
  misc_feature 1..4323: note = derived and/or modified CDS sequence (wt) from TAHV(94)__GQ386828.1__GP
  source 1..4323: mol_type = other RNA
atgatgttcgtattgtttttcattgcactaagtgctgcaagcccagtttatcagaggtgtttccaggatggtgcaattgtcaagcaaaacccatccaaacaggctgtaacagaggtatgcctaaaggatgacgttagtatgataaaaacagaagctagatatttcagaaatgctaccggaacatatgccaacaatgttgccattagaaagtggcttgtctcagattggcatgactgcaggccaaaaaaagtctcagggggtcatataaatgttatagaagttggagatgacttaacgctgcatacagaggcatatgtatgtaatgcagactgcacaataggtgtagataaagaaaccgcacaggtaagattgcaaacagatacaacaaatcattttgagattgcaggaacaacagttaagtcagggtggttcaaaagcacaacttatatcacccttgatcaaacttgcgagcatttgaaagtttcttgtgggcctaaatctatacagttccatgcgtgtttcaatcaacacatgtcttgtgttagattcttacataggacaatcctacctgggtctattgccagctccatatgccaaaatgtagagataataatattaacagtgctaaccctccttatatttatactattaagcatactgagtaaaacttacatatgttatatactcatgccaatatttatcccgcttgcttatatatatggtgtaatatataataaatcgtgtaaaaaatgtaaactatgcggattagtttaccatcccttcactgagtgcggcacccattgcgtatgtggtgctagatacgagacatcggataggatgaaattgcacagggcatctgggttgtgtccaggttataaaagtctcagggctgcaagagtcatgtgcaaatccaaagggccagcttctattttatctataatcactgcagtgttaatccttacttttgtcactcccataaatgccatggtagctggggacacacaagaaacatttaagcttgaggacctaccagatgacatgctgagcatggcaatgaaagtaaatatgtactacattatgtgtatgataaattatgctgtaacttggtcatttattttatgcgccctattaattgctttactcttcaagaagtatcagcatagattcttaaacttttatgccatgtactgccacgagtgcgatatgtaccatgatagatctggcctaaaatataatggagacttcacaaacaaatgtagacagtgcacatgcgggcagtacgaagatgccgcagctctactaacccacagaaaaacatacaactgcctcgtgcagtacaaatcaaaatggctgactaatttcttaattgtatacataatcttgatgcttattaaagattctgtactaatagtgcatgctgatggcacagactttgaaaaatgcagtggtgaggcggatataacatggaattgtacaggaccattcttgaatctaggtaattgtgagaagaagcaaaagaaggagtcatataataatatagcaactcaactaaaagggctagatgccatatcggttttagatatccccatgatatctaaaataccagaggatatagctggagccctaagattcattgaagagcaaagatcataccatgtccaactgactgcagaatatgctatgctaactagatactgcgattattatacccaattcactgacaattctggatacagtcagaccacatggagggtttacttgagatcccacgattttgaggtatgcattttatatcccaatcagcatttttgcaggtgtgtcaagcatggggacaaatgctcaagctccaattgggatttcgccaatgagatgaagaactattacagtggaaaacagtccaaatttgataaagatttaaatttagcattgatgtccttacaccacgcatttagaggaacatctagtttttatattgctaaactcctaaaggaaaagaaaaatgaagatcttgtaacttatgcagaaaagattaaaggcaaatacccaggcaatgccttgctaaaggcaataattgactacgtaaagtatatgaaggatttaaccgagatgaacaatttcaaacatgatgagatgtgggatgacttcatatttgaagttcctcctacaaagagcccatcagtaagaagattagagtcttcatatgattttaaaactaatgtaaattcaaacccatcacacatttgcaagaatatcaaaactgtggtctgcttgtcaccaaagtcaggagtgtcatatgattcaataattgcctgtggggagccaagccagccaagcatctacagaaagccagacagtcaagttttccaatcaaatgctgaccagacacatttttgtttatcagatacacactgcctggaaaattatgagacagttggagaggaaatcattgatgcaattaaaaaatcgaaatgctgggaaacagaatttactgagtacatccaatttaaacagagtgatggggtaaggagttgcaggatgaaagactcaggagaatgtacagtcaccaccaatagatggcctataatactctgcgataacgataaattctattactctgagttgcagaaagattatgataaggaccaggatataggtcacttctgtcttagcccaagatgcaacacaattaggcaccctataaatcggaaacatatatcaaattgtacgtggcaggttagtcacaacaatatagacaagattgaggtacatgaactggaggatcttgaacagtataagaaggccataacacagaagttgcagacaagcctaaccctatttaaatactcaaagacaaaaaacttgccccatatcaagcctatgtacaaatatataacaattgaaggaacagagactgctgagggtatagaaagtgcttatatagaatcagagatacccgctctagcaggaacatcaataggtttcaagatcacatccaagtctggaaagcatttattagatgtcattggttatgttaagagcgcatcttattcagccgtttatacaaaattgtatacaacaggacctactataggtgttaacactaaacatgatgaattatgcacagggccatgtcctgtcaatgtgcctcatggcacaggttggctcacatttgctaaggagaggacaagctcctgggggtgtgaagaatttggctgcctggcaattagcgatgggtgtgtttttggttcctgtcaagatattataaaagatgaaataactgtctataggaaggaaactgaggagaccacagatgtggaattgtgcctgacatttgcagacaaaacatattgcactaacctcaatgcaattacccctataatcaccgaccagtttgaagtccaatttaaaactgtagaggcttacagtctgcctagaatcattgcagtgcggaatcatgagattatggttgggcaaataaatgacataggtgtttactcaaaaggctgtggaaatgtacagaaagtaaacaacacaaattatggaaatggtgtgcctaagtttgattacctgtgtcatttagcaagtagaaaagaagtgatagtgaggaaatgctttgataatgactaccaggcctgcaaatttctacaaacaccagcgagttataggctagaagaggagggaggttcagttacagtcatagactacaagaaaatccttggcactataaagatgaaggctatccttggagatgtgaaatataaaacatttgcagacaatgtggacttaaccgttgagggggtatgcactggctgcgtcaattgttttgaaaatatacattgtgagtcaacaatacacagtacggttgaagccagctgcccggtaataagttcgtgtacagtatttcatgatagaattttaataaccccaaatgagcacaagtatgctataaaggtgatctgcaatgaaaagccaggtcctacattgccgttcaagatctgcagtgcaaagacagatgctgcaatgacactggcagatgctaagccaatattagagctagcacctgtagaccaaacaacatatattaaggagaaagatgaaaggtgcaagacttggatgtgcagagtaagagatgaaggttttcaagtaatttttgaaccattcaaaaacttatttggttcttatattgggatattttatacatttataatatctttaatggcaatatttatagttatatatattgtgttgcctatatgtttcaaacttagagacacactgaggcagcatgaagacgcttataagagagagatgaaaattaggtaa

SEQ ID NO: 4249 - RNA, 4323 nt, synthetic construct
  misc_feature 1..4323: note = derived and/or modified CDS sequence (wt) from TAHV(XJ0625)__EU622819.2__GP
  source 1..4323: mol_type = other RNA
atgatgtttgtattgttctttatagcactaagtactgcaagtccagtgtaccaaaggtgtttccaagatggtgcaattgtgaagcagaacccatccaaacaggctgtaacagaagtatgcctgaaggatgatgttagcatgataaaaacagaagctaggtatttcaaaaatgctactggaacatatgcaaataatgttgcaatcaggaaatggttggtttcagactggcatgattgtagaccaaaaaaagtagcaggaggccacataaatgtcatagaagtaggggatgacttaaccttacatactgaagcctatgtatgcaatgcagactgcacaataggagtggacaaagaaactgcacaggtgaggttgcagacagacacaacgaaccattttgagattgcaggtacaactgttaaatcagggtggttcaaaagcacaacatatatcacccttgatcaaacttgcgagcatttaaaggtttcctgcggcccaaaatctgtccagttccatgcttgcttcaatcagcacatgtcttgtgtaagatttctgcacaggactatactgcctggctctatagcgagttccatatgtcaaaatgtagaaataataattttaacagtgctaaccttactaattttcatattacttagtatactaagcaaaacatatatatgctatctattgatgccaatatttatcccacttgcctatgtatatggtgttatatataacaaatcatgcaaaaaatgtaaattatgcggtttagtttaccacccattcacagaatgtggcactcattgcgtgtgtggtgctagatatgaaacttctgataggatgaaattgcatagggcgtcaggcttatgcccaggttacaaaagtctgagggcagcacgagttatgtgtaagtcgaaagggccagcatctatactatctgtaataactgcagtattgatactaacatttgtgaccccaataaatgcaatggttgctggagatacgcaagaaacatttaagcttgaagatctgccggatgatatgttaagtatggctatgaaaatacagatgtattatataatgtgcattgtcaactatattgtcacttggtcgttcattgtatgtgctttaataattgccttgatttttaagaagtaccaacacagattcttaaatttttatgccatgtattgtcatgaatgcgatatgtaccatgataggtcaggcttaaaatataatggggacttcacaaacaaatgtaggcagtgcacatgtggtcagtatgaagatgctgcaggcttactaacccataggaaaacatacaattgcctagtacaatacaaatcgaagtggttagtgaattttttgataatatacatacttctgatgcttgtaaaagattcagtactaatagtccaagcagaaggcacagattttgaaaaatgtagtggggaaataaacataacctggaattgcacaggacctttcctaaacttaggcaattgtgagaagaaacaaaagaaggagccatacagcaacatagcgacacaattgaagggcctagatgctatatctattttagacatcccaatgatatcaaggatacctgaagatatagctggagctctgaggtttattgaagagcaaaattcataccatgtgcagctgactgcagaatatgcaatgctaaccagatattgtgactattacactcaatttagtgataattcaggttatagccaaaaaacatggagagtatacttaagatcccatgatttcgaagcatgtatattgtacccaaaccagcatttttgcagatgtgttaagcatggtgacaaatgttcaagctcaaactgggactttgctagtgagatgaagaattattacactggcaaacaactgaaatttaataaagatttaaatttagctctgatgtcttttcatcatgcttttagagggacatctagcttctatgttgcaaaactcctaagagagaaaaataatgaggaattggtgaattacacagaaaagataaaagataagtacccaggcaatgcacttttgaaagctataattgactacataaaatatatgaagaacctaagtgagatgaccaactttaaacatgatgagatgtgggatgattttgtttttaatagtcccccaactaaaagcccttctgtaagacgctcagactctgcatatgatttcaagaataatataaattcaaatccatcacatatatgccagaatataaaaactgttatatgtctatcaccaaaatctggagtatcttacgattcaataatagcttgtggcgaaccgagtcagccgacaatttataaaaagccagaaagcagagtgtttcagtcaaatgcagatcaaacacacttctgtttagcagatacccattgcctggagaactatgagacagtaggtgaagaaattcttgacgctattaagaaatcaaaatgttgggagacagattttactgagtacattcaattcaaacaaagtgacggagtaagaagctgcagaatgaaagattcaggagaatgtacagtgaccacccacagatggcctatcatactgtgcgacaataacaagttttactactctgaattgcaaaaggactatgacaaagatcaagatataggccatttctgcctcagccccagatgcaatacaatcaggcatccaataaatcagaagcacatatcaaattgcacatggcaagtcagtcacaataatatcgagaagattgaagtgcacgagttggaaaatctggagcaatataagaaggctataactcaaaagttacagacaagtttaacattattcaagtattctaaaacaaaaaacctaccccatattaagccaatgtacaaatacataactattgagggtacagaaacagcagaaggtattgaaagtgcctatatagagtcagaaatacctgcattagctggaacatcaatagggtttaaaatcacatccaagtcaggaaagcacttattagatgtgataggttatgtcaaaagtgcatcttactcagctgtttatacaaagttgtacacaacaggcccaacaatcggtgtcaacacaaagcatgatgagttgtgtacaggcccatgtccagttaatgtaccacacggcactggttggctaacatttgctaaagagagaacaagctcgtggggttgtgaggagtttggttgcctggcgattagcgacgggtgtgtctttggctcatgtcaagatattataaaagaagagctagctgtttataggaaagaaactgaagagactacagatgtagaattatgcctaacctttgcagataaaacttattgcaccaatctgaacgcaataacaccaataatcactgaccaatttgaagttcaattcaaaacagtcgaatcttatagtttacctagaattattgctgtacgaaaccatgaaatcatggtgggacagataaatgatatcggcgtttattcgaaaggttgcggaaatgtgcaaaaggtaaataatacaaactatgggaatggtgtacccaaatttgattatttatgccatttagcaagtaggaaagaagtaatagtcagaaaatgctttgataacgattatcaggcttgcaaatttctacaaacaccagcaagctatagactagaggaagagggcggttctgttacagttatagattataaaaagattctcggaacaataaagatgaaggctattctgggagatgtaaaatacaaaacgtttgcagacaatgtagatttaactgttgaaggggtgtgcacagggtgtatcaattgttttgaaaatatacactgtgaactgacaatacatagcacagtggaagcaagttgcccagtgacaagctcatgcactgtgtttcacgatagaatcctgataacaccaaacgagcacaaatacgctataaaggtaatttgtgctgaaaaaccagggccatcattacagttcaaaatatgtaatgcaaaaactgatgcagctatgacattagcagatgcaaaaccaatattagaattagcgccagttgatcagacaacatatataaaggaaaaagatgtgagatgcaaaacctggatgtgtagagtcagagatgaaggcctccaagttatatttgaaccattcaagaacctatttggctcttatataggcatattttatacatttttaataaccttaattgccgtattcgtagtcatatacatcgtgctgccaatatgctttaaacttagagacactttgaggcagcatgaagatgcctacaagagagaaatgaaaattagataa

SEQ ID NO: 4250 - RNA, 4323 nt, synthetic construct
  misc_feature 1..4323: note = derived and/or modified CDS sequence (wt) from TAHV(XJ0708)__HM243138.1__GP
  source 1..4323: mol_type = other RNA
atgatacttgtactggtctttgttgcactaagtgctgccagcccagtctatcagaggtgtttccaggatggtgcaattgtcaaacaaagtccatccaaacaagcagtgacggaagtgtgcttgaaggatgatgtcagcatgataaaaacagaagctagatactttaagaatgcaactggaacatatgcgaataatgttgctattaggaagtggcttgtatcagactggcatgattgcaggcccaagaaaatttctggaggccacataaatgtgatagaagtgggagatgatttaacactgcacacagaagcttatgtttgtaatgcagattgcataattggagtggataaagagacagcacaagtgagattgcaaacagacacaacaaaccactttgagattgccggcactactgtcaaatctgggtggttcaaaagcactacttatattaccctcgaccagacatgtgagcacttgaaagtctcatgcgggcctaagtctattcaattccatgcttgctttaatcagcacatgtcatgtgtcagatttttgcataggacaatattacctggatccatagctagctcgatatgccaaaatgttgaaataataatactaacagttttaactctacttatattcattttacttagtatactaagcaaaacatatatatgctatattttaatgccaatatttatcccattagcttatgtgtacggcgttatatataacaagtcttgcaagaagtgcaaactatgtgggctagtttaccatccatttacagagtgtggaactcactgtgtttgcggtgctcgatatgagacatctgacagaatgaagttgcatagagcatctggattatgcccgggttataaaagtctcagagcagcaagggtcatgtgcaagtccaaagggccagcatcaatattatccatcataactgcagtactaatcttaacatttgttactccaataaatgccatgattgctggggaaacacaagagacatttaaacttgaagatttgccagatgacatgttaagtatggctatgaaactaaacatgtactatttgatgtgcattgttaattatattgttacttggtcatttatcatatgtgccttaataattgcgctaatctttaaaaaataccaacatagattcttgaatttctatgccatgtactgccatgagtgcgatatgtatcatgaccgatccggtcttaaatataatggtgactttacaaacaaatgcagacaatgcacatgtgggcaatatgaggatgctgctgggctgctgactcacaggaaaacatataattgcctggtgcaatataaatcaaaatggctagttaactttttgattgtatacatactacttatgcttgtcaaggattccatattgatagtccaagcagagggcacagatttcgataaatgcagtggagaggcaggcataatttggaattgtacagggccattcttaaatctaggcaactgcgagaaaaaacagaaaaaagaatcgtataataatattgcaacgcagctgaagggattgaatgcaatctctgttttagatattcctatgatatcaagaataccagaggatatagccggggcattaaggttcattgaagatcagaactcatatcatgtccagctgacagctgagtatgctatgctaactaggtactgcgactactacacacagttcagcgacaattcaggatatagccagacaacatggagagtttatctaaggtctcataactttgaggcttgcatattatactccaaccaacacttctgtagatgtgtcaaacatggagataagtgctcaagctctaactgggattttgctaacgaaatgaagaattattattctggtaaacagtccaagttcaacaaagatctaaacctggcattaatgtctcttcatcatgcctttagaggaacatccagcttttatattgccaaactcttgagagagaagaagaatgaagaattaataaattatgtggaagagattaagaagaagtacccaggtaatgcattactaaaagctgtgattgattacatcaagtatatgaagaatctaacagagatggctagctttaagcacgatgagatgtgggatgaatttgtatatgagagtccaccaacaagaagcccatccgccagaagatcagaatctgaatatgatttcaaaactaatgtgaattcaaaaccaacacatgtatgtaaaaacataaaaactgttgtatgcttgtcaccaaaatcaggggtgtcttatgattcaataattgcttgtggtgagccagggcagccaagtgtatataggaagccagagcaacaagtcttccaatccaatgcagaccagacacacttctgcctattggacacacattgcttagaaaattatacaactgtcaatgacgaaattctagatgcgataaaaaaatccagatgttgggagactgaattcactgagtatattcagttcaaacagggcgatggggtgaggagttgtagaatgaaagactctggcgaatgtgctgtagcagcaaacaggtggcctataatattgtgtgacaataataaattttattactcagagctgcaaaaggactatgataaagaccaggatataggccacttctgtcttagtcctagatgcaacacaatcaggcacccaataaatcagaagcacatatcaaattgtacatggcaagtcagtcacaataatatagaaaagattgaggtccatgaattagaaaatctcgaacaatacaaaaaagccatcacccagaaattgcagacaagcttgacactattcaagtattcaaaaacgaaaaaccttcctcatatcaagcccatgtataagtatataacaattgagggaacagagacagcagagggtatcgagagtgcatatatagaatcggagatacctgcccttgcagggacatcaataggattcaaaatcacttctaaatctggaaagcacttactagatgttattggctacgttaagagtgcatcttattcatctgtatacacacgactgtatacaacaggcccaaccattggtatcaatacaaggcatgatgagttgtgcacaggaccatgtccagtcaatgtcccccacaacactggttggcttacatttgcaaaagaaaggacaagttcttgggggtgtgaagaatttggatgtttagccattagtgatgggtgtgtttttggttcttgccaggatatcataaaggaagagttaacagtttatagaaaagaaactgaagaaaccactgatgtagaattatgtctaacgtttgcagacaaaacctattgtaccaatctcaatgcaatcactcctataattactgatcagtttgaggttcaattcaaaactgttgaagcttatagcctgcctagaattattgcagtacggaaccatgagatactggtaggccaaataaatgatctcggtgtttattcaaaaggttgcggtaatgtacagaaagtaaataaaacaaattacgggaatggtgtgccaaaattcgattatttgtgccatttagcaagcagaaaagaagttatagttaggaaatgctttgacaatgattatcaggcttgtaagtttttgcagacaccagccagctataggctagaagaggaaggtggaacagtgacagtcattgattataaaaagattcttgggactataaagatgaaagccatacttggagatgtaaaatataaaacttttgcagataatgtcgacctaaccatagaaggagtatgcacaggatgcattaattgcttcgaaaacatacactgcgaattgacaatacatagcactgttgaagctagctgcccaattattagctcatgcacagtatttcatgatagaattttaataactccgaatgagcataaatatgccataaaagtgatctgtaatgagaagcctggttcatcattatcattcagagtctgcaacacaaaaactgatgcagccatgactttaacagatgcgaaaccaatattagaattagcaccagtggatcaaacagcatacataaaggaaaaagatgagagatgcaaaacctggatgtgcagggttagagatgaaggtctccaggtgatctttgagccattcaagaacctatttggttcttatatagggatattttatactttcatattatctttaattgcaatattcataatcatatacattgtgctccctatatgcttcaagcttagagacactttaaggcagcatgaagatgcttacaaaagggagatgaaaattaggtaa

SEQ ID NO: 4251 - RNA, 4323 nt, synthetic construct
  misc_feature 1..4323: note = derived and/or modified CDS sequence (wt) from TAHV(XJ0710)__HM243141.1__GP
  source 1..4323: mol_type = other RNA
atgatgttcgtattgttttttatagcactaagtgctgcaagtccagtgtaccaaaggtgtttccaagatggtgcaattgtgaagcagaacccatccaaacaggctgtaacagaagtatgcctgaaggatgatgtcagcatgataaaaacagaagctaggtatttcaaaaatgctactggaacatatgcaaataatgttgcaatcaggaaatggttggtttcagactggcatgattgtagaccaaaaaaagtagcaggaggccacataaatgtcatagaagtaggggatgacttaaccttacacactgaagcctatgtatgcaatgcggactgcacaataggagtggataaagaaactgcacaggtgaggttgcaaacggacacaacgaaccattttgagattgcaggtacaactgtcaaatcagggtggttcaaaagcacaacgtatatcacccttgatcaaacttgtgagcatttaaaggtttcttgcggcccgaaatctgtccagttccatgcttgcttcaatcaacacatgtcctgtgtaagatttctgcacaggactatactgcctggttctatagcgagctccatatgtcaaaatgtagaaataataattttaacagtactaaccttgctaattttcatattactcagtatactaagcaaaacatatatatgctatctattgatgccaatatttatcccacttgcctatgtatatggtgttatatataataaatcatgcaaaaaatgtaaattatgcggtttggtttaccacccattcacagaatgtggcactcattgtgtgtgtggtgctagatatgagacttctgataggatgaaattgcatagggcatcaggattatgcccaggttacaaaagccttagggcagcacgagttatgtgtaagtcaaaagggccagcatctatactatctataataactgcagtattgatactaacatttgtaaccccaataaatgcaatggttgctggagatacacaagaaacatttaagcttgaagatctaccagatgatatgttgagtatggctatgaaaatacagatgtattatataatgtgcattgtcaactatattgtcacatggtcattcattgtatgtgctttaataattgccttaatttttaagaagtaccaacatagattcttaaatttttatgccatgtattgtcatgaatgcgatatgtaccatgataggtcaggcttaaaatacaatggggatttcacaaacaaatgtaggcagtgcacatgtggccagtatgaagatgctgcaggcttgctaacccataggaaaacatacaactgcctagtacaatacaaatcgaagtggttagtgaactttttaataatatatatacttctgatgcttgttaaagattcagtactaatagtccaagcagaaggcatagatttcgaaaaatgtagtggagaaataaacataacctggaattgcacaggacctttcctaaacttaggtaattgtgaaaagaaacaaaagaaggagccatacagtaacatagcgacacaattgaagggcctagatgctatatctattttagacatcccaatgatatcaaggatacctgaagacatagctggagctctgaggtttattgaagagcaaaattcatatcatgtgcagctgactgcagaatatgcaatgctaaccagatattgtgactattacactcaatttagtgataattcaggttatagccaaacaacatggagggtgtacctaagatctcacgatttcgaagcatgtatattgtacccaaaccagcatttttgcagatgtgttaagcacggtgataaatgttcaagctcaaactgggactttgctagtaagatgaagaattattacactggcaaacaactgaaatttaataaagatttaaatttagctttgatgtcttttcatcatgcttttagagggacatctagtttctatgttgcgaaactcctaagagagaaaaataatgacgagttggtgaattacacagaaaagataaagaataagtacccaggcaatgcacttttgaaagctataattgactatataaaatatatgaagagcctaagcgagatgaccaactttaaacatgacgagatgtgggatgattttgtttttaatagtcccccaactaagagcccttctgtaagacgctcagactctgcatatgatttcaaaaataacataaattcaaatccatcacacatatgcaagaatataaaaactgttgtatgtttatcaccaaaatctggagtatcttatgattcaataatagcttgtggcgaaccaagtcagccgacaatttacaaaaagccggaaagcagagtgtttcagtcaaatgcagatcagacacacttttgtttagcagacacccattgcctggagaactatgagacagtaggtgaagaaattcttgatgctattaagaaatcaaaatgttgggagacagattttacagagtacattcaatttaaacaaagtgatggagtaagaagctgcagaatgaaagattcaggagaatgcacagtgaccaccaacagatggcctatcatattgtgtgacaataacaagttttactactccgaattacaaaaagactatgacaaagaccaagatataggccatttctgcctcagccctagatgcaatacaatcaggcatccaataaatcagaagcacatatcaaattgtacatggcaagtcagtcacaacaatatcgagaagattgaagtgcatgagttggaaaatctagagcaatataagaaggctataactcaaaagttacagacaagtttaacattatttaagtactctaaaacaaaaaacctgccccatatcaagcctatgtataaatacataactattgagggtacagagacagcagaaggtattgaaagtgcctatatagagtcagaaatacctgcattagctggaacatcaatagggtttaaaatcacatccaagtcaggaaaacatttattagatgtgataggttatgtcaaaagtgcgtcttactcagctgtttatacaaagttgtacacgacaggcccaacaatcggtgtcaatacaaagcatgatgagttgtgcacaggcccatgcccagtcaatgtaccgcacggcactggttggctaacatttgccaaagagagaacaagctcgtggggttgtgaggagtttggttgcctggcgattagtgacgggtgtgtctttggttcatgtcaagatattataaaagaagagctagctgtttataggaaagaaactgaagaggctacagatgtagaattatgcctaacctttgcagataagacttattgcaccaacctgaatgcaataacaccaataatcactgatcaatttgaagttcaattcaaaacagtcgaatcttatagtttacctagaattattgctgtacggaatcatgagatcatggtggggcagataaatgatatcggcgtttattcgaaaggttgcggaaatgtgcaaaaggtaaataatacaaattatggcaatggtgtacccaaatttgattatttatgccatttagcaagtaggaaagaagtaatagtcagaaaatgctttgataacgattatcaagcttgtaaatttctacaaacaccagcaagctatagattggaggaagagggtggttctgttacagttatagattataagaagatcctcggaacaataaagatgaaggctattctaggagatgtaaaatacaaaacatttgcagacaatgtagatttaactgttgaaggggtgtgcacagggtgtatcaattgttttgaaaatatacattgtgaactgacaatacatagtacagtggaagcaagttgtccagtgacaagctcatgcactgtgtttcatgatagaatcctgataacaccaaatgagcacaaatacgctataaaggtgatttgtgctgaaaaaccagggccatcattacagttcaaaatatgtaatgcaaaaactgatgcagctatgacattagcagatgcaaaaccgatattagaattagcgccagttgatcaaacaacatatataaaggaaaaagatgagagatgcaaaacctggatgtgtagagtcagagatgaaggcctccaagttatatttgaaccgtttaagaacttatttggctcttatataggcatattttatacatttttaataaccttaattgccgtattcatagtcatatacatcgtgctgccaatatgttttaagcttagagacactttaaggcagcatgaagatgcctacaagagagaaatgaaaattagataa

SEQ ID NO: 4252 - RNA, 4326 nt, synthetic construct
  misc_feature 1..4326: note = derived and/or modified CDS sequence (wt) from TVTV__AF123491.1__GP
  source 1..4326: mol_type = other RNA
atgattgtttttgctttgctaacaattgtggctgcaagtcctgtctacaaaagatgtttccaagatggagcaattgtcagacaagagtactcaaaaaatgcagttactgaagtctgcttaaaagacgatgttagtatgataaaaacagaggctgaatacttcaagaattcaaccggcgttttttcaaaaaacatagcatacaggaaatggctagtttcagattggaatgagtgcaggccacaaaagtcagcaaatggacacatcaatgtgattgaagttcaaccagacctatctttgcaaactaactcctatgtctgtgctgcaacatgtgttatcagtattgataaagaaacagcacaggtacgccttcagacagatacaacaaaccattttgaaatatctggcacaactgtgaaatctggatggtttaagagcactacatacctaaccctcgatcagacttgtgaacatttgaaaatttcatgtggttcaaagtctgtacaactacatgcgtgcttcaatcagcatatgagctgtgttagatttctacataggacaattctaccaggaaaacatcgcaaatcaatttgtcaaaatatagaaataatcatactgactagcctaagtctttttatatttttattcttaacaataataagtaagacatatatatgttatgtactaataccaatattcataccaatagcttacgtatatggatttatctacaataaatcatgtaaaaaatgcaaactatgtggactggtatatcacccttttacagaatgcggcagtcattgtgtttgtggggcaaaatatgacacatctgacaggatgaaaatgcatagatcatcaggattatgtccagggtataaaagcttaagggctgcaagatctatgtgcaaatcaaaaggaccagctcccatactatcgttattgagtgcagtcttgatcctaacttttgtaacacctataacggccatatcacttaaagatgaagaaaaagaaacatacaaattaccagaattacctgatgataaggttaatttggaaaccaagattgacttatacttccaaatgtgtctaataaattatgcaactacatgggctctaattttctgtgtattaataactgcatgtttattcaaaaagcttcaacataagtttcttgattattatgctgtctattgccatgaatgtgacatgtatcatgaaaagacgagcctgaaatacaatggtgatttctcaaacaaatgcagacaatgcacatgtgaacagtatgaggatgctactggattactaacacatcggaaatcatataatcgtctagtacaatataaagcaaaatggacgttgaatttcttgataacatatgctatcttagttatcatcaaagactctgtaatgattgtaggtgcaagcaatacagatgtcaaggattgcttggaccaagaagaaataacctggaattgtactggacccttcttgaatatgggaagatgcacaagacctcaaaaaaaggaaaactacggaaatatagcaactcaactgaaaggcctagatgtgttatctgctttagatatgccagctgtaggtaaaataccagaagatattgctggggcattgtcatacatcgaatctaaaaagacatatcatgaacaattaactttagaatttgcaatgctaacaaggtattgtgatttctataagcaatatgctgacaattcaggctacagtcagacaacatggagggcatacataagatctcatgactttggggtttgtataatgtacccgaatcaacatttttgtaggtgtgtaaaaatgggggaaaaatgtacaagttcaaattgggactttgcaaatcaaatggctaactactataatgggaagcaaaatagatttaacaaagatttaaatttagcattatataccatgcatcatgcttttagaggaagtactagttacttaatatctaaagtcctccatgagaaaaaatatgaccaattgactaatcttttaacacaattgaagacaaaatatcccggtaatgctttattgaaagcactgataggctaccaaatctatttaaaaagccttagtgaaatgtctagttttacacctgacgagctctgggatgatctgcaatatgtcccagccccaacatttaaaccaaatctcggcagaagtggagacaatgaatacaagtttgacaaatcaagaatagtcgatccacaaactacatgtacctctttgaaaggagtgaattgcttatcgccaagatcgcgagcaagtgtgagtgatattatagcatgtggacaagctacacagccagcattgttttatgtaccaaatgataaaatccaccaatctaacacagatcagaatcaatattgtatcggtgattctcattgcttaacaaaattcacgcccataacagaagaattgttggcagctgtaaaaaaatcaaaatgtcaggcttttgatttagacaatattgttaaaactagtacatcaactggggttagaagctgcttggttaaaaagtttggaaactgcaacactacaaaccaagtatggccgataactatatgctctgacgatcaatattattatacagacacgaaacaatcatatgactcatatcaagatattggacacttctgcctatctccaaggtgttcaacaatccgatatccagtaaacccaaaacatctatctgcatgtacatggacggaagaatatacaccagtcgacaaaatttctgtgacaaatattgaggaaatagagcaatataaaaaagctctattacaaaaattgcagacagggctgaacattttcaaatacaggaagacaagcaatctaccacacatcaagtcaatgtataaatacataacagttcaaggaacagggactgctgaaggcgtagaaaatgcttacatagaatctgaaatgcctgctttggccggtagttcttctggatttaaagttttatctaaagaaggtaatcatttatttgatgttgtggcctatataaagtctgcatcatattcctcagtttataataaattatacagtacgggacccaccttaggcataaatgtaaaacatgatgagaaatgcacagggccatgtcctgcaaacattccacataagacaggttggttaacttttgctagagagagaacaagcacctggggacgtgaagaatatggatgcttggcaattagtgatggatgtgtttttggttcctgtcaagatataattaaacctgagatgactgtttataggaagcaaacagatgaaattgtcaccgtagaattatgtctaacttttgtggacaaaacttattgcactgaattgaatgctgtaacacctataatatcagacttatttgaggtacaattcaaaacagtagaaagttacagtttacccaaaatagttgcaattaaaaatcatcaaatttttgtaggccaaatcaatgtcattggaactaattcaaaaggctgcggaaatgtgcaggtatttaatggaacaaattatggttcaggaacccccagatttgactatctatgccatctggcaagcagaagagaagtcataatgaggaagtgttttgacaatgattaccaagcatgtaagtttttacaacaaccctcaagttttagacttgaggaagagggagaaaccgtaacaataattgattacaaaaaaatattggggacaataaagatgaaagcaattttcggggacgtaaaatatagaacttttagtgaaaaagtggatataaatgctgaaggtgtctgcgcagggtgcatcaattgttttgagagaattaactgtgagttcacaatccacagcactgttgaaacaagttgtcctttagtagcagattgtcaattgttccatgacaggttacttataacaccaaatgaacacaaatatgctataaaagctatttgcaaagataaaccttcaaacactttgagatttagtatctgcaacacaaaggttgaagcaacagtcactataatagatgcaaaacctatattggagcttgcccctgtggatcaaacagcatatattaaggagaaagatgaaaggtgcaaaacatggctttgtagagtgaaagatgaaggtgtggcagttctattggagccatttaagaacttgtttggttcatatatagggatattttatggaataattcttgtcgtcttagctatactagtttgtatatatatcgtcttgccagtatgctttaaaattaaagacactctaaagaagcacgaggatgcttacaaaagagaaatgaaaataaggtaa

SEQ ID NO: 4253 - RNA, 4335 nt, synthetic construct
  misc_feature 1..4335: note = derived and/or modified CDS sequence (wt) from TVTV(AR42)__KX891322.1__GP
  source 1..4335: mol_type = other RNA
atgaggaatatgattgtttttgctttgctaacaattgtggctgcaagtcctgtctacaaaagatgtttccaagatggagcaattgtcagacaagagtactcaaaaaatgcagttactgaagtctgcttaaaagacgatgttagtatgataaaaacagaggctgaatacttcaaaaattcaaccggcgttttttcgaaaaacatagcatacaggaaatggctagtttcagattggaatgagtgcaggccacaaaagtcagcaaatggacacatcaatgtgattgaagttcaaccagacctatctttgcaaactaactcctatgtctgtgctgcaacatgtgttatcagtattgataaagaaacagcacaggtacgccttcaaacagatacaacaaaccactttgaaatatctggcacaactgtgaaatctggatggtttaagagcactacatacctaaccctcgatcagacttgtgaacatttgaaaatttcatgtggttcaaagtctgtacaactacatgcatgcttcaatcagcatatgagctgtgttagattcctacataggacaattctaccaggaaacatcgcaaattcaatttgtcaaaatatagaaataatcatactgactagcctaagcctttttatatttttattcttaacaataataagtaagacatatatatgttatgtactaataccaatattcataccaatagcttacgtatatggatttatctacaataaatcatgtaaaaaatgcaaactatgtggactggtataccacccttttacagaatgcggcagtcattgtgtttgtggggcaaaatatgacacatctgacaggatgaaaatgcatagatcatcaggattatgtccagggtataaaagcttaagggctgcacgatctatgtgcaaatcaaaaggaccagcttctatactatcgttattgagtgcagtcttgatcctaacttttgtaacacctataacagccatatcacttaaagatgaagaaaaagaaacatataaattatcagaattacctgatgatatggttaatttggaaaacaagattgacttatacttccaaatgtgtctaataaattatgcaactacatgggccctaattttctgtgcattaataactgcatgtttattcaaaaagcttcaacataagtttcttgattattatgctgtctactgccatgaatgtgacatgtatcatgaaagaagaggcctgaaatacaatggtgatttctcaaacaaatgcagacaatgcacatgtggacagtatgaggatgctactggattactaacacatcggaaatcatataattgtctagtgcaatataaagcaaaatggatgttgaatttcttgataacatatgctatcttagttatcatcaaagattctgtaatgattgtaggtgcaagcgatacagatgtcaaggattgcttggaccaagaagaaataacctggaattgtactggacccttcttgaatatgggaagctgcacaagacctcaaaaaaaggaaaactacggaaatatagcaactcaactgaaaggcttagatgtgttatctgctttagatatgccagctgtaggcaaaataccagaagatattgctggggcattgtcatacattgaatctaaaaagacatatcatgaacaattaactttagaatttgcaatgctaacaaggtattgtgatttctataagcaatatgctgacaattcaggctacagtcagacaacatggagggcatacataagatctcatgactttggggtttgtataatgtacccgaatcaacatttttgtaggtgtgtaaaaatgggggaaaaatgtacaagttcaaattgggactttgcaaatcaaatggctaactactataatgggaagcaaaatagattcaacaaagatttaaatttagcattatacaccatgcatcatgcttttagaggaagtactagttatttaatatctaaagtcctccatgagaaaaaatatgaccaattgactaatcttttaacacaattgaagacaaaatatcccggtaatgctttattgaaagcactgatagactaccaaatctatttaaaaagccttagtgaaatgtctagttttacacctgacgagctctgggatgatctgcaatatgtcccagccccaacatttaaaccaaatctcggcagaagtgaagacaacgaatacaagtttgataagtcaagaatagttgatccacaaactacatgtacctctttgaaaggagtgaattgcttatcgccaagatcgcgagcaagtgtgagtgatattatagcatgtggacaggctacacagccagcattgttttatgtaccaaatgataaaattcaccaatctaatacagatcagaatcaatattgtattggtgattctcattgcttaacaaaattcacgcccataacagaagaattgttggcagctgtaaaaaaatcaaaatgtcaggcttttgatttagacgatattgttaaaactagtccatcaactggggttagaagctgcctagttaagaagtttggaaactgcaacactacaaaccaagtatggccgataactatatgctctgacgatcaatattattatacagacacgaaacaatcatatgactcaaatcaagatattggacacttctgcctatctccaaggtgttcaacaatccgatatccggtaaacccaaaacatctatctgcatgtacatggacagaagaatatacaccagtcgacaaaatttctgtgacaaatattgaagaaatagagcaatataaaaaagctctattacaaaaattacagacagggctgaacattttcaaatacaagaagacaagcaatctaccacatatcaagccaatgtataaatacataacagtgcaaggaacagagactgctgaaggcgtagaaaatgcttacatagaatctgaaatgcctgctttggctggtagttcttctggatttaaagttttatctaaagaaggtaatcatttatttgatgttgtggcctatataaagtctgcatcatattcctcagtttataataaattatacagtacaggacccaccttaggcataaatgtaaaacatgatgagaaatgcacagggccatgtcctgcaaacattccacataagacaggttggttaacttttgctagagagagaacaagcacctggggatgtgaagaatatggatgcttggcaattagtgatggatgtgtttttggttcctgtcaagatataattaaacctgagatgactgtttataggaagcaaacagatgaaattgtcaccgtagaattatgtttaacttttgtggacaaaacttattgcactgaattgaatgctgtaacacctataatatcagacttatttgaggtacaattcaaaacagtagaaagttacagtttacccaaaatcgttgcaattaaaaatcatcaaatttttgtaggccaaatcaatgacattggaacttattcaaaaggctgcggaaatgtgcaggtatttaatggaacaaattatggttcaggaactcccagatttgactatctatgccatctggcaagcagaaaagaagtcataatgaggaagtgttttgacaatgattaccaagcatgtaagtttttacaacaaccctcaagttttagacttgaggaagagggagaaaccgtaacaataattgattacaaaaaaatattagggacaataaagatgaaagcaattttcggggacgtaaaatataaaacttttagtgaaaaagtggatataaatgctgaaggtgtctgcgcagggtgcatcaattgttttgagagtattaactgtgagttcacaatccacagcactgttgagacaagttgtcctttagtagcagattgtcaattgttccatgacaggttacttataacaccaaatgaacacaaatatgctataaaagctatttgtaaagataaaccttcaaacactttgagatttagtatctgcaacacaaaggttgaagcaacagtcactataatagatgcaaaacctatattggagcttgcccctgtagatcaaacagcatatattaaggagaaagatgaaaggtgcaagacatggctttgtagagtgaaagatgaaggtgtggcagttctattggagccatttaagaacttgtttggttcatatatagggatattttatggaataattcttgtcgtcttagctatactagtttgtatatatatcgtcttgccagtatgctttaaaattagagacactctaaagaagcacgaggatgcttacaagagagaaatgaaaataaggtaa

SEQ ID NO: 4254 - RNA, 4335 nt, synthetic construct
  misc_feature 1..4335: note = derived and/or modified CDS sequence (wt) from TVTV(Eklund)__KR149248.1__GP
  source 1..4335: mol_type = other RNA
atgaggaatatgattgtttttgctttgctaacaattgtggctgcaagtcctgtctacaaaagatgtttccaagatggagcaattgtcagacaagagtactcaaaaaatgcagttactgaagtctgcttaaaagacgatgttagtatgataaaaacagaggctgaatacttcaagaattcaaccggcgttttttcaaaaaacatagcatacaggaaatggctagtttcagattggaatgagtgcaggccacaaaagtcagcaaatggacacatcaatgtgattgaagttcaaccagacctatctttgcaaactaactcctatgtctgtgctgcaacatgtgttatcagtattgataaagaaacagcacaggtacgccttcagacagatacaacaaaccattttgaaatatctggcacaactgtgaaatctggatggtttaagagcactacatacctaaccctcgatcagacttgtgaacatttgaaaatttcatgtggttcaaagtctgtacaactacatgcgtgcttcaatcagcatatgagctgtgttagatttctacataggacaattctaccaggaaacatcgcaaattcaatttgtcaaaatatagaaataatcatactgactagcctaagtctttttatatttttattcttaacaataataagtaagacatatatatgttatgtactaataccaatattcataccaatagcttacgtatatggatttatctacaataaatcatgtaaaaaatgcaaactatgtggactggtatatcacccttttacagaatgcggcagtcattgtgtttgtggggcaaaatatgacacatctgacaggatgaaaatgcatagatcatcaggattatgtccagggtataaaagcttaagggctgcaagatctatgtgcaaatcaaaaggaccagcttctatactatcgttattgagtgcagtcttgatcctaacttttgtaacacctataacagccatatcacttaaagatgaagaaaaagaaacatacaaattatcagaattacctgatgatatggttaatttggaaaccaagattgacttatacttccaaatgtgtctaataaattatgcaactacatgggctctaattttctgtgcattaataactgcatgtttattcaaaaagcttcaacataagtttcttgattattatgctgtctattgccatgaatgtgacatgtatcatgaaagacgaggcctgaaatacaatggtgatttctcaaacaaatgcagacaatgcacatgtggacagtatgaggatgctactggattactaacacatcggaaatcatataattgcctagtacaatataaagcaaaatggatgttgaatttcttgataacatatgctatcttagttatcatcaaagactctgtaatgattgtaggtgcaagcaatacagatgtcaaggattgcttggaccaagaagaaataacctggaattgtactggacccttcttgaatatgggaagatgcacaagacctcaaaaaaaggaaaactacggaaatatagcaactcaactgaaaggcctagatgtgttatctgctttagatatgccagctgtaggtaaaataccagaagatattgctggggcattgtcatacatcgaatctaaaaagacatatcatgaacaattaactttagaatttgcaatgctaacaaggtattgtgatttctataagcaatatgctgacaattcaggctacagtcagacaacatggagggcatacataagatctcatgactttggggtttgtataatgtacccgaatcaacatttttgtaggtgtgtaaaaatgggggaaaaatgtacaagttcaaattgggactttgcaaatcaaatggctaactactataatgggaagcaaaatagatttaacaaagatttaaatttagcattatataccatgcatcatgcttttagaggaagtactagttatttaatatctaaagtcctccatgagaaaaaatatgaccaattgactaatcttttaacacaattgaagacaaaatatcccggtaatgctttattgaaagcactgatagactaccaaatctatttaaaaagccttagtgaaatgtctagttttacacctgacgagctctgggatgatctgcaatatgtcccagccccaacatttaaaccaaatctcggcagaagtgaagacaatgaatacaagtttgacaaatcaagaatagtcgatccacaaactacatgtacctctttgaaaggagtgaattgcttatcgccaagatcgcgagcaagtgtgagtgatattatagcatgtggacaagctacacagccagcattgttttatgtaccaaatgataaaatccaccaatctaacacagatcagaatcaatattgtatcggtgattctcattgcttaacaaaattcacgcccataacagaagaattgttggcagctgtaaaaaaatcaaaatgtcaggcttttgatttagacaatattgttaaaactagtccatcaactggggttagaagctgcttggttaaaaagtttggaaactgcaacactacaaaccaagtatggccgataactatatgctctgacgatcaatattattatacagacacgaaacaatcatatgactcatatcaagatattggacacttctgcctatctccaaggtgttcaacaatccgatatccagtaaacccaaaacatctatctgcatgtacatggacggaagaatatacaccagtcgacaaaatttctgtgacaaatattgaagaaatagagcaatataaaaaagctctattacaaaaattgcagacagggctgaacattttcaaatacaggaagacaagcaatctaccacacatcaagccaatgtataaatacataacagttcaaggaacagagactgctgaaggcgtagaaaatgcttacatagaatctgaaatgcctgctttggccggtagttcttctggatttaaagttttatctaaagaaggtaatcatttatttgatgttgtggcctatataaagtctgcatcatattcctcagtttataataaattatacagtacaggacccaccttaggcataaatgtaaaacatgatgagaaatgcacagggccatgtcctgcaaacattccacataagacaggttggttaacttttgctagagagagaacaagcacctggggatgtgaagaatatggatgcttggcaattagtgatggatgtgtttttggttcctgtcaagatataattaaacctgagatgactgtttataggaagcaaacagatgaaattgtcaccgtagaattatgtttaacttttgtggacaaaacttattgcactgaattgaatgctgtaacacctataatatcagacttatttgaggtacaattcaaaacagtagaaagttacagtttacccaaaatagttgcaattaaaaatcatcaaatttttgtaggccaaatcaatgacattggaacttattcaaaaggctgcggaaatgtgcaggtatttaatggaacaaattatggttcaggaacccccagatttgactatctatgccatctggcaagcagaaaagaagtcataatgaggaagtgttttgacaatgattaccaagcatgtaagtttttacaacaaccctcaagttttagacttgaggaagagggagaaaccgtaacaataattgattacaaaaaaatattggggacaataaagatgaaagcaattttcggggacgtaaaatataaaacttttagtgaaaaagtggatataaatgctgaaggtgtctgcgcagggtgcatcaattgttttgagagtattaactgtgagttcacaatccacagcactgttgaaacaagttgtcctttagtagcagattgtcaattgttccatgacaggttacttataacaccaaatgaacacaaatatgctataaaagctatttgcaaagataaaccttcaaacactttgagatttagtatctgcaacacaaaggttgaagcaacagtcactataatagatgcaaaacctatattggagcttgcccctgtagatcaaacagcatatattaaggagaaagatgaaaggtgcaaaacatggctttgtagagtgaaagatgaaggtgtggcagttctattggagccatttaagaacttgtttggttcatatatagggatattttatggaataattcttgtcgtcttagctatactagtttgtatatatatcgtcttgccagtatgctttaaaattaaagacactctaaagaagcacgaggatgcttacaaaagagaaatgaaaataaggtaa

SEQ ID NO: 4255 - RNA, 4335 nt, synthetic construct
  misc_feature 1..4335: note = derived and/or modified CDS sequence (wt) from JCV(3324-04)__HM007357.1__GP
  source 1..4335: mol_type = other RNA
atggaagtcctaaacttaatatggttgctgacattatgtttggctagtccagtattccagcgatgtttccaagatggggctatagtgaagcaaaacccatcaaaagaggcagtgacagaagtctgcttgaaagatgatgtaagtatgataaaaacagaagcaaaatatgtaaaaaatacaacaggaacatttgccaacaacattgctatgaggaaatggttagttgcagattggcatgactgcaggcctcagaagtcatcgggtggtcatatcaatgtcattgaggttggtgatgacctatcgctccatactgaatcatacatctgtagtgcagactgtgtcattacagttgacaaggaaacagcacaaatccggttacagactgacaatacaaatcattttgaagttgccggcactacagttaaatctggatggtttaagagcacaacgtatatcacactcgaccagacatgtgagcatctcaaagtgtcatgtgggcctaaatcaatacaattccatgcttgcttcaatcagcatatgtcatgcgtacgattcttgcatagaacaatacttccaggttcaatagcaaactccatatgccaaaatatagaaataattatcttagtcactctatcattagtgatcttcatatttttaacaatagtgagtaagacatacatatgctacttattaatgcctatctttattccaatagcatttatttacggatggatatataataaatcctgcaaaaagtgtaaactatgtggtttggtgtatcacccatttaccgaatgtggcacacattgtgtttgcggtgcaagatatgagacttctgatagaatgaaattgcacagagcatctgggttatgcccagggtataaaagccttagagcagcaagggttatgtgtaagtcaaaagggccagcttcagttttatctataatgactgcagttctcatattaacattcgtcactcctattagtgctatggttattggtgaatcaagtgaaatatatacactagaagatttacctgacgatatggtacaaatggcagaaaggataaatatttattatcaaataattattatcaattacggtattacatgggctttcctactgcttggcctgcttctcgcatacttttttaggaaatatcagcatagattcttagacttttacgcaatgtattgtgaagagtgtgacatgtaccatgaaaaagctggtttgacacattggggtgacttcacaaataagtgcagacaatgtacatgcggccaatatgaagacattactgggttaatggttcataaaaaatcctataattgcttggtgaagtataaagcaaaatggatacgagatattttaatcacatatcttgttataatattagttaaagattcactactatttgttggtgcaacaggaaccgattttgctacatgtatagatgagaaaactgttacatggaattgtaccggaccattcttaaatttgggtagatgtgataaatctcaaaagaaaaccaattatgctgatatagccaatcaattaaaggggttaggtgtcatttcagtactagacatcccaatgataaagaagatgccagatgaaatatcaggatctttaaaatatattgataatttagagacgtaccatgagcaactgactgctgagtatgcttttcttactagatactgcgactattatacacaatacactgacaattcaggctatagccagacagtgtggagaacatacttgcgatctcatgacttcggtgcatgtgttgtctacccaaaccaacatttttgcagatgtgtaaaatatggtgataagtgtaatagtgccaagtgggatttcgcaaatgaaatgaaaactttctatacaggtcaaaaagcgaaattcaataaggacctaaatttggcattattagtattgcataaggcatttagaggcaccggaaccgcatatatagcagaagctatggctcgcaaagataatggttctatggcacactttgccttagaagtaagaaagaaattcccaacaaatgccctattggcagcattgatagattacattgtttacttacaatcacttgcagaaatatccacatttgaactagatgaggattgggaagattttaaatataagccagagccaacagaatcaacaatccaagccagatcgcatagagatgatcagtacaattttaagaatgcagctagtggcagcaatgttaaagtttgtaaaaatattcagaaagtgctatgtatttcacctagatcaagggctaaatttgagaatatcatagcatgtggagaacatgcaaacccatcagtatatatgatgcctaatgttagtatttaccaatcaagctcagagagaagccattattgtatagctgattcacattgcttagaagaatatgaagtggtggagacagagcttttgaatgcactgaagaagtctaaatgctgggtcaaagaaatggacgatgttattctacataagcaaagtgatggtttgaggagttgtaggatgaaagacactggaaattgcaatgttcaagaaaatgattggaatattgtcctatgtgaaaatggcaactattattattcagaaattcacaaagattatgataaagaccaggatgtaggacacttttgtctaagccctaggtgcaacacaatacgttacccaataagtaagaggcatatcagaagctgcaactggcaaatttcacattctacaatcgacaagatagcagtccaagaattagctgatatagaacaatataagaaggctatctcacaaaaattgcaaacgagtctatcaattttcaaatatataaaaacaaaaaatcttccacacattaaacctgcatacaaatatataactgtggaaggtgttgagactgttgaaggaatagaaaatgcctttatagagtctgaaatcccagcattggctggcacagctatcggcttcaaaataaattcaagagaaggcaattatttaatggatgtgatagggtatgttaaaagtgcatcttactcagcaacatatacaaaattgtacacaactggccccactataggaataaatactagacatgatgagaaatgtacaggaccttgcccagctgtaatagatcataaagatggctggttaactttctcaaaggaaagaactagtacatggggctgcgaagaatttggttgtttagcagtaagtgatggttgtgtatttggatcctgtcaagatattataaaggacgaactagctgtctataggaagaccactgaggagcttactactgtagaattgtgtttgacattttcagataagacttactgtactaatttaaatgctataactcctataataactgacaagtttgaagttcaatttaaaacagttgaggcctatacattaccaagaataattgcagtaaagaatcacgagatcaaggttggacagattaatgatcttggtgtttactctaaaggatgtggaaatgtccaaaaggttaatggaactaattatgggaatggtgcaccaagattcgattatctgtgccacttagcaagtagaaaagaagtgattttaagaaagtgttttgacaatgattatcaagcttgcaaatttctacaaagtccttcaagttatcgtttggaagaacaccaaggcacagtaacagttatagattataagaaaattttaggtaccataaaaatgaaggctatattgggagatgtaaaatacaagaatttccaaagcaatatagaaatcaatgcagaagggacatgtgctggatgtataaattgctttgagaatattcactgtgaatttactatacataccactgttgaaacaagctgccctatagttacagattgtgtttcatttcatgatagaatattaattacaccagatgagcataagtatgcattaaaagttgtatgtcaagacaagcccaaagtgtctctaaaatttaaaatttgcaatacgaatattgatgcatctatgaccatagtggattctaagccaatcttagaacttgcaccagttgaccaaactgcatatatcagagaaaaagatgaaaggtgtaagacctggatgtgtagagtccgagacgaagggtttcaagttatactagagccttttaagaacctttttggctcttacatagggatattttatacaggtatattatctataatttgtctccttattgtcatttatattatactgcctatctgcttcaaattaagagacactttaaggcagcatgaggacgcatataagaaagaaatgaaaataagataa

SEQ ID NO: 4256 - RNA, 4335 nt, synthetic construct
  misc_feature 1..4335: note = derived and/or modified CDS sequence (wt) from JCV(61V2235)__U88058.1__GP
  source 1..4335: mol_type = other RNA
atggaagtcctaaacttaatctggttactagcattgtgctcagctagtccagtatttcaacggtgtttccaagatggagctatagtgaagcaaaacccatctaaggaagcagtgacagaggtgtgcttaaaggatgacgtgagcatgataaaaacagaagcaaaatatgtaaaaaataccacagggacatttgctaataacatagctatgagaaaatggttggttgcagattggcatgactgtaggccccaaaagtcatcaggtggtcatattaatgttattgaagttggagatgatctgtcgctccacacagagtcttatatttgcagtgcagattgtgttatcacagttgataaagaaactgctcagatccgcttgcaaactgacaatacaaaccactttgaggttgctgggaccacagtaaaatcaggttggttcaaaagtacaacttatatcacacttgatcaaacatgtgagcatcttaaagtatcatgcggaccaaaatcgatacagtttcatgcttgcttcaatcagcatatgtcttgtgtgcgattcttacatagaacgatactaccagggtcaattgctaattccatatgtcaaaatatagaaataattatcttggttactctctcattagtaatcttcatattcttatcaatagtaagcaagacatatgtatgttacttattaatgcctatcttcaccccaatagcttttatctatggatgggtatacaataaatcctgcaagaaatgcaagttatgtggcttagtttatcacccattcacagaatgtggaacacactgtgtatgtggtgcaagatatgaaaattctgataggatgaaattgcatagagcatctggattgtgtccagggtacaagagtctcagagcagctagagttatgtgcaaatcaaaaggaccagcttctatcctatctataatgactgcaattctcatactaacatttgtcacccctattagtgccatggtcataggtgaatcaagtgagctgtacacactagatgatttacccaatgatatggtacaaatggcggagagggtgaatatctattatcaaataaccatcattaattatggtgtcacttgggctttcttttgccttggtttaattttggcatacttcttcaaaaaatatcaacataaatttctagatttttatgcgatgtattgtgaggaatgcgatatgtatcatgagaaatctggtttgacacactggggtgactttactaataaatgtagacagtgcacatgcggtcagtttgaagatgttgctggcttgatgatacataaaaaatcttacaattgtttggtcaaatataaagcgaaatggataagagacatactcatcatatatttggctatgattctgatcaaagattcgttattattcgttggagcatcggggacagactttgctgcatgtatagatgagaaagtcgttacatggaactgcaccgggccattcctaaatttaggtagatgcgacaaatctcagaagaaagcaagctatgcaggtatagctgatcagttaaagggcttaggagttatatctgttttggatatcccgatgataaaaaatatgccagatgaaatatcaggttcactaaagtatatcgacagcttagagacgtatcatgagcagctaactgctgaatatgccttcctcaccaggtactgcgactattatacacaatacacagataaatctggctatagtcaaacagtatggaggacttatttacgatctcatgattttggtgcatgtgttgtttatccgaatcaacatttttgtagatgcgtaaagtatggagataaatgcaatagtgccaagtgggattttgccaatgagatgaaaacattctacacaggccagaaagtgaagtttaataaggatttaaacttggcattattggtattacataaagcatttagaggcactggaactgcatatgttgcagaagctatggctcgggaagataacggttccatggcacattttgctttggagataagaaaaaaattcccaacaaatgctttgttagcagcattaatagattatatagtttatttacagtcccttggagaaatagccacatttgaactcgatgaagattgggaagattttaaatataagccagagccaacagaatcaacacctcaagttaggtcacacagaaatgatcagtataacttcaaaaatgctgaaagtaatagtgataccaaagtctgtaagaatgttcagaaagtactatgtatttcacccaggtcaaaggcaaaattcgaaaatattatagcatgtggagagcatgcaaatccatctgtatacatgatgccaaatgtcagcatctaccaatccaattcggaaaggagtcactattgtatagctggctctcattgccttgagaaatatgaagtggtagaaacagaacttttgaatgctttaaagaagtcaaaatgttgggccaaggaaatggatgatattatcttgcataagcagagcgatggcttgaggagttgtagaataaaagatactggaaactgcaatgttcaagaaaatgattggaccattgtcttatgcgaaaatggcaactattactactctgaggtccacaaagactatgataaagatcaggatgtaggtcatttctgtcttagccctagatgcactacaatacgttatccaataagtaaaaggcatataaagaagtgcgaatggcagatatcacattcaacaattgataaaatctctgttcaagagttagcagacatagaacaatataagaaggccatatcacaaaaactgcaaacaagtctatcaatttttaagtatgtaagaacaaaaaacctcccacatatcaaacccgcatataagtacataactgtagaaggtgtcgaaactattgaaggaatcgaaaacgcttttatagagtctgagatcccagcattggcaggtacagctataggtttcaaaataaattcaagagaaggcaactatctaatggatgtgatagggtatgttaagagcgcatcatattcagcagtgtacacaaagctatatacaactgggcctactataggaataaacaccaaacatgatgaaaaatgcacaggaccttgcccagctataatagatcataaagatggttggctaaccttctcaaaagaaaggaccagcacttggggttgtgaagagtttggttgcttagcagtcagtgatggttgtgtatttggctcttgccaagatataataaaagatgaattggctgtttataggaaaactactgaagaactcactacagtagaactgtgcttgacattttcagataaaacatattgcaccaacttgaatgctataactcctattataacagataaatttgaagtgcagttcaaaactgttgaatcttatacactaccaagagtcattgccataaagaatcatgagattaaggttggacaaatcaatgacttaggtgtctactcaaaaggatgtggaaatgttcaaaaggtcaatggaacaaactatggcaatggttcaccaaggtttgattatctttgccacttggcgagtagaaaagaagtaatcctaaggaaatgttttgacaatgattaccaggcttgcaaattcttgcagagtccttcaagttatcgtttagaagagcaccagggaacagtgacagttatagattataaaaagattctaggcactataaagatgaaggctatattaggggatgtgaaatacaaaaattatcaaaataatatagaaatcagtgctgagggaacatgtgctggatgtattgattgctttgaaaatatacactgtgaatttactatacatactacagttgaggcaagttgtcctataacaacagagtgtgtctccttccatgatagaatattgatcacaccagatgaacataagtatgcattgaagattgtatgtcatgataaaccaaaagtgtctcttaaatttaaaatctgtaacacacatgttgatgcagctatgactattgtagattctaaaccaattttagaacttgcgccagtagatcaaacaacatacatcagagagaaagatgaaagatgcaagacctggatgtgtagagtccgagatgaagggttccaggtgatattagaaccttttaaaaacctctttggttcgtatattggaatattttatactggtatattgtctattatttgtttactcattgtcgtctatattatattgcccatttgtttcaaattgagggacaccttaaggcagcatgaagatgcctataaaaaggaaatgaagataagatga

SEQ ID NO: 4257 - RNA, 4335 nt, synthetic construct
  misc_feature 1..4335: note = derived and/or modified CDS sequence (wt) from JCV(61V2235)__HM007351.1__GP
  source 1..4335: mol_type = other RNA
atggaagtcctaaacttaatctggttactagcattgtgctcagctagtccagtatttcaacggtgtttccaagatggagctatagtgaagcaaaacccatctaaggaagcagtgacagaggtgtgcttaaaggatgacgtgagcatgataaaaacagaagcaaaatatgtaaaaaataccacagggacatttgctaataacatagctatgagaaaatggttggttgcagattggcatgactgtaggccccaaaagtcatcaggtggtcatattaacgttattgaagttggagatgatctgtcgctccacacagagtcttatatttgcagtgcagattgtgttatcacagttgataaagaaactgctcagatccgcttgcaaactgacaatacaaaccactttgaggttgctgggaccacagtaaaatcaggttggttcaaaagtacaacttatatcacacttgatcaaacatgtgagcatcttaaagtatcatgcggaccaaaatcgatacagtttcatgcttgcttcaatcagcatatgtcttgtgtgcgattcttacatagaacgatactaccagggtcaattgctaattccatatgtcaaaatatagaaataattatcttggttactctctcattagtaatcttcatattcttatcaatagtaagcaagacatatgtatgttacttattaatgcctatcttcatcccaatagcttttatctatggatgggtatacaataaatcctgcaagaaatgcaagttatgtggcttagtttatcacccattcacagaatgtggaacacactgtgtatgtggtgcaagatatgaaacttctgataggatgaaattgcatagagcatctggattgtgtccagggtacaagagtctcagagcagctagagttatgtgcaaatcaaaaggaccagcttctatcctatctataatgactgcaattctcatactaacatttgtcacccctattagtgccatggtcataggtgaatcaagtgaggtgtacacactagatgatttacccaatgatatggtacaaatggcggagagggtgaatatctattatcaaataatcatcattaattatggtgtcacttgggctttcttattgcttggtttaattttggcatacttcttcaaaaaatatcaacataaatttctagatttttatgcaatgtattgtgaggaatgcgatatgtatcatgagaaatctggtttgacacactggggtgactttactaataaatgtagacagtgcacatgcggtcagtttgaagatgttgctggcttgatgatacataaaaaatcttacaattgtttggtcaaatataaagcgaaatggataagagacatactcatcatatatttggctatgattctgatcaaagattcgttattattcgttggagcatcggggacagactttgctgcatgtatagatgagaaagtcgttacatggaactgcactgggccattcctaaatttaggtagatgcgacaaatctcagaagaaagcaagctatgcaggtatagctgatcagttaaagggcttaggagttatatctgttttggatatcccgatgataaaaaatatgccagatgaaatatcaggttcactaaagtatatcgacagcttagagacgtatcatgagcagctaactgctgaatatgctttcctcaccaggtactgcgactattatacacaatacacagataactctggctatagtcaaacagtatggaggacttatttacgatctcatgattttggtgcatgtgtcgtttatccgaatcaacatttttgtagatgcgtaaagtatggagataaatgcaatagtgccaagtgggattttgccaatgagatgaaaacattctacacaggccagaaagtgaagtttaataaggatttaaacttggcattattggtattacataaagcatttagaggcactggaactgcatatgttgcagaagctatggctcggaaagataacggttccatggcacattttgctttggagataagaaaaaaattcccaacaaatgctttgttagcagcattaatagattatatagtttatttacagtcccttggagaaatagccacatttgaactcgatgaagattgggaagattttaaatataagccagagccaacagaatcaacacctcaagttaggtcacacagaaatgatcagtataacttcaaaaatgctgaaagtaatagtgataccaaagtctgtaagaatgttcagaaagtactatgtatttcacccaggtcaaaggcaaaattcgaaaatattatagcatgtggagagcatgcaaatccatctgtatacatgatgccaaatgtcagcatctaccaatccaattcggaaaggagtcactattgtatagctgactctcattgccttgagaaatatgaagtggtagaaacagaacttttgaatgctttaaagaagtcaaaatgttgggccaaggaaatggatgatattatcttgcataagcagagcgatggcttgaggagttgtagaataaaagatactggaaactgcaatgttcaagaaaatgattggaccattgtcttatgcgaaaatggcaactattactactctgaggtccacaaagactatgataaagatcaggatgtaggtcatttctgtctcagccctagatgcactacaatacgttatccaataagtaaaaggcatataaagaagtgcgaatggcagatatcacattcaacaattgataaaatctctgttcaagagttagcagacatagaacaatataagaaggccatatcacaaaaactgcaaacaagtctatcaatttttaagtatgtaagaacaaaaaacctcccacatatcaaacccgcatataagtacataactgtagaaggtgtcgaaactattgaaggaatcgaaaacgcttttatagagtctgagatcccagcattggcaggtacagctataggtttcaaaataaattcaagagaaggcaactatctaatggatgtgatagggtatgttaagagcgcatcatattcagcagtgtacacaaaactatatacaactgggcctactataggaataaacaccaaacatgatgaaaaatgcacaggaccttgcccagctataatagatcataaagatggttggctaaccttctcaaaagaaaggaccagcacttggggttgtgaagagtttggttgcttagcagtcagtgatggttgtgtatttggctcttgccaagatataataaaagatgaattggctgtttataggaaaactactgaagaactcactacagtagaactgtgcttgacattttcagataaaacatattgcaccaacttgaatgctataactcctattataacagataaatttgaagtgcagttcaaaactgttgaatcttatacactaccaagagtcattgccataaagaatcatgagattaaggttggacaaatcaatgacttaggtgtctactcaaaaggatgtggaaatgttcaaaaggtcaatggaacaaactatggcaatggttcaccaaggtttgattatctttgccacttggcgagtagaaaagaagtaatcctaaggaaatgttttgacaatgattaccaggcttgcaaattcttgcagagtccttcaagttatcgtttagaagagcaccagggaacagtgacagttatagattataaaaagattctaggcactataaagatgaaggctatattaggggatgtgaaatacaaaaattatcaaaataatatagaaatcaatgctgagggaacatgtgctggatgtattgattgctttgaaaatatacactgtgaatttactatacatactacagttgaagcaagttgtcctataacaacagagtgtgtctccttccatgatagaatattgatcacaccagatgaacataagtatgcattgaagattgtatgtcatgataaaccaaaagtgtctcttaaatttaaaatctgtaacacaaatgttgatgcagctatgactattgtagattctaaaccaattttagaacttgcgccagtagatcaaacaacatacatcagagagaaagatgaaagatgcaagacctggatgtgtagagtccgagatgaagggttccaggtgatattagaaccttttaaaaacctctttggttcgtatattggaatattttatactggtatattgtctattatttgtttactcattgtcgtctatattatattgcccatttgtttcaaattgagggacaccttaaggcagcatgaagatgcctataaaaaggaaatgaagataagatga

SEQ ID NO: 4258 - RNA, 4335 nt, synthetic construct
  misc_feature 1..4335: note = derived and/or modified CDS sequence (wt) from JCV(61V2235)__KX817316.1__GP
  source 1..4335: mol_type = other RNA
atggaagtcctaaacttaatctggttactagcattgtgctcagctagtccagtatttcaacggtgtttccaagatggagctatagtgaagcaaaacccatctaaggaagcagtgacagaggtgtgcttaaaggatgacgtgagcatgataaaaacagaagcaaaatatgtaaaaaataccacagggacatttgctaataacatagctatgagaaaatggttggttgcagattggcatgactgtaggccccaaaagtcatcaggtggtcatattaacgttattgaagttggagatgatctgtcgctccacacagagtcttatatttgcagtgcagattgtgttatcacagttgataaagaaactgctcagatccgcttgcaaactgacaatacaaaccactttgaggttgctgggaccacagtaaaatcaggttggttcaaaagtacaacttatatcacacttgatcaaacatgtgagcatcttaaagtatcatgcggaccaaaatcgatacagtttcatgcttgcttcaatcagcatatgtcttgtgtgcgattcttacatagaacgatactaccagggtcaattgctaattccatatgtcaaaatatagaaataattatcttggttactctctcattagtaatcttcatattcttatcaatagtaagcaagacatatgtatgttacttattaatgcctatcttcatcccaatagcttttatctatggatgggtatacaataaatcctgcaagaaatgcaagttatgtggcttagtttatcacccattcacagaatgtggaacacactgtgtatgtggtgcaagatatgaaacttctgataggatgaaattgcatagagcatctggattgtgtccagggtacaagagtctcagagcagctagagttatgtgcaaatcaaaaggaccagcttctatcctatctataatgactgcaattctcatactaacatttgtcacccctattagtgccatggtcataggtgaatcaagtgaggtgtacacactagatgatttacccaatgatatggtacaaatggcggagagggtgaatatctattatcaaataatcatcattaattatggtgtcacttgggctttcttattgcttggtttaattttggcatacttcttcaaaaaatatcaacataaatttctagatttttatgcaatgtattgtgaggaatgcgatatgtatcatgagaaatctggtttgacacactggggtgactttactaataaatgtagacagtgcacatgcggtcagtttgaagatgttgctggcttgatgatacataaaaaatcttacaattgtttggtcaaatataaagcgaaatggataagagacatactcatcatatatttggctatgattctgatcaaagattcgttattattcgttggagcatcggggacagactttgctgcatgtatagatgagaaagtcgttacatggaactgcactgggccattcctaaatttaggtagatgcgacaaatctcataagaaagcaagctatgcaggtatagctgatcagttaaagggcttaggagttatatctgttttggatatcccgatgataaaaaatatgccagatgaaatatcaggttcactaaagtatatcgacagcttagagacgtatcatgagcagctaactgctgaatatgctttcctcaccaggtactgcgactattatacacaatacacagataactctggctatagtcaaacagtatggaggacttatttacgatctcatgattttggtgcatgtgtcgtttatccgaatcaacatttttgtagatgcgtaaagtatggagataaatgcaatagtgccaagtgggattttgccaatgagatgaaaacattctacacaggccagaaagtgaagtttaataaggatttaaacttggcattattggtattacataaagcatttagaggcactggaactgcatatgttgcagaagctatggctcggaaagataacggttccatggcacattttgctttggagataagaaaaaaattcccaacaaatgctttgttagcagcattaatagattatatagtttatttacagtcccttggagaaatagccacatttgaactcgatgaagattgggaaggttttaaatataagccagagccaacagaatcaacacctcaagttaggtcacacagaaatgatcagtataacttcaaaaatgctgaaagtaatagtgataccaaagtctgtaagaatgttcagaaagtactatgtatttcacccaggtcaaaggcaaaattcaaaaatattatagcatgtggagagcatgcaaatccatctgtatacatgatgccaaatgtcagcatctaccaatccaattcggaaaggagtcactattgtatagctgactctcattgccttgagaaatatgaagtggtagaaacagaacttttgaatgctttaaagaagtcaaaatgttgggccaaggaaatggatgatattatcttgcataagcagagcgatggcttgaggagttgtagaataaaagatactggaaactgcaatgttcaagaaaatgattggaccattgtcttatgcgaaaatggcaactattactactctgaggtccacaaagactatgataaagatcaggatgtaggtcatttctgtctcagccctagatgcactacaatacgttatccaataagtaaaaggcatataaagaagtgcgaatggcagatatcacattcaacaattgataaaatctctgttcaagagttagcagacatagaacaatataagaaggccatatcacaaaaactgcaaacaagtctatcaatttttaagtatgtaagaacaaaaaacctcccacatatcaaacccgcatataagtacataactgtagaaggtgtcgaaactattgaaggaatcgaaaacgcttttatagagtctgagatcccagcattggcaggtacagctataggtttcaaaataaattcaagagaaggcaactatctaatggatgtgatagggtatgttaagagcgcatcatattcagcagtgtacacaaaactatatacaactgggcctactataggaataaacaccaaacatgatgaaaaatgcacaggaccttgcccagctataatagatcataaagatggttggctaaccttctcaaaagaaaggaccagcacttggggttgtgaagagtttggttgcttagcagtcagtgatggttgtgtatttggctcttgccaagatataataaaagatgaattggctgtttataggaaaactactgaagaactcactacagtagaactgtgcttgacattttcagataaaacatattgcaccaacttgaatgctataactcctattataacagataaatttgaagtgcagttcaaaactgttgaatcttatacactaccaagagtcattgccataaagaatcatgagattaaggttggacaaatcaatgacttaggtgtctactcaaaaggatgtggaaatgttcaaaaggtcaatggaacaaactatggcaatggttcaccaaggtttgattatctttgccacttggcgagtagaaaagaagtaatcctaaggaaatgttttgacaatgattaccaggcttgcaaattcttgcagagtccttcaagttatcgtttagaagagcaccagggaacagtgacagttatagattataaaaagattctaggcactataaagatgaaggctatattaggggatgtgaaatacaaaaattatcaaaataatatagaaatcaatgctgagggaacatgtgctggatgtattgattgctttgaaaatatacactgtgaatttactatacatactacagttgaagcaagttgtcctataacaacagagtgtgtctccttccatgatagaatattgatcacaccagatgaacataagtatgcattgaagattgtatgtcatgataaaccaaaagtgtctcttaaatttaaaatctgtaacacaaatgttgatgcagctatgactattgtagattctaaaccaattttagaacttgcgccagtagatcaaacaacatacatcagagagaaagatgaaagatgcaagacctggatgtgtagagtccgagatgaagggttccaggtgatattagaaccttttaaaaacctctttggttcgtatattggaatattttatactggtatattgtctattatttgtttactcattgtcgtctatattatattgcccatttgtttcaaattgagggacaccttaaggcagcatgaagatgcctataaaaaggaaatgaagataagatga

SEQ ID NO: 4259 - RNA, 4335 nt, synthetic construct
  misc_feature 1..4335: note = derived and/or modified CDS sequence (wt) from JCV(3573-03)__HM007354.1__GP
  source 1..4335: mol_type = other RNA
atggaagttctaagcttaatctggttgctgacattgtgttcagctagtccagtattccaacggtgtttccaagatggggctatagtgaagcaaaacccgtcaaaggaagctgtaacagaagtttgcctaaaagatgatgtaagcatgataaagaccgaagcaaaatatgtgaagaacactacaggaacattcgctaacaacatagccatgagaaagtggcttgttgcagattggcatgattgtagacctcagaagtcatcgggtggtcacatcaatgttattgaagtcggtgatgatctatcactccatacagaatcatacatctgtagtgcagattgtgttatcacagttgataaggaaacagctcagatccgcttacaaactgacaatacaaatcattttgaagtcgctgggactacagtaaaatctgggtggtttaaaagtacaacatatataacactcgatcaaacttgtgaacacctcaaggtgtcatgtggacctaaatcgatacaattccatgcttgctttaaccaacatatgtcatgtgtacggtttttacacagaacaatactccctagttcaatagctaactctatatgccagaatatagagataataatcttagtcactctatcattaacaatcttcatattcttaacaatagtaagtaagacatatatatgttatttactgatgcccgtttttattccaatagcatttgtttatgggtggatatataataagtcttgtaagaaatgtaagttgtgcgggttagtttatcacccttttactgagtgtggaacacattgtgtctgtggtgcacggtatgaaacttctgataggatgaagttgcacagagcatcaggattatgcccaggatataaaagcttaagagcagctagggtgatgtgtaagtcaaaagggccagcatcgattttatctataatgacagcagttttgatattaacatttgtcacccctattagtgctatgatgattggggaatcaagcgaggtgtacactctagatgatttacccgatgatatggtacaaatggctgagagagtgaacatttactatcagataatcattataaattatggtgttacatgggctttcttgctacttggtctagttctagcatatttctttaagaaataccagcacaagttcctagacttttatgcaatgtattgtaatgaatgtgatatgtatcatgaaaaagccggtctaacacattggggtgattttacaaatagatgcagacaatgtacatgtgggcaatatgaagatgttactggattgatagtacacaaaaaatcgtacaattgcttagttaaatataaagcaaagtggataagagatattttaatcacatatttaattataatattggttaaagattcactgttgtttgttggtgcaacaggaactgactttgctgcatgtatagatgagaaaacagttacatggaactgtactggaccgtttctaaatttaggtagatgtgataaatctcaaaagaaaacaagttacaatgatatagctaaccaattaaaagggttaggcgtcatatcggtactagacatcccaatgataaaaagaatgccagacgagatatcaggatcactgaagtatattgataacttagaaacataccatgaacaattaactgcagaatatgctttcctcactagatactgtgattattacacgcagtatactgacaattcaggttatagtcaaacagtatggagaacttatttacggtctcatgattttggtgcatgtgttgtctatccaaatcagcacttctgtagatgtgtgaaatatggcgataagtgcaatagtgctaaatgggattttgcaaatgaaatgaagacattttatacaggtcaaaaaataaaatttaacaaagacttgaatttggcactattagtattgcataaagcatttagaggcactggaactgcatacatagcagaagctatggcccgaaaagacaatggatcgatggcacactttgccttagaagtgcgaaagaagtttccaacaaatgccctattggcagcattaatagattatatagtttacctacaatcacttgcagaaatatctacattcgaacttgatgaggactgggaagacttcaaatataaaccagaaccaactgagtcaccttctcaagctaggtcacatagaagtgatcagtacaacttcaaaaatgcagagagtaatagtaatgtcaaagtttgtaagaatattcagaaagtactatgtatttcacctagatcaagggctaaattcgagaatattatagcatgcggagaacatgcaaatccctctgtatatatgatgcccaatgttagcatttatcaatctaattcagaaaggagtcattattgtatagctgactctcattgtctagaagactacgaaatagtggaaacagagcttttaagtgcactaaagaagtctaagtgctgggccaaggagatggatgatattgttttgcacaagcaaagtgatggtctaagaagttgtaggatgaaagatactgggaactgtgatgttcaagaaaatgactggacaattgtcttatgtgaaaatggcaattattactattcagaaatccacaaggattatgataaagatcaagatgtgggacatttttgccttagtcccagatgcagtacaataagatatccgataaacaagagacatataaaaagatgtaattggcagatttcacactcgacaattgataaaatctcagttcaagaactagcagacatagaacagtataaaaaggctatttcacaaaagttacagacaagtttgtctatcttcaaatacgtgaagaccaaaaatttgccgcacattaaacctgcatacaagtatataactgtggaaggcattgagactgtagaaggcatagaaaatgctttcatagagtctgagatccctgcattagctggtacagctatcggcttcaaaataaactcaagagaaggtaattatttaatggatgtgataggatatgttaagagcgcatcatactctgctacatatacaaaattgtatacaactggtcctactattggaataaatactagacatgatgagaagtgcacaggaccctgtccagctgtgatagaccacaaagatggatggctaactttttcaaaagaaagaaccagtacatggggttgtgaagagtttggttgtttagcagttagtgatgggtgtgtctttgggtcctgtcaagacattataaaagatgagctagctgtttataggaagactactgaagaactcactacagtagaattgtgtctgacattttctgataaaacatactgcacaaacttaaatgctataactcccataataacagacaaattcgaagttcaatttaagacagttgaatcttacacattaccaagagtaattgctgtaaaaaatcatgagattaaagttgggcagattaatgacttaggcgtttactctaaagggtgtggaaatgtgcaaaaagtaaatggcaccaattatgggaatggaatgccaaaatttgactatctatgccatctagcaagtagaaaagaggtaattttgaggaaatgctttgacaacgattaccaagcttgcaaatttttacaaagcccttcaagttaccgtttagaagagcatcagggcacagtaacgatcatagattataaaaagattttgggcactattaagatgaaggctatactgggagatgttaaatacaaaaactaccagagtaatatagaaatcaatgctgaagggacatgtgctgggtgtataaattgctttgaaaatattcattgtgaatttactatacataccactgttgaagcgagctgtcctatagtgacagattgtgtttcattccatgatagaattctaataacaccagatgaacataaatatgcattgaaggtagtctgtcaagataaacccaaagtatctttaaaatttaagatttgtaacacgaacattgatgcatcaatgaccattgtagattctaagccgatcctagagcttgcaccagtagaccaaactgcatatatcaaagagaaagatgagagatgtaaaacctggatgtgtagagttcgagatgaaggatttcaagttatattagagccttttaaaaatttgttcggctcttatattggtatattttatacaggcatattatctgttatttgtctcctcatcgttatttatataatattacccatttgtttcaaattgagagacactttgcggcaacacgaagatgcgtataagaaggaaatgaaaataaggtaa

SEQ ID NO: 4260 - RNA, 4335 nt, synthetic construct
  misc_feature 1..4335: note = derived and/or modified CDS sequence (wt) from KEYV(KEYV/Ochlerotatus atlanticus/USA/KEYVLK01/2005)__KT630289.1__GP
  source 1..4335: mol_type = other RNA
atgatgatctggattctgctcactgttgtcactgtgacaattgcaaatccagtctaccaacgttgcttccaagatggtgctatagtgaagcaaaatccatcaaaggaggcagtcactgaagtatgtctgaaagatgatgtcagcatgatcaaaactgaggcaaaatatgtgaaaaatttgaccggaacattttcaaacaatgttgcaatgagaaaatggctagttgctgattggcatgattgtaggccacaaaaaagagctggcggacacataaatgttattgaagtaggcgatgacctgtctttacacacagagtcttatatatgcagtgcagattgcgtaattagtgttgataaagaaacagcacaaataaggttacagacagacaccactaatcattttgaagttgcaggaacaactgtaaaatcgggatggtttaagagcaccacatacataactttagaccagacatgtgagcacttgaaagtctcttgcggacctaaatctattcaattccatgcatgctttaatcagcatatgtcatgtgttagatttttacatcgtactatattaccaggatcgattgctaattctatttgtcaaaacatagaaataataatattggttactcttacattactaatattcatactcttgagtattttgagtaagacatacatatgttacatactaatgccaatattcataccgattgcttatatatatggttgggtttataacaagtcatgtaaaaaatgcaagttatgtggcttagtttaccatccattcacagaatgtgggacacactgtgtctgtggagcaagatatgagacttcagataggatgaagttgcatagagcttcaggattatgtcctggttataaaagcttaagagcagcaagagtaatgtgcaaatcaaaaggcccagcatcaatactatctattttgactgcagtgttaatactaacatttattacacctatgaatgctatggtgcttggctcatcagaagaggtgtataaattagaggatctacctgatgatatgttgaacatggcggagaagatagatatttactatttatctatcgtattgaattatagtactacatgggggctattaatcttgttgctaatagtgtcatgtctgttcaaaaagtatcaacatgtatttttgaattattatgccatgtattgccatgagtgcgatatgtatcatgaaaagaaaaatctagtatataatggggatttttcaaacaaatgtcgtcagtgtacatgcgggcaatatgaagacgctacaggtttgatagtccatcaaaaatcatataactgcttgattaagtataaggcaaaatggtttataaatatacttataatatataccatattagtactcctgaaagactctgtgttgatggctgctgctgaaggaccagatttcaatacatgtattgagcagagaagcatttcattaaattgtactgggccatttataaatttgggaggatgtgaaaaacctcaaaagagggcgagctatcaatcaatagctgaacagttaaaagcaatcaatgcaatatcaatacttgacatgcctatgatttcgaaaataccagatgatatatctggagctttaaggcatattgaaaatctcaaaacataccatgaacaactaacagcagaatttgcaatgttgacaagatactgtgattactacacccaattctctgacaattctggatatagccaaaccagctggagaacatatttacggtctcatgattttgaggtatgcattgcatatccaaatcaacatttttgtagatgtgtcaagaatggagaaaaatgcacaagtgctaactgggattttgctaatgagatgaagaattactatactggaaaacagattaggtttgacaaagatctaaatttagcacttactacattacataccgcatttagaggaacatccacgtattacatgtcagacatattagcagagacaaaagcgaactcattgagagactacgcattagcactcaagagtaagtaccctggaaatgccttgttgaaagctattctagatttcataatgtacttgcaatccctaaatgaggctacaaaattcaagcttagtagtgattgggaagactttaaatataattctgaactagaagcaagggcattaatgcctcgtgccaggagctctggtgattacaattttagtaatgcagaaagcacaaataaggtaaaaatttgcaagaacatacaacgtgtaatgtgtttatctccaagatccaaagctacagttgaggacattattgcatgcggtgaacatgagcatccatcagtgtatatggttccaaacactactatataccagtccaacattgagaggagccattactgtatagctgattcacattgcctagaagaatatgaactagttcagaatgaactattaactgcattaaagaaatccacatgctggactggagaattagaaaatgttataccacataaacaaagtgatgggatccggagctgcaggacgaagaacacagggagatgcaatgttaaaggtgaagattggactgtcatcttgtgtgaaaatgacaaatattactactcagaattaaataaagactatgataaggatcaagatataggtcatgtctgtttaagtcctagatgcaactcaattagatacccaataagcccaagacacatcactaattgcaagtgggaaaaccctgctggaacaatcagtagaatagagacccactcattagctgatatagagcaatataagaaagcaatatcacagaaattgcagaatagtttaacaatttttaaatatgaaaaaacaaagaacttaccacatataaaacctatttataaatatataaccatagaaggtacagaaactgttgaaggtgtggaaaatgcattcatagaggcagagattccagcattggctggtacttcaataggattcaaggtaaattcaagagatggtgatcatttgatggacataattgcatatattaaggttgcatcttattcatcaacatatacgaaattgtatacgacaggaccaaccattggtattaatacaaaacatgatgaaaagtgcacaggtaattgcccagcaagattagaacataaagtaggctggctcacctttgctaaagaaagaacaagcacatggggctgtgaggaatttggctgtctagctgtaagtgatggttgtgtctttggttcatgtcaagacatcataaaagaggaactatctgtttacagaaaagatacagaggaagtgtctaatgttgaattgtgtctaacatttgcagataaaacgtactgcacaagtttgaatgctattaccccaatcataacagaaaagtttgaagtgcagtttaaaactgttgagtcttattccttacctagaattgtaggaataagaaaccatgagattagaattggccaaataaatgatttgggcagctattctaaaggatgtggaaatgttcaaagggtgaatggcacaaattatggtagtggtcaaccaaagtttgactatttatgtcatcttgccagccgaaaagaagtgattgtcagaaagtgctttgacaatgattatcaagcatgcaaattcctgcagacaccatcaagctacagattagaagagcatgaaggaacagtaacaatcatagattacaaaaagatcctaggtactataaaaatgaaagcaattttaggtgatgtcagatacaaaaattatgcttcagccattgatataaatgctgaaggggtttgtgcaggatgtattaattgcttcgaaaacatacactgtgaatttacaatacatactacaattgaagcaagttgccctattgagagcgactgtgtatcttttcacgatagaatactagtcacaccaaatgagcacaaatatgctctaaaattaatatgtgaagacaagccaggaagtacactgaagttcaaaatatgcaacacaaagattgatgctgctatgacattggttgatgctaaaccaatcctagaattggcaccagtagaccagacagcatatatcagagaaaaagatgagaggtgcaagacttggatgtgtagggtgcgagatgagggcatcaaggttttactagaaccatttaagaatttatttggttcatatataggtattgtttatagtataatcctgattattattgcagcaataatcataatttatataatactgcctatctgcttcaaattaagggacactttaaagaagcatgaagatgcttatagaaaggagatgaaaattagatag

SEQ ID NO: 4261 - RNA, 4332 nt, synthetic construct
  misc_feature 1..4332: note = derived and/or modified CDS sequence (wt) from KEYV(KEYV/Ochlerotatus atlanticus/USA/KEYVLK01/2005)__KT630289.1__GP
  source 1..4332: mol_type = other RNA
atgatctggattctgctcactgttgtcactgtgacaattgcaaatccagtctaccaacgttgcttccaagatggtgctatagtgaagcaaaatccatcaaaggaggcagtcactgaagtatgtctgaaagatgatgtcagcatgatcaaaactgaggcaaaatatgtgaaaaatttgaccggaacattttcaaacaatgttgcaatgagaaaatggctagttgctgattggcatgattgtaggccacaaaaaagagctggcggacacataaatgttattgaagtaggcgatgacctgtctttacacacagagtcttatatatgcagtgcagattgcgtaattagtgttgataaagaaacagcacaaataaggttacagacagacaccactaatcattttgaagttgcaggaacaactgtaaaatcgggatggtttaagagcaccacatacataactttagaccagacatgtgagcacttgaaagtctcttgcggacctaaatctattcaattccatgcatgctttaatcagcatatgtcatgtgttagatttttacatcgtactatattaccaggatcgattgctaattctatttgtcaaaacatagaaataataatattggttactcttacattactaatattcatactcttgagtattttgagtaagacatacatatgttacatactaatgccaatattcataccgattgcttatatatatggttgggtttataacaagtcatgtaaaaaatgcaagttatgtggcttagtttaccatccattcacagaatgtgggacacactgtgtctgtggagcaagatatgagacttcagataggatgaagttgcatagagcttcaggattatgtcctggttataaaagcttaagagcagcaagagtaatgtgcaaatcaaaaggcccagcatcaatactatctattttgactgcagtgttaatactaacatttattacacctatgaatgctatggtgcttggctcatcagaagaggtgtataaattagaggatctacctgatgatatgttgaacatggcggagaagatagatatttactatttatctatcgtattgaattatagtactacatgggggctattaatcttgttgctaatagtgtcatgtctgttcaaaaagtatcaacatgtatttttgaattattatgccatgtattgccatgagtgcgatatgtatcatgaaaagaaaaatctagtatataatggggatttttcaaacaaatgtcgtcagtgtacatgcgggcaatatgaagacgctacaggtttgatagtccatcaaaaatcatataactgcttgattaagtataaggcaaaatggtttataaatatacttataatatataccatattagtactcctgaaagactctgtgttgatggctgctgctgaaggaccagatttcaatacatgtattgagcagagaagcatttcattaaattgtactgggccatttataaatttgggaggatgtgaaaaacctcaaaagagggcgagctatcaatcaatagctgaacagttaaaagcaatcaatgcaatatcaatacttgacatgcctatgatttcgaaaataccagatgatatatctggagctttaaggcatattgaaaatctcaaaacataccatgaacaactaacagcagaatttgcaatgttgacaagatactgtgattactacacccaattctctgacaattctggatatagccaaaccagctggagaacatatttacggtctcatgattttgaggtatgcattgcatatccaaatcaacatttttgtagatgtgtcaagaatggagaaaaatgcacaagtgctaactgggattttgctaatgagatgaagaattactatactggaaaacagattaggtttgacaaagatctaaatttagcacttactacattacataccgcatttagaggaacatccacgtattacatgtcagacatattagcagagacaaaagcgaactcattgagagactacgcattagcactcaagagtaagtaccctggaaatgccttgttgaaagctattctagatttcataatgtacttgcaatccctaaatgaggctacaaaattcaagcttagtagtgattgggaagactttaaatataattctgaactagaagcaagggcattaatgcctcgtgccaggagctctggtgattacaattttagtaatgcagaaagcacaaataaggtaaaaatttgcaagaacatacaacgtgtaatgtgtttatctccaagatccaaagctacagttgaggacattattgcatgcggtgaacatgagcatccatcagtgtatatggttccaaacactactatataccagtccaacattgagaggagccattactgtatagctgattcacattgcctagaagaatatgaactagttcagaatgaactattaactgcattaaagaaatccacatgctggactggagaattagaaaatgttataccacataaacaaagtgatgggatccggagctgcaggacgaagaacacagggagatgcaatgttaaaggtgaagattggactgtcatcttgtgtgaaaatgacaaatattactactcagaattaaataaagactatgataaggatcaagatataggtcatgtctgtttaagtcctagatgcaactcaattagatacccaataagcccaagacacatcactaattgcaagtgggaaaaccctgctggaacaatcagtagaatagagacccactcattagctgatatagagcaatataagaaagcaatatcacagaaattgcagaatagtttaacaatttttaaatatgaaaaaacaaagaacttaccacatataaaacctatttataaatatataaccatagaaggtacagaaactgttgaaggtgtggaaaatgcattcatagaggcagagattccagcattggctggtacttcaataggattcaaggtaaattcaagagatggtgatcatttgatggacataattgcatatattaaggttgcatcttattcatcaacatatacgaaattgtatacgacaggaccaaccattggtattaatacaaaacatgatgaaaagtgcacaggtaattgcccagcaagattagaacataaagtaggctggctcacctttgctaaagaaagaacaagcacatggggctgtgaggaatttggctgtctagctgtaagtgatggttgtgtctttggttcatgtcaagacatcataaaagaggaactatctgtttacagaaaagatacagaggaagtgtctaatgttgaattgtgtctaacatttgcagataaaacgtactgcacaagtttgaatgctattaccccaatcataacagaaaagtttgaagtgcagtttaaaactgttgagtcttattccttacctagaattgtaggaataagaaaccatgagattagaattggccaaataaatgatttgggcagctattctaaaggatgtggaaatgttcaaagggtgaatggcacaaattatggtagtggtcaaccaaagtttgactatttatgtcatcttgccagccgaaaagaagtgattgtcagaaagtgctttgacaatgattatcaagcatgcaaattcctgcagacaccatcaagctacagattagaagagcatgaaggaacagtaacaatcatagattacaaaaagatcctaggtactataaaaatgaaagcaattttaggtgatgtcagatacaaaaattatgcttcagccattgatataaatgctgaaggggtttgtgcaggatgtattaattgcttcgaaaacatacactgtgaatttacaatacatactacaattgaagcaagttgccctattgagagcgactgtgtatcttttcacgatagaatactagtcacaccaaatgagcacaaatatgctctaaaattaatatgtgaagacaagccaggaagtacactgaagttcaaaatatgcaacacaaagattgatgctgctatgacattggttgatgctaaaccaatcctagaattggcaccagtagaccagacagcatatatcagagaaaaagatgagaggtgcaagacttggatgtgtagggtgcgagatgagggcatcaaggttttactagaaccatttaagaatttatttggttcatatataggtattgtttatagtataatcctgattattattgcagcaataatcataatttatataatactgcctatctgcttcaaattaagggacactttaaagaagcatgaagatgcttatagaaaggagatgaaaattagatag

SEQ ID NO: 4262 - RNA, 4332 nt, synthetic construct
  misc_feature 1..4332: note = derived and/or modified CDS sequence (wt) from KEYV(KEYV/Ochlerotatus atlanticus/USA/KEYVLK02/2005)__KT630292.1__GP
  source 1..4332: mol_type = other RNA
atgatctggattctgctcactgttgtcactgcgacaattgcaaatccagtttaccaacgttgcttccaagatggcgctatagtgaagcaaaatccatcaaaggaggcagtcactgaagtatgtctgaaagatgatgtcagcatgatcaaaactgaggcaaaatatgtgaaaaatttaaccggaacattttcaaacaatgttgcaatgagaaaatggctagttgctgattggcatgattgtaggccacaaaagagagctggcggacacataaatgttatcgaagtaggcgacgatctgtctttacacacagagtcttatatatgcagtgcagattgcgtaattagtgttgataaagaaacagcacaaataaggttacagacggacaccactaatcattttgaagttgcaggaacaactgtaaaatcgggatggtttaagagcactacatacataactttagaccagacttgtgagcacttgaaagtctcttgcggacctaaatctattcaattccatgcatgctttaatcaacatatgtcatgtgttagatttttacatcgtactatattaccaggatcaattgctaattctatttgtcaaaacatagaaataataatattggttactcttacattactaatattcatactcttgagtattctgagtaagacatacatatgttacatactaatgccaatattcataccgattgcttatatctatggttgggtttataacaagtcatgtaaaaaatgcaagttatgtggcctagtttaccatccattcacagaatgtgggacacactgtgtctgtggagcaagatatgagacttcagataggatgaagttgcatagagcttcaggattatgtcctggttataaaagcttaagagcagcaagagtaatgtgcaaatcaaaaggcccagcatcaatactatctattttgactgcagtgttaatactaacatttattacacctatgaatgctatggtgcttggctcatcagaagaggtgtataaattagaggatctacctgatgatatgttgaacatggcagagaagatagatatatactatttatctatcgtattgaattatagtactacatgggggctattaatcttattgctaatagtgtcgtgtctgttcaaaaagtatcaacatgtatttctgaattattatgccatgtattgccatgagtgtgatatgtatcatgaaaagaaaaatctagtatataatggggatttttcaaacaaatgtcggcagtgtacatgcgggcaatatgaagacgctacaggtttgatagtccaccaaaaatcatataactgcttgattaagtataaggcaaaatggtttataaatatacttataatatataccatattagtactcctgaaagactctgtattgatggctgctgctgaaggaccagatttcaatacatgtattgagcagaggagcatttcattgaattgtactgggccatttataaatttgggaggatgtgaaaaacctcaaaagagggcgagctatcaatcaatagctgaacagttaaaagcaatcaatgcaatatcaatacttgacatgcctatgatttcaaaaataccagatgatatatctggagctttaaggcatattgaaaatctcaaaacataccatgaacaactaacagcagaatttgcaatgttgacaagatactgtgattactacacccaattctctgacaattccggatatagccaaaccagctggagaacatatttacggtctcatgattttgaggtatgcattgcatatccaaatcaacatttttgtagatgtgtcaagaatggagaaaaatgcacaagtgctaactgggattttgctaatgagatgaagaattactatactggaaaacagattaggtttgacaaagatctaaatttagcactcactacactacataccgcatttagaggaacatccacatattacatgtcagacatattagcagaaacaaaagcgaactcattgagagactacgcattagcactcaagagtaagtaccctggaaatgccttgttgaaagctattctagatttcataatgtacttgcaatccctaaatgaggctacaaaattcaagcttagtagtgattgggaagactttaaatataattctgaaccagaagcaagggcattaatgcctcgtgccaggagctctggtgattacaattttagtaatgcagaaagcacaaataaggcaaaagtttgcaagaacatacaacgtgtaatgtgcttatctccaagatccaaagccacagttgaggacattattgcatgcggtgaacatgagcatccatcagtgtatatggttccaaacactactgtataccagtccaacattgagaggagtcattactgtatagctgactcacattgcctagaagaatatgagctagttcagaatgaactattaactgcattaaagaaatccacatgctggactggagaattagaaaatgttataccacataaacaaagtgatgggacccggagctgcaggacgaagaacacagggagatgcaatgttaaaggtgaagattggactgttatcttgtgtgaaaatgacaaatattactactcagaattaaataaagactatgataaggaccaagatataggtcatgtctgtttaagccctagatgcaactcaattagatacccaataagcccaagacacatcactaattgcaagtgggaaaaccctgctggaacaatcagtagaatagagacccactcattagctgatatagagcaatataagaaagcaatatcacagaaattgcagaatagtttaacaatttttaaatatgaaaaaacaaagaatttaccacatataaaacctatttataaatatataaccatagaaggtacagaaactgtcgaaggtgtggaaaatgcattcatagaggcagagattccagcattggctggtacttcaataggattcaaggtaaattcaagagatggtgatcatctgatggacataattgcatatatcaaggttgcatcttattcatcaacatatacgaaattgtatacgacaggaccgaccattggtattaatacaaaacatgatgaaaagtgcacaggtaattgcccagcaagattagaacataaagtaggctggctcacctttgctaaagaaagaacaagcacatggggctgtgaggaatttggctgtctagctgtaagtgatggttgtgtctttggttcatgtcaagacatcataaaagaggaactatctgtttacaggaaagatacagaagaagtgactaatgttgaattgtgtctgacatttgcagataagacgtactgcacaagtttaaatgctattaccccaatcataacagaaaagtttgaagtgcagtttaaaactgttgagtcctattccttacctagaattgtaggaataagaaaccatgagattagaattggccaaataaatgatttgggcagttattctaaaggatgtggaaatgttcaaagggtgaatgatacaaattatggtagtggtcaaccaaagtttgactatttatgtcatcttgccagccgaaaagaagtgattgtcaggaagtgctttgacaatgattatcaagcatgcaaatttctgcagacaccatcaagctacagattagaagagcatgaaggaacagtaacaatcatagattacaaaaagatcctaggtactataaaaatgaaagcaattttaggtgatgtcagatacaagaattatgcttcagccattgatataaatgctgaaggggtttgtgcaggatgtattaattgcttcgaaaacatacactgtgaatttacaatacataccacaattgaagcaagttgccctattgagagcgactgtgtatcttttcacgatagaatgctagtcacaccaaatgagcacaaatatgctctaaaactaatatgtgaagacaagccaggaagtacactgaagttcaaaatatgcaacacaaagattgatgctgctatgacattggttgatgctaaaccaatcctagaattggcaccagtagaccagacagcatatatcagagaaaaagatgagaggtgcaagacttggatgtgtagggtgcgagatgagggcatcaaagttttactagaaccatttaagaatttatttggttcatatataggtattgtttatagtataatcctaattattattgcagcaataatcataatttatgtaatactgcctatctgctttaaattaagggacactttaaagaagcatgaagatgcttatagaaaggaaatgaaaattagatag

SEQ ID NO: 4263 - RNA, 4332 nt, synthetic construct
  misc_feature 1..4332: note = derived and/or modified CDS sequence (wt) from KEYV(C14031-33)__AF123489.1__GP
  source 1..4332: mol_type = other RNA
atgatctggattctgctcactgttgtcactgtgacaattgcaaatccagtctaccaacgttgcttccaagatggtgctatagtgaagcaaaatccatcaaaggaggcagttactgaagtatgtctgaaagatgatgtcagcatgatcaaaactgaggcaaaatatgtgaaaaatttgaccggaacattttcaaacaatgttgcaatgagaaaatggctagttgctgattggcatgattgtaggccacaaaaaagagctggcggacacataaatgttattgaagtaggcgatgacctgtctttacacacagagtcttatatatgcagtgcagattgcgtaattagtgttgataaagaaacagcacaaataaggttacagacagacaccactaatcattttgaagttgcaggaacaactgtaaaatcgggatggtttaagagcactacatacataactttagaccagacttgtgagcgcctgaaagtctcttgcggacctaaatctattcaattccatgcatgctttaatcaacatatgtcatgtgttagatttttacatcgtactatattactaggatcgattgctaattctatttgtcaaaacatagaaataataatattggttactcttacattactaatattcatactcttgagtattttgagtaagacatacatatgttacatactaatgccaatatccataccgattgcttatatatatggttgggtttataacaagtcatgtaaaaaatgcaagttatgtggcttagtttaccatccattcacagaatgtgggacacactgtgtctgtggagcaagatatgagacttcagataggatgaagttgcatagagcttcaggattatgtcctggttataaaagcttaagagcagcaagagtaatgtgcaaatcaaaaggcccagcatcaatactatctattttgactgcagtgttaatactaacatttattacacctatgaatgctatggtgcttggctcatcagaagaggtgtataaattagaggatctacctgatgatatgctgaacatggcggagaagatagatatttactatttatctatcgtattgaattatagtactacatgggggctattaatcttgttgttaatagtgtcttgtctgttcaaaaagtatcatcttgtatttttgaattattatgccttgtattgccatgagtgcgatatgtaccatgaaaagaaaaatctagtatataatggggatttttcaaacaaatgtctgcagtgtacatgcgggcaatatgaagatgctacaggtttgatagtccatcaaaaatcatataactgcttgattaactataaggcaaaatggtttataaatatacttataatatataccatattagtactcctgaaagactctgtgttgatggctgctgctgaaagaccagatttcaatacatgtattgagcagagaagcatttcattaaattgtactgggccatttataaatttgggaggatgtaaaaaacctcaaaagagggcgagctatcaatcaatagctgaacagttaaaagcaatcaatgcaatatcaatacttgacatgcctatgatttcaaaaataccagatgatatatccggagctttaagacatattgaaaatctcaaaacataccatgaacaactaacagcagaatttgcaatgttgacaagatactgtgattactacacccaattctctgacaattccggatatagccaaaccagctggagaacatatttacggtctcatgattttgaggtatgcatcgcatatccaaatcaacatttttgtagatgtgtcaagaatggagaaaaatgcacaagtgctaactgggattttgctaatgagatgaagaattactatactggaaaacagattagatttgacaaagatctaaatttagcacttactacactacataccgcatttagaggaacatccacatattacatgtcagacatattagcagagacaaaagcgaactcattgagagactacgcattagcactcaagagtaagtaccctggaaatgccttgttgaaagctattctagatttcataatgtacttgcaacccctaaatgaggctacaaaattcaagcttagtagtgattgggaagactttaaatataattctgaaccagaagcaagggcattaatgcctcgtgccaggagctctggtgattacaattttagcaatgcagaaagcacaaataaggtaaaagtttgcaagaacatacaacgtgtaatgtgcttatctccaagatccaaagctacagttgaggacattattgcatgcggtgaacatgagcatccatcagtgtatatggttccaaacactactatataccagtccaacattgagaggagccattactgtatagctgactcacattgcctagaagaatatgagctagttcagaatgaactattaactgcattaaagaaatccacatgctggactggagagttagaaaatgttataccacataaacaaagtgatgggatccggagctgcaggacgaagaacacagggagatgcaatgttaaaggtgaagattggactgtcatcttgtgtgaaaatgataaatattactactcagaattaaataaagactatgataaggatcaagatataggtcatgtctgtttaagccctagatgcaactcaattagatacccaataagcccaagacacatcactaattgcaagtgggaaaaccctgctggaacaatcagtagaatagagacccattcattagctgatatagagcaatataagaaagcaatatcacagaaattgcagaatagtttaacaatttttaaatatgaaaaaacaaagaacttaccacatataaaacctatttataaatatataaccatagaaggtacagaaactgttgaaggtgtggaaaatgcattcatagaggcagagattccagcattggctggcacttcaataggattcaaggtaaattcaagagatggtgatcatctgatggacataattgcatatattaaggttgcatcttattcatcaacatatacgaaattgtatacgacaggaccaaccattggtattaatacaaaacatgatgaaaagtgcacaggtaattgcccagcaagattagaacataaagtaggctggctcacctttgctaaagaaagaacaagcacatggggctgtgaggaatttggctgtctagctgtaagtgatggttgtgtctttggttcatgtcaagacatcataaaagaggaactatctgtttacaggaaagatacagaagaagtgactaatgttgaattgtgtctaacatttgcagataaaacgtactgcacaagtttaaatgctattaccccaatcataacagaaaagtttgaagtgcagtttaaaactgttgaatcttattccttacctagaattgtaggaataagaaaccatgagattagaattggccaaataaatgatttgggcagctattctaaaggatgtggaaatgttcaaagggtgaatggcacaaattatggtagtggtcaaccaaagtttgactatttatgtcatcttgccagccgaaaagaagtgattgtcagaaagtgctttgacaatgattatcaagcatgcaaattcctgcagacaccatcaagctacagattagaagagcatgaaggaacagtaacaatcatagattacaaaaagatcctaggtactataaaaatgaaagcaattttaggtgatgtcagatacaagaattatgcttcagccattgatataaatgctgaaggggtttgtgcaggatgtattaattgcttcgaaaatatacactgtgaatttacaatacatactacaattgaagcaagttgccctattgagagcgactgtgtatcttttcacgatagaatgctagtcacaccaaatgagcacaaatatgctctaaaactaatatgtgaagacaagccaggaagtgcactgaagttcaaaatatgcaacacaaagattgatgctgctatgacattggttgatgctaaaccaatcctagaattggcgccagtagaccagacagcatatatcagagaaaaagatgagaggtgcaagacttggatgtgtagggtgcgagatgagggcatcaaggttttactagaaccatttaagaatttatttggttcatatataggtattgtttatagtataatcctaattattattgcagcaataattataatttatataatactgcctatctgcttcaaattaagggacaccttaaagaagcatgaagatgcttatagaaaggagatgaaaattagatag

SEQ ID NO: 4264 - RNA, 4326 nt, synthetic construct
  misc_feature 1..4326: note = derived and/or modified CDS sequence (wt) from LACV(Human/78)__NC_004109.1__GP
  source 1..4326: mol_type = other RNA
atgatttgtatattggtgctaattacagttgcagctgcaagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagagtcatgtgcaagtcgaaagggcctgcatcaatattgtctataattactgcggtactggtcttaacctttgtgacaccaatcaactccatggttttaggagagagtaaagaaacctttgaacttgaagatcttccagacgacatgttggaaatggcatcgagaataaattcttattatctcacctgtatcttgaattatgctgtaagctggggtcttgttatcattggattgttgatcgggctgctttttaagaaataccagcacagattcttaaatgtttacgcaatgtactgtgaagaatgtgacatgtatcatgacaagtctgggttgaaaagacatggtgatttcaccaacaaatgcagacagtgcacatgtggtcaatatgaagatgctgcaggtttgatggctcacaggaaaacctataactgcttagtgcagtacaaagcaaagtggatgatgaacttcctgataatttacatattcttaattttgatcaaagattctgctatagttgtacaagctgctggaactgacttcaccacctgcctagagactgagagtataaattggaactgcactgggccatttttgaacctcgggaattgccaaaagcaacaaaagaaagaaccttacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgaattctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatag

SEQ ID NO: 4265 - RNA, 4326 nt, synthetic construct
  misc_feature 1..4326: note = derived and/or modified CDS sequence (wt) from LACV__KP271111.1__GP
  source 1..4326: mol_type = other RNA
atgattcgcatactggtactgattgcagttacagctgcaagcccagtgtatcaaaggtgtttccaagatggggctatagtgaagcaaaacccatccaaagaagcagttacagaggtgtgcctgaaagatgatgttagcatgatcaaaacagaggccaggtacgtaagaaatgcaacaggagttttttcaaacaatgttgcaataaggaaatggctagtctctgactggcatgattgcagacctaagaagatcattgggggacacatcaatgtaatagaagttggtgatgacctgtcactccatactgaatcatatgtttgtagcgcagattgtagcataggtgttgacaaagagactgcacaggtcaggcttcagacagataccacaaatcactttgaaattgcaggcactactgtgaagtcagggtggtttaaaagcacgacgtatataactcttgatcaaacctgcgaacaccttaaagtttcctgcggcccaaaatctgtacagttccatgcctgcttcaatcagcacatgtcttgcgtcagatttttacacaggacaatattgcctggctctatagccaattctatatgtcagaatattgaaatcataattttagttacacttactctattaatctttatattgttaagcattttaagtaagacttatatatgttatttattaatgcctatatttatccctatagcatacatgtacggtataatttacaataagtcgtgcaaaaaatgcaaactatgcggcctagtgtatcatccattcacagagtgtggcacacattgcgtctgtggtgctcgctatgatacttcagatagaatgaaactgcacagagcttctggattgtgccctggttataaaagcctaagagctgccagagttatgtgcaagtcgaaagggcctgcatcaatattgtctataattactgcagtactggtcttaacctttgtgacaccaatcaattctatggttttaggggagagtaaagaaacttttgaacttgaagagcttccagacgatatgttggaaatggcatcaagaataaattcttattatttcacctgtatcttaaattatgctgtaagctggggtcttgttatcattggattgttgaccgggctgctatttaagaaatatcagcacagatttttaaatgtttacgcaatgtactgtgaggagtgtgacatgtaccatgacaagtctgggttgaaaagacatggtgatttcactaacaaatgcaggcagtgcacatgtggtcagtatgaagatgctgcaggtttgatggcccacaggaaaacctataactgcttagtgcagtacaaagcaaaatggatgatgaatttcctgataatttatatattcttaattttaatcaaagattctgctatagttgtacaagctgctggaactgatttcaccacttgcctagagactgagagtataaattggaactgcacagggccattcttgaacctcgggaattgtcaaaagcaacaaaagaaagaaccttacaccaacattgcaacccagttaaagggactaaaggcaatttccgtactagatatccctataataacagggataccagatgatatcgcaggtgctttaagatatatagaagagagggaagacttccatgtccagctaactatagaatatgcaatgctgagtaaatactgtgactattatacccaattctcagacaactcaggatacagtcaaacaacatggagagtgtacttaaggtctcatgattttgaggcatgtatactatatccaaatcagcatttttgcagatgtgtgaaaaatggtgagaagtgcagcagctccaattgggactttgccaacgaaatgaaagattattactcagggaaacaaacaaagtttgataaagacttaaatctagccctaacagctttgcatcatgctttcagggggacttcatctgcatatatagcaacaatgctctcaaaaaaatccaacgatgacttgattgcatacacaaataagataaaagcaaaattcccaggtaatgcattgttgaaggctataatagattatatagcatatatgaaaagtctgccaggtatggcaaatttcaaatatgatgaattctgggatgagttattgtacaaacccaacccagcaaaggcttcaaaccttgctagaggaaaggagtcttcttacaacttcaaactagcaatttcatcaaaatctataaaaacctgcaagaatgttaaggatgttgcctgcttatcgccaaggtcaggtgctatatatgcttcaataattgcatgtggtgaacccaatggaccaagtgtgtatagaaaaccatcaggtggtgtattccaatctagcactgatcggtctatatactgcttactagatagccattgtctagaagaatttgaggctattaaccaggaggaactggatgcagtaaaaaaatcaaaatgttgggaaattgaatattctgatgtgaagcccctccaagaaggtgatggaactaaaagctgtagaatgaaagattctgggaactgcaatgttgcaactaacagatggccagtgatacaatgcgagaatgacaaattttactactcagagcttcaaaaagattatgacaaaactcaagatattggtcattattgcttaagtcctggatgtactactgttcggtaccctattaatccaaagcatatctctaactgtaattggcaggtgagcagatccagcatagcgaagatagatgtgcacaatattgaagatattgaacagtataagaaggctataactcagaaacttcaaacaagcttatctctattcaagtatgcaaaaacaaagaatttgccgcacatcaagccaatttacaaatatataactatagagggaacagaaactgcagaaggtatagagagtgcatacatcgaatcagaggtacctgcattggctgggacatctatcggattcaaaatcaattctaaagagggcaagcacttgctagatgttatagcatatgtaaaaagcgcctcatactcttcagtgtatgcaaaattgtactcaactggcccaacatcagggataaatactaaacatgatgaattgtgtactggcccatgcccggcaaatatcaatcatcaggttgggtggctaacatttgcaaaagagaggacaagctcatggggatgcgaagagtttggttgcctggctgtaagtgatgggtgtgtattcgggtcatgccaagatataataaaagaagaactatctgtctataggaaggagaccgaagaagtgactgatgtagaactatgtttaacattttcagacaaaacatactgtacaaacttaaaccctgttacccctattataacagacctatttgaggtacagttcaagactgtagagacttacagcttgcccagaattgttgctgtgcaaaatcatgagattaagattgggcaaataaatgatctaggagtttactctaagggttgtggaaatgtccaaaagatcaacggaactgtttatggcaatggagttcccagatttgactatctatgccatttagctagcagaaaggaagtcattgttagaaaatgcttcgacaatgattaccaagcatgcaaatttcttcagagccctgctagttacagacttgaagaagacagtggcactgtgactataattgattacaaaaagatattaggcacaatcaagatgaaggcaattctaggagatgtcaaatataaaacatttgctgatagtgtcgatataactgcagaagggtcatgcactggctgtatcaactgcttcgagaatatccattgcgaattaacgttgcatactacaattgaagccagctgcccaattaaaagctcatgcacagtattccatgataggattcttgtgactccaaatgaacacaaatatgcattaaaaatggtgtgcacagaaaagccggggaacacactcacaattaaagtttgcaatactaagattgaagcatctatggcccttgtcgatgcaaagcctatcatagaactagcaccagttgatcagacagcatatataagagaaaaagatgaaaggtgtaaaacttggatgtgtagggtaagagatgaaggactgcaggtcatcttggagccatttaaaaatttgtttgggtcttatattgggatattttacacatttattatatctatagtggcattattggttattgtctatgtgctattgcctatatgctttaagttaagagatacccttagaaagcacgaagatgcatataagagagagatgaaaattagatag

SEQ ID NO: 4266 - RNA, 4326 nt, synthetic construct
  misc_feature 1..4326: note = derived and/or modified CDS sequence (wt) from LACV__M87664.1__GP
  source 1..4326: mol_type = other RNA
atgatttgtatattggtgctaattacagttgcgactgcaagcccagtgttacaaaggtgtttccaagatggggctatagtgaagcaaaacccatccaaagaggcattcacagaggtgtgcctgaaagatgatgttagcatgatcaaaacagaggccaggtatgtaagaaatgcaacaggagttttttcaaataatgtcgcaataaggaaatggctagtctctgcttggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcagaagcacgacatatataactcttgatcaaacttgcgaacaccttaaagtttcctgcggcccaaaatctgtacagttccatgcctgcttcaatcagcatatgtcttgcgtcagatttttacacaggacaatattgcctcgttctatagccaattccatatgtcagaatatcgaaatcataattttagttacacttactctattaatctttatattgttaagcattttaagtaagacttatatatgttatttattaatgcctatattcatccccatagcatatatatacggtacaatttacaataagtcgtgcaaaaaatgcaaattatgtggcttagcgcatcacccattcacagagtgtggcacacattgtgtctgtggtgcccgctatgatacttcagatagaatgaaactgcatagagcttctggattgtgccctggttataaaagcctaagagctgccagagtcatgtgcaagtcgaaagggcctgcatcaatattgtctataattactgcggtactggtcctaacctttgtgacaccaatcaactccatggttttaggagagagtaaagaaacctttgaacttgaagatcttccagacgacatgttggaaatggcatcgagaataaattcttattatcctacctgtatcttgaattatgctgtaagctggggtcttgttatcattggattgttgatcgggctgctttttaagaaataccagcacagattcttaaatgtttacgcaatgtactgtgaagaatgtgacatgtatcatgacaagtctggggtgaaaagacatggtgatttcaccaacaaatgcagacaatgcacatgtggtcaatatgaagatgctgcaggtttgatggctcataggaaaacctataactgcttagtgcagtacaaagcaaagtggatgatgaacttcttgataatttacatattcttaattttgatcaaagattctgctatagttgtacaagctgctggaactgacttcaccacctgcctagagactgagagtataaattggaactgcactgggccatttttgaacctcgggaattgccaaaagcaacaaaagaaagaaccttacaccaacattgcaactcagttaaagggactaaaagcaatttccgtactagatatccctataataacagggataccagatgatattgcgggtgctttaagatatatagaagagaaggaagatttccatgtccagctaactatagaatatgcgatgttaagtaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaatcgggactttgccaatgaaatgaaagattattactctgggaaacaaacaaagtttgacaaggatttaaatctagccctaacagctttgcattcccaggtaatgcattgttcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgacgagttctgggatgaattattgtacaaacctaacccagcaaaagcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatccagtactgaccggtctatatactgcttgctggatagccattgtctagaagaatttgaggccatcagtcaagaggagctggatgcagtaaagaaatccaaatgttgggaaattgaatatcctgacgtaaagctcatccaagaaggcgatgggactaaaagctgtagaatgaaagattctgggaactgcaatgttgcaactaacagatggccagtgacacaatgtgagaatgacaaattttactactcagaccttcaaaaagattatgacaaaactcaagatattggtcactattgcttaagccctggatgtactactgtccggtaccctattaatccaaagcacatctctaactgtaattggcaagtaagcagatctagcatagcagagatagatgtgcacaatattgaggatattgagcaatataagaaagctataactcagaaacttcaaacaagcctatctctattcaagtatgcaaaaacaaaaaacttgccgcacatcaaaccaatttataaatatataactatgaagggaacagaaactgcagaagggatagagagtgcatatattgagtcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgacgaattgtgtactggcccatgcccagcaaatatcaatcatcaggttgggtggctgacatttgcaagagagaggacaagctcatggggatgcgaagagtttggttgcctggctgtaagtgatgggtgcgtatttgggtcatgccaagatataataaaagaagaactatctgtctataggaaggagaccgaggaggtgaccaatgttgagctatgtttaacattttcagacaagacatattgcacaaacttaaaccctgttacccctattataacagatctatttgaggtacagttcaaaactgtagagacctacagcttgcccagaattgttgctgtgcaaaaccatgagattaagattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaattccttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtaaccccaaatgaacacaaatatgcattgaaaatggtgtgcacagaaaagccagggaacacactcacaattaaagtctgcaatactaaaattgaagcatctatggcccttgtcgatgcaaagcctatcatagaactagcaccagttgatcagacagcatatataagagaaaaagatgaaaggtgtaaaacttggatgtgtagggtaagagatgaagggctgcaggtcatcttggagccatttaaaaatttatttggatcttatattgggatattttacacatttattatatctatagtagcattattggttattatctatgtactactacctatatgctttaagttaagggatacccttagaaagcatgaagatgcatataagagagagatgaaaattagatag

SEQ ID NO: 4267 - RNA, 4326 nt, synthetic construct
  misc_feature 1..4326: note = derived and/or modified CDS sequence (wt) from LACV__KP271105.1__GP
  source 1..4326: mol_type = other RNA
atgattcgcatactggtactgattgcagttacagctgcaagcccagtgtatcaaaggtgtttccaagatggggctatagtgaagcaaaacccatccaaagaagcagttacagaggtgtgcctgaaagatgatgttagcatgatcaaaacagaggccaggtacgtaagaaatgcaacaggagttttttcaaacaatgttgcaataaggaaatggctagtctctgactggcatgattgcagacctaagaagatcattgggggacacatcaatgtaatagaagttggtgatgacctgtcactccatactgaatcatatgtttgtagcgcagattgtagcataggtgttgacaaagagactgcacaggtcaggcttcagacagataccacaaatcactttgaaattgcaggcactactgtgaagtcagggtggtttaaaagcacgacgtatataactcttgatcaaacctgcgaacaccttaaagtttcctgcggcccaaaatctgtacagttccatgcctgcttcaatcagcacatgtcttgcgtcagatttttacacaggacaatattgcctggctctatagccaattctatatgtcagaatattgaaatcataattttagttacacttactctattaatctttatattgttaagcattttaagtaagacttatatatgttatttattaatgcctatatttatccctatagcatacatgtatggtataatttacaataagtcgtgcaaaaaatgcaaactatgcggcctagtgtatcatccattcacagagtgtggcacacattgcgtctgtggtgctcgctatgatacttcagatagaatgaaactgcacagagcttctggattgtgccctggttataaaagcctaagagctgccagagttatgtgcaagtcgaaagggcctgcatcaatattgtctataattactgcagtactggtcttaacctttgtgacaccaatcaattctatggttttaggggagagtaaagaaacttttgaacttgaagagcttccagacgatatgttggaaatggcatcaagaataaattcttattatttcacctgtatcttaaattatgctgtaagctggggtcttgttatcattggattgttgaccgggctgctatttaagaaatatcagcacagatttttaaatgtttacgcaatgtactgtgaggaatgtgacatgtaccatgacaagtctgggttgaaaagacatggtgatttcactaacaaatgcaggcagtgcacatgtggtcagtatgaagatgctgcaggtttgatggcccacaggaaaacctataactgcttagtgcagtacaaagcaaaatggatgatgaatttcctgataatttatatattcttaattttaatcaaagattctgctatagttgtacaagctgctggaactgatttcaccacttgcctagagactgagagtataaattggaactgcacagggccattcttgaacctcgggaattgtcaaaagcaacaaaagaaagaaccttacaccaacattgcaacccagttaaagggactaaaggcaatttccgtactagatatccctataataacagggataccagatgatatcgcaggtgctttaagatatatagaagagagggaagacttccatgtccagctaactatagaatatgcaatgctgagtaaatactgtgactattatacccaattctcagacaactcaggatacagtcaaacaacatggagagtgtacttaaggtctcatgattttgaggcatgtatactatatccaaatcagcatttttgcagatgtgtgaaaaatggtgagaagtgcagcagctccaattgggactttgccaacgaaatgaaagattattactcagggaaacaaacaaagtttgataaagacttaaatctagccctaacagctttgcatcatgctttcagggggacttcatctgcatatatagcaacaatgctctcaaaaaaatccaacgatgacttgattgcatacacaaataagataaaagcaaaattcccaggtaatgcattgttgaaggctataatagattatatagcatatatgaaaagtctgccaggtatggcaaatttcaaatatgatgaattctgggatgagttattgtacaaacccaacccagcaaaggcttcaaaccttgctagaggaaaggagtcttcttacaacttcaaactagcaatttcatcaaaatctataaaaacctgcaagaatgttaaggatgttgcctgcttatcgccaaggtcaggtgctatatatgcttcaataattgcatgtggtgaacccagtggaccaagtgtgtatagaaaaccatcaggtggtgtattccaatctagcactgatcggtctatatactgcttactagatagccattgtctagaagaatttgaggctattaaccaggaggaactggatgcagtaaaaaaatcaaaatgttgggaaattgaatattctgatgtgaagcccctccaagaaggtgatggaactaaaagctgtaaaatgaaagattctgggaactgcaatgttgcaactaacagatggccagtgatacaatgcgagaatgacaaattttactactcagagcttcaaaaagattatgacaaaactcaagatattggtcattattgcttaagtcctggatgtactactgttcggtaccctattaatccaaagcatatctctaactgtaattggcaggtgagcagatccagcatagcgaagatagatgtgcacaatattgaagatattgaacagtataagaaggctataactcagaaacttcaaacaagcttatctctattcaagtatgcaaaaacaaagaatttgccgcacatcaagccaatttacaaatatataactatagagggaacagaaactgcagaaggtatagagagtgcatacatcgaatcagaggtacctgcattggctgggacatctatcggattcaaaatcaattctaaagagggcaagcacttgctagatgttatagcatatgtaaaaagcgcctcatactcttcagtgtatgcaaaattgtactcaactggcccaacatcagggataaatactaaacatgatgaattgtgtactggcccatgcccggcaaatatcaatcatcaggttgggtggctaacatttgcaaaagagaggacaagctcatggggatgcgaagagtttggttgcctggctgtaagtgatgggtgtgtattcgggtcatgccaagatataataaaagaagaactatctgtctataggaaggagaccgaagaagtgactgatgtagaactatgtttaacattttcagacaaaacatactgtacaaacttaaaccctgttacccctattataacagacctatttgaggtacagttcaagactgtagagacttacagcttgcccagaattgttgctgtgcaaaatcatgagattaagattgggcaaataaatgatctaggagtttactctaagggttgtggaaatgtccaaaaggtcaacggaactgtttatggcaatggagttcccagatttgactatctatgccatttagctagcagaaaggaagtcattgttagaaaatgcttcgacaatgattaccaagcatgcaaatttcttcagagccctgctagttacagacttgaagaagacagtggcactgtgactataattgattacaaaaagatattaggcacaatcaagatgaaggcaattctaggagatgtcaaatataaaacatttgctgatagtgtcgatataactgcagaagggtcatgcactggctgtatcaactgcttcgagaatatccattgcgaattaacgttgcatactacaattgaagccagctgcccaattaaaagctcatgcacagtattccatgataggattcttgtgactccaaatgaacacaaatatgcattaaaaatggtgtgcacagaaaagccggggaacacactcacaattaaagtttgcaatactaagattgaagcatctatggcccttgtcgatgcaaagcctatcatagaactagcaccagttgatcagacagcatatataagagaaaaagatgaaaggtgtaaaacttggatgtgtagggtaagagatgaaggactgcaggtcatcttggagccatttaaaaatttgtttgggtcttatattgggatattttacacatttattatatctatagtggcattattggttattgtctatgtgctattgcctatatgctttaagttaagagatacccttagaaagcacgaagatgcatataagagagagatgaaaattagatag

SEQ ID NO: 4268 - RNA, 4326 nt, synthetic construct
  misc_feature 1..4326: note = derived and/or modified CDS sequence (wt) from LACV(74-32813)__D10370.1__GP
  source 1..4326: mol_type = other RNA
atgattcgcatgctggtgctgattgtagttacggctgcaagcccagtgtatcagagatgtttccaagatggggctatagtgaagcaaaacccatccaaagaggcagtcacagaagtgtgcctaaaagatgatgttagcatgatcaaaacagaggccaggtatgtaaaaaatgcaacaggagttttctcaaacaatgttgcaataaggaagtggttagtctctgattggcatgactgcagacctaagaagatcgttggggggcacatcaatgtaatagaagttggtgatgacctgtcgcttcatactgaatcatatgtttgcagtgcagattgtaccataggtgtagacaaggaaacagcacaggtcagacttcaaacagataccacaaaccattttgaaatagcaggtactactgtgaagtcaggatggttcaaaagcacaacatatataactctagatcagacctgtgaacacctcaaagtttcctgcgccccaaaatctgtacagttccatgcctgcttcaatcagcatatgtcctgtgtcagattcttacacaggacaatattgcctggttccatagctaattccatatgtcagaatattgaaatcataattttagttacacttaccttattaatcttcatactgttaagcattttaagtaagacttatatatgttatttgttaatgcccatattcatccccatagcatatatgtacggtgtaatttacaataagtcatgcaaaaagtgcaagctatgcggcctagtgtatcatccattcacagagtgtggcacgcattgtgtctgtggtgctcgctatgatacttccgatagaatgaaactacacagagcttctggattgtgccctggttataaaagcctaagagctgccagagtcatgtgcaaatcaaaagggcctgcatcaatattgtctataattactgcagtgctggttctaacctttgtgacaccaatcaactccatggttttaggggaaagtaaggaaacctttgaactagaagagcttccagacgacatgctggaaatggcattaaggataaattcttattacttcacctgtatcttaaattatgctgtaagctggggtcttattattgctggattattggttggactgatatttaaaaaataccagcataggttcttaaatatttatgcaatgtactgtgaagaatgtaacatgtatcatgacaaatctgggctgaagagacacggtgacttcaccaacaaatgtagacaatgcacatgtggtcaatatgaagatgctacaggtttgataactcataggaaaacctataactgtttagtgcagtacaaagcaaagtggatgatgaatttcctaataatttacatattcttaattttgatcaaagattctgccatagttggacaagctactgggacagatttcaccacctgcctagagactgagagtataaattggaactgcactgggccattcctaaaccttggaaactgccaaaagcaacaaaagaaagaaccttacacaaatattgcaacccagctaaaagggctaaaagcaatttccgtactagatatccctataattacgagtatcccagacgacattgcaggtgctttaagatatatagaggaaaaggaagatttccatgtccaactaactacagaatatgcaatgctgagtaagtactgtgactattatacccagttctcagataactcaggatatagtcaaacaacatggagagtatacttgagatctcatgattttgaggcatgcatactatatccaaatcagcatttctgcaagtgtgtgaaaaatggtgaaaagtgtagcagctccaattgggactttgccaatggaatgaagaattattactctgggaaacaagcaaaatttgataaagatttaaacctagctctaacagctttgcatcatgccttcagagggacctcatctgcatatatagcagcaatgctctcaaagaagtccaatgatgatttgattgcatatacaaataagataaaagcaaaatttccaggtaatgcactattgaaggctataatagattatatagcatacatgaaaggtttgccagaaatggcaaatttcaaatatgacgagttctgggatgaattattgtacaaacctaacccagcaaaagcctcaaatcttgctaggggaaaagagtcatcctacaacttcaagttagcaatttcgtcaaaatctataaaaacctgtaagaatgttaaggatgttgcctgcttatcaccaaggtcaggtgctatatactcttcaataattgcatgcggtgaacccaacgggccaagtgtgtatagaaaaccatcaggtggtgtatttcaatccagtactgaccggtctatatattgtttgctagacagccattgtctagaggagtttgaggctatcagtcaagaggaactggatgcagtaaaaaaatccaagtgttgggagattgaatatcctgacgtaagacccctccaagaaagtgacggggctaaaagctgtagaatgaaagattctgggaattgtaatgttgcaactaacagatggccagtaatgcaatgcgagaatgacaaattttattattcagaacttcaaaaagattatgacaaaactcaagatattggtcattattgcttaagccctggatgtaccactatccggtaccctattaatccaaagcatatctctaattgtaattggcaggtaagcagatccagcatagcaaagatagacgtacataatgttgaagatattgaacaatataaaaaggctataacccaaaagcttcaaacaagcttgtctctattcaagtatgcaaaaacaaaaaacttgccgcacattagaccaatttataaatacataactatgaaggaaacagaaactgcagaagggatagagagcgcatatattgaatcagaagtgcctgcattggctgggacatctgttgggttcaaaattaattctaaagagggcaaacacttgctagatgttatagcatatgtaaaaagtgcatcgtactcttcagtatatgcgaaattatactcaactggcccaacatcaggaataaatactaaacatgatgaattgtgtactggcccatgcccagcaaatatcaatcatcaagttgggtggctcacatttgcaagagagaggacaagttcatggggatgcgaagagtttggttgcctggctgtaagtgatgggtgcgtgttcgggtcatgccaagacataataaaagaagaactatctgtctataggaaggagaccgaagaagtgaccaatgttgagctatgtttaacattttcagacaagacatattgcacaaacttaaaccctgttacccctattataacagatctatttgaggtacagtttaaaactgtagagacttacagcttgcccagaattgttgccgtgcaaaaccatgagattaagattgggcaaataaatgatctaggggtttactctaagggatgtgggaatgttcaaaaggttaatggaactgtttatggcaatggggtccccagatttgattacttatgtcacttagctagtagaaaggaagtcatcgttagaaaatgctttgataatgattaccaagcatgcaaattccttcaaagccctgctagttatagacttgaagaagacagcggtactgtgactataattgattataagaaaatattaggcacaatcaagatgaaggcaattttaggagatgtcaaatacaaaacatttgctgacagtgttgatataactgcagaagggtcgtgtgctggctgtatcaattgctttcagaatattcattgcgaattaacgctgcataccacaattgaagccagctgcccaattaaaagttcttgcacagtattccatgataggattcttgtaaccccaaatgaacacaaatatgcattaaaaattgtatgcacagaaaagccagggaatacactcaccattaaagtctgcaatactagaattgaagcttcaatggcccttgttgatgcaaagcctatcatagaattagcaccagttgatcagacggcatatataagagaaaaagatgaaagatgcaaaacttggatgtgtagggtaagggatgaagggctgcaggttatcttagagccatttaaaaacttgtttggatcttatattgggatattttacacatttattatatctataatagcattgttggttatcatctatgtactactgcctatatgcttcaaattaagggatacccttagaaagcacgatgatgcatataagagagagatgaaaattagataa

SEQ ID NO: 4269 - RNA, 4326 nt, synthetic construct
  misc_feature 1..4326: note = derived and/or modified CDS sequence (wt) from LACV(Craig County/VA/2009)__KP226848.1__GP
  source 1..4326: mol_type = other RNA
atgattcgcatactggtgctgattgcagttacagctgcaagcccagtgtatcaaaggtgtttccaagatggggctatagtgaagcaaaacccatccaaagaagcagttacagaggtgtgcctgaaagatgatgttagcatgatcaaaactgaggccaggtatgtaagaaatgcaacaggagttttttcgaacaatgttgcaataaggaaatggctagtctctgattggcatgattgcaggcctaagaagatcattgggggacacatcaatgtaatagaagttggtgatgacctgtcactccatactgaatcatatgtttgtagcgcagattgtaccataggtgtagacaaagagactgcacaggtcaggctccaaacagataccacaaatcattttgaaattgcaggcactactgtgaagtcaggatggttcaaaagcacgacatatataactcttgatcaaacctgcgaacaccttaaagtttcctgcggcccaaaatctgtacagttccatgcctgcttcaatcagcatatgtcttgcgtcagatttttacacaggacaatattgcctggctccatagccaattccatatgtcagaatattgaaatcataattttagttacacttactctattaatctttatattgttaagcattttaagtaaaacttatatatgttatttattaatgcctgtattcatccccatagcatgtatatacggtataatttacaataagtcgtgcaaaaaatgcaaactatgtggcctagtatatcacccattcacagagtgtggcacacactgtgtctgtggcgctcgctatgatacttcagatagaatgaaactgcacagagcttctggattgtgccctggttataaaagcctaagagctgccagagtcatgtgcaagtcaaaagggcctgcatcaatattgtctataattactgcagtactggtcttaacctttgtgacaccaatcaactccatggttttaggggagagtaaagagacttttgaacttgaagagcttccagacgacatgttagaaatggcatcgagaataaattcttattatttcacctgtatcttaaattatgctgtaagctggggtcttgttatcattggattgttgatcgggctgctatttaagaaatatcagcacagatttttaaatatttatgcaatgtactgtgaggaatgtgacatgtatcatgacaagtctggattgaaaaggcatggtgatttcaccaacaaatgcaggcagtgcacatgtggtcagtatgaagatgccgcaggtttgatggcccacaggaaaacctataactgcttagtgcagtacaaagcaaaatggataatgaatttcttgataatttacatattcttaattttaatcaaagattctgctatagttgtacaagctgctgggaccgatttcaccacttgcctagagactgagagtataaattggaactgcactgggccatttttaaacctcgggaattgtcaaaagcaacaaaagaaagaaccttacactaacattgcaacccagttaaaaggactaaaggcaatctccgtactagatatccctataataacagggataccagatgatattgcaggtgctttaagatatatagaagagagggaagatttccatgtccagctaactatagaatacgcgatgctgagtaaatactgtgactattatacccaattctcagacaactcaggatacagtcagacaacatggagagtgtacttaaggtctcatgattttgaggcatgtatactatatccaaatcagcatttttgtagatgtgtgaaaaatggtgagaagtgcagcagctccaattgggactttgccaatggaatgaaagattattactctgggaaacaagcaaagtttgataaagacttaaatctagccctaacagctttgcatcatgccttcagggggacctcatctgcatatatagcaacaatgctctcaaaaaagtccaatgatgacttgattacatacacaaataagataaaaacaaaattcccaggtaatgcattgttgaaggctataatagattatatagcatatatgaaaagtttgccaggtatggcaaatttcaaatatgatgaattctgggatgaattattgtacaaacccaacccagcaaaggcctcaaaccttgctagaggaaaggagtcatcttacaacttcaaactagcaatttcatcaaaatctataaaaacctgcaagaatgttaaggatgttgcctgcttgtcgccaaggtcaggtgctatatatgcttcaataattgcgtgtggtgaacccaatgggccaagtgtgtatagaaaaccatcaggtggtgtattccaatctagcactgatcggtctatatactgcttactagatagccattgtctagaagaatttgaggctatcagccaggaggagctggatgcagtaaaaaaatccaaatgttgggaaattgaatatccagacgtaaaacccctccaagaaagtgatgggactaaaagctgtagaatgaaagattctgggaactgcaatgttgcaactaacagatggccaattatacaatgcgagaatgacaaattttactactcagagcttcagaaagattatgacaaaactcaagatattggtcattattgcttaagccctggatgtactactgttcggtaccctattaacccaaagcatatctctaactgtaattggcaggtaagcagatccagcatagcgaagatagatgtgcacaatattgaagatattgaacaatataagaaggctataactcaaaaacttcaaacaagcctatctttatttaagtatgcaaaaacaaaaaacttgccgcacatcaaaccaatttataaatatataactatagaaggaacagaaactgcagaaggtatagagagtgcatacattgaatcagaggtacctgcattagctggggcatctatcggattcaaaatcaattctaaagagggcaagcacttgctagatgttatagcatatgtaaaaagcgcctcatactcttcagtttatgcaaaattgtactcaactggcccaacatcagggataaatactaaacatgatgaattgtgtactggcccatgcccagcaaatatcaatcatcaagttgggtggctaacatttgcaagagagaggacaagctcatggggatgcgaagagtttggttgcctggctgtaagtgatgggtgtgtattcggatcatgccaagatataataaaagaagaactatctgtctatagaaaggagaccgaagaagtgactgatgtagaactatgtttaacattttcagacaaaacatactgtacaaacttaaaccctgttacccctattataacagatctatttgaggtgcaattcaaaactgtagagacttacagcttgcccagaattgttgctgtacaaaaccatgagattaagattgggcagataaatgatctaggagtttactctaaaggttgtggaaatgttcaaaaggtcaatggaactgtttatggcaatggagttcctagatttgactacttatgccacttagctagcagaaaggaagtcattgttagaaagtgcttcgacaatgactaccaagcatgcaaatttcttcaaagccccgccagttacagacttgaagaagacagtggcactgtgactataattgattacaaaaagatattaggcacaatcaagatgaaggcaattttaggagatgtcaagtataaaacgtttgctgatagtgtcgatataactgcagaagggtcatgtactggttgtatcaactgcttcgagaatatccattgcgaattaacattgcataccacaattgaagccagctgcccaattaaaagctcgtgcacagtattccacgacaggattcttgtgactccaaatgaacacaaatatgcattaaaaatggtgtgcacagaaaagccagggaacacactcacaattaaagtttgcaatactaagattgaagcatctatggccctcgtcgacgcaaagcctatcatagaactagcaccagttgatcagacagcatatataagagaaaaagatgaaagatgtaaaacttggatgtgtagggtaagagatgaaggactgcaggttatcttggagccatttaaaaatttatttggatcttatattgggatattttacacatttattatatctatagtggcaatattggttatcatctatgtactattgcctatatgctttaagttaagagatactcttagaaagcatgaagatgcatataagagagagatgaaaattagataa

SEQ ID NO: 4270 - RNA, 4326 nt, synthetic construct
  misc_feature 1..4326: note = derived and/or modified CDS sequence (wt) from LACV(Dallas/TX/2009)__GU591165.1__GP
  source 1..4326: mol_type = other RNA
atgattcgcatactagtgctgattgtagttacggctgcaagcccggtgtatcagagatgtttccaagatggggctatagtgaagcaaaacccatccaaagaggcagtcacagaggtgtgcctaaaagatgatgttagcatgatcaaaacagaggccaggtatgtaaaaaatgcaacaggagttttctcaaacaatgttgcaataaggaagtggttagtctctgattggcatgactgcagacctaagaagatcgttggggggcacatcaatgtaatagaagttggtgatgacctgtcgctccataccgaatcatatgtttgcagtgcagattgtaccataggtgtagacaaggaaacagcacaggtcagacttcaaacagatactacaaaccattttgaaatagcaggtactactgtgaagtcaggatggttcaaaagcacgacatatataactctagatcagacctgtgaacacctcaaagtttcctgcggcccaaaatctgtacagttccatgcctgcttcaatcagcatatgtcttgtgtcagattcttacacaggacaatattgcctggttccatagctaattccatatgtcagaatattgaaatcataattttagttacacttaccttattaatcttcatactgttaagcattttaagtaagacttatatatgttatttgttaatgcccatattcatccccatggcatatatgtacggtgtaatttacaataagtcatgcaaaaagtgcaagctatgtggcctagtgtatcatccattcacagagtgtggcacacattgtgtctgtggtgctcgctatgatacttccgatagaatgaaactgcacagagcttctggattgtgccctggttataaaagcctaagagctgccagagtcatgtgcaaatcaaaagggcctgcatcaatattgtctataattactgcagtgctggttctgacatttgtgacaccaatcaactctatggttttaggggaaagtaaggaaacctttgaacttgaagagcttccagacgacatgctggaaatggcattaaggataaattcttactacttcacctgtatcttaaattatgctgtaagctggggtcttattattgctggattattggttggactgatatttaaaaagtaccagcataggttcttaaatatttacgcaatgtactgtgaagaatgtgacatgtatcatgacaaatctgggctgaagagacatggtgacttcaccagcaaatgtagacaatgcacatgtggtcaatatgaagatgctacaggtttgataactcacaggaaaacctataactgcttagtgcagtacaaagcaaagtggatgatgaatttcctaataatttacatattcttaattttgatcaaagattctgccatagttgtacaagctactgggacagatttcaccacctgcctagagactgagagtataaattggaactgcactgggccattcctaaaccttggaaactgccaaaagcaacaaaagaaagaaccttacacaaatattgcaacccagctaaaagggctaaaagcaatttccgtactagatatccctataattacgggtatcccagacgacattgcaggtgctttaagatatatagaggagaaggaagatttccatgtccaactaactacagaatatgcaatgctgagtaagtactgtgactattatacccagttctcagataactcaggatatagtcaaacaacatggagagtatacttgagatctcatgattttgaggcatgcatactatatccaaatcagcatttctgcaggtgtgtgaaaaatggtgagaagtgtagcagctctaattgggactttgccaatgaaatgaagaattattactctgggaaacaagcaaaatttgataaagatttaaacctagctctaacagctttgcatcatgccttcagagggacctcatctgcatatatagcaacaatgctctcaaagaagtccaatgatgatttggttgcatatacaaataagataaaagcaaaattcccaggtaatgcattattgaaggctataatagattatatagcatacatgaaaggtttgccagatatggcaaatttcaaatatgatgagttctgggatgaattattgtacaaacctaacccagcaaaagcctcaaatcttgctagaggaaaagagtcatcctacaacttcaagttggcagtttcgtcaaaatctataagaacctgtaagaatgttaaggatgttgcctgcttatcaccaaggtcaggtgctatatactcttcaataattgcatgcggtgaacccaacgggccaagtgtgtatagaaaaccatcaggtggtgtatttcaatccagtactgaccggtctatatattgtttgctagacagccattgtctagaggagtttgaggctatcagtcaagaggagttggatgcagtaaaaaaatccaagtgttgggagattgaatatcctgacataagacccctccaagaaagtgacgggtctaaaagctgtagaatgaaagattctgggaactgtaatgttgcaactaacagatggccagtaatgcaatgcgagaatgacaaattttattactcagaacttcaaaaagattatgacaaaactcaagatattggtcactattgcttaagccctggatgtaccactatccggtaccctattaatccaaagcatatctctaattgtaattggcaggtaagcagatccagcatagcaaagatagacgtacataatgttgaagatattgaacaatataaaaaggctataacccaaaagcttcaaacaagcctatctctattcaagtatgcaaaaacaaaaaacctgccacacattaagccaatttataaatacataactatagaaggaacagaaactgcagaagggatagagagcgcatatattgaatcagaggtgcctgcattggctgggacatctattgggttcaaaattaattctaaagagggcaaacacttgctagatgttatagcatatgtaaaaagtgcatcgtattcttcagtatatgcgaaattatactcaactggcccaacatcaggaataaatactaaacatgatgaattgtgcactggcccatgcccagcaaatatcaatcatcaagttgggtggctaacatttgcgagagagaggacaagttcatggggatgcgaagagtttggttgcctggctgtaagtgatgggtgcgtgttcgggtcatgccaagacataataaaagaagaactatctgtctataggaaggatactgaagaagtgaccaatgtggagctatgtctaacattttcagacaagacatattgcacaaacttaaaccctgttacccctattataacagatctatttgaggtacagtttaaaactgtagagacttacagcttgcccagaattgttgctgtgcaaaaccatgagattaagattgggcaaataaacgatctaggggtttactctaagggctgtgggaatgttcaaaaggttaatggaactgtttatggcaatggggtccccagatttgattacttatgtcatttagctagtagaaaggaagtcatcgttagaaaatgctttgataatgattaccaagcatgcaaattccttcaaagccctgctagttatagacttgaagaagacagcggtactgtaactataattgattataagaagatattaggcacaatcaagatgaaggcaattttaggagatgtcaaatacaaaacatttgctgacagtgttgatataactgcagaagggtcgtgtgctggctgtatcaattgctttgagaatattcattgtgaattaacactgcataccacaattgaagccagctgcccaattaaaagttcttgcacagtattccatgataggattcttgtaaccccaaatgaacacaaatatgcattaaaaatggtatgcacagaaaagccagggaatacactcaccattaaagtctgcaatactagaattgaagtttcaatggcccttgttgatgcaaagcctatcatagaactagcaccagttgatcagacggcatatataagagaaaaagatgaaagatgcaaaacttggatgtgtagggtgagggatgaagggctgcaggtcatcttggagccatttaaaaatttatttggatcttatattggaatattttacacatttattatatctataatagcattattggttatcatctatgtactactgcctatatgcttcaaattaagggatacccttagaaagcacgatgatgcatataagagagagatgaaaattagataa

SEQ ID NO: 4271 - RNA, 4326 nt, synthetic construct
  misc_feature 1..4326: note = derived and/or modified CDS sequence (wt) from LACV(Fort Bend County/TX/2009)__GU591168.1__GP
  source 1..4326: mol_type = other RNA
atgattcgcatgctggtgctgattgtagttacggctgcaagcccagtgtatcagagatgtttccaagatggggctatagtgaagcaaaacccatccaaagaggcagtcacagaggtgtgcctaaaagatgatgttagcatgatcaaaacagaggccaggtatgtaaaaaatgcaacaggagttttctcaaacaatgttgcaataaggaagtggttagtctctgattggcatgactgcagacctaagaagatcgttggggggcacatcaatgtaatagaagttggtgatgacctgtcgctccataccgaatcatatgtttgtagtgcagattgtaccataggtgtagacaaggaaacagcacaggtcagacttcaaacagataccacaaaccattttgaaatagcaggtactactgtgaagtcaggatggttcaaaagcacgacatatataactctagatcagacctgtgaacacctcaaagtttcctgcggcccaaaatcagtacagttccatgcctgcttcaatcagcatatgtcctgtgtcagattcttacacaggacaatattacctggttccatagctaattctatatgtcagaacattgaaatcataattttagttacacttaccctattaatcttcatactgttaagcattttaagtaggacttatatatgttatttgttaatgcccatattcatccctatagcatatatgtacggtgtaatttacaataagtcatgcaaaaagtgcaagctatgtggcctagtgtatcatccattcacagagtgtggtacacattgtgtctgtggtgctcgctatgatacttccgatagaatgaaactgcacagagcttctggattgtgccctggttataagagcctaagagctgccagagtcatgtgcaaatcaaaagggcctgcatcaatattgtctataattactgcagtgctggttctaacctttgtgacaccaatcaactccatggttttaggggaaagtaaggaaacctttgaacttgaagagcttccagacgacatgctggaaatggcattaaggataaattcttattatttcacctgtatcttaaattatgctgtaagctggggtcttattattgctggattattggttggactgatatttaaaaagtaccagcataggttcttaaatatttacgcaatgtactgtgaagaatgtgacatgtatcatgacaaatctgggctgaagagacatggtgacttcaccaacaaatgtagacaatgcacatgtggtcaatatgaagatgctgcaggtttgatggctcataggaaaacctataactgcttagtgcagtacaaagcaaagtggatgatgaatttcctaataatttacatattcttaattttgatcaaagattctgccatagttgtacaagctactgggacagatttcaccacttgcctagagactgagagtataaattggaactgcactgggccattcctaaaccttggaaactgccaaaagcaacaaaagaaagagccttacacaaatattgcaacccaactaaaagggctaaaagcaatttccgtactagatatccctataattacgggtatcccagacgacattgcaggcgctttaagatatatagaggagaaggaagatttccatatccaactaactacagaatatgcaatgctaagtaagtactgtgactattatacccagttctcagataactcaggatatagtcaaacaacatggagagtatacttgagatctcatgattttgaggcatgcatactatatccaaatcagcatttctgcaggtgtgtgaaaaatggtgagaagtgtagcagctccaattgggactttgccaatgaaatgaagaattattactctggaaaacaagcaaaatttgataaagatttaaacctagctctaacagctttgcatcatgccttcagagggacctcatctgcatatatagcaacaatgctctcaaagaagtccaatgatgatttgatcgcatatacaaataaaataaaagcaaaattcccaggtaatgcattattgaaggctataatagattatatagcatacatgaaaggtttgccagatatggcaaatttcaaatatgatgagttctgggatgaattattgtacaaacctaacccagcaaaagcctcaaatcttgctagaggaaaagaatcatcctacaacttcaagttagcaatttcgtcaaaatctataaaaacctgtaagaatgttaaggatgttgcctgcttatcaccaaggtcaggtgctatatactcttcaataattgcatgtggtgaacccaacgggccaagtgtgtatagaaaaccatcaggtggtgtatttcaatccagtactgaccggtctatatattgtttgctagacagtcattgtttagaggagtttgaggctatcagtcaagaggagttggatgcagtaaaaaaatccaagtgttgggagattgaatatcctgacgtaagacccctccaagaaagtgacggggctaaaagctgtagaatgaaagattctgggaactgtaatgttgcaactaacagatggccagtaatgcaatgcgagaatgacaaattttattactcagaacttcaaaaagattatgacaaaactcaagatattggtcattattgcttaagccctggatgtaccactatccggtaccctattaatccaaagcatatctctaattgtaattggcaggtaagcagatccagcatagcaaagatagatgtacataatgttgaagatattgaacaatataaaaaggctataacccaaaagcttcaaacaagcctatctctattcaagtatgcaaaaacaaaaaacctgccacacatcaagccaatttataaatacataactatagaaggaacagaaactgcagaagggatagagagcgcatatattgaatcagaggtgcctgcattggctgggacatctattgggttcaaaattaattctaaagagggcaaacacttgctagatgttatagcatacgtaaaaagtgcttcgtactcttcagtatatgcgaaattatactcaactggcccaacatcaggaataaatactaaacatgatgaattgtgtactggcccatgcccagcaaatatcaatcatcaagttgggtggctaacatttgcgagagagaggacaagttcatggggatgcgaagagtttggttgcctggctgtaagtgatgggtgcgtgttcgggtcatgccaagacataataaaagaagaactatctgtctatagaaaagagaccgaagaagtgaccaatgtggagctatgtctaacattttcagacaagacatattgcacaagcttaaaccctgttacccctattataacagatctatttgaggtacagtttaaaactgtagagacttacagcttgcccagaattgttgctgtgcaaaatcatgagattaagattgggcaaataaatgatctaggggtttactctaagggctgtgggaatgttcaaaaggttaatggaactgtttatggcaatggggtccccagatttgattacttatgtcatttagctagtagaaaagaagtcatcgttagaaaatgctttgataatgattaccaagcatgcaaattccttcaaagccctgctagttatagacttgaagaagacagcggtactgtaactataattgattataagaagatattaggcacaatcaagatgaaggcaattttaggagatgtcaaatacaaaacatttgctgacagtgttgatataactgcagaagggtcgtgtgccggctgtatcaattgctttgagaatattcattgtgaattaacgctgcataccacaattgaagccagctgcccaattaaaagttcttgcacagtattccatgataggattcttgtaaccccaaatgaacacaaatatgcattaaaaatggtatgcacagaaaagccagggaatacactcaccattaaagtctgcaatactagaattgaagcttcaatggcccttgttgatgcaaagcctatcatagaactagcaccagttgatcagacggcatatataagagaaaaagatgaaagatgcaaaacttggatgtgtagggtgagggatgaagggctgcaggttatcttagagccatttaaaaacttgtttggatcttatattgggatattttacacatttattatatctataatagcattattggttatcatctatgtactactgcctatatgcttcaaattaagggatacccttagaaagcacgatgatgcatataagagagagatgaaaattagataa

SEQ ID NO: 4272 - RNA, 4326 nt, synthetic construct
  misc_feature 1..4326: note = derived and/or modified CDS sequence (wt) from LACV(LAC22988-89)__U18980.1__GP
  source 1..4326: mol_type = other RNA
atgatttgtatattggtgctaattacagttgcagctgcaagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagagtcatgtgcaagtcgaaagggcctgcatcaatattgtctataattactgcggtactggtcttaacctttgtgacaccaatcaactccatggttttaggagagagtaaagaaacctttgaacttgaagatcttccagacgacatgttggaaatggcatcgagaataaattcttattatctcacctgtatcttgaattatgctgtaagctggggtcttgttatcattggattgttgatcgggctgctttttaagaaataccagcacagattcttaaatgtttacgcaatgtactgtgaagaatgtgacatgtatcatgacaagtctgggttgaaaagacatggtgatttcaccaacaaatgcagacagtgcacatgtggtcaatatgaagatgctgcaggtttgatggctcacaggaaaacctataactgcttagtgcagtacaaagcaaagtggatgatgaacttcctgataatttacatattcttaattttgatcaaagattctgctatagttgtacaagctgctggaactgacttcaccacctgcctagagactgagagtataaattggaactgcactgggccatttttgaacctcgggaattgccaaaagcaacaaaagaaagaaccttacaccaacattgcaactcagttaaagggactaaaggcaatttccgtactagatgtccctataataacagggataccagatgatattgcaggtgctttaagatatatagaagagaaggaagatttccatgtccagctaactatagaatatgcgatgttaagtaaatactgtgactattatacccaattctcagataactcaggatacagtcagacaacatggagagtgtacttaaggtctcataattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgaattctgggatgaattactgtacaaacccaacccagcaaaggcctcaaaccttgctagaggaaaggagtcatcttacaacttcaaactagcaatttcatcaaagtctataaaaatctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgctgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatag

SEQ ID NO: 4273 - RNA, 4326 nt, synthetic construct
  misc_feature 1..4326: note = derived and/or modified CDS sequence (wt) from LACV(LAC30928-31)__U18979.1__GP
  source 1..4326: mol_type = other RNA
atgatttgtatattggtgctaattacagttgcagctgcaagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtacaatttacaataagtcgtgcaaaaaatgcaaattatgtggcttagtgtatcacccattcacagagtgtggcacacattgtgtctgtggtgcccgctatgatacttcagatagaatgaaactgcatagagcttctggattgtgccctggttataaaagcctaagagctgccagagtcatgtgcaagtcgaaagggcctgcatcaatattgtctataattactgcggtactggtcttaacctttgtgacaccaatcaactccatggttttaggagagagtaaagaaacctttgaacttgaagatcttccagacgacatgttggaaatggcatcgagaataaattcttattatcttacctgtatcttgaattatgctgtaagctggggtcttgttatcattggattgttgatcgggctgctttttaagaaataccagcacagattcttaaatgtttacgcaatgtactgtgaagaatgtgacatgtatcatgacaagtctgggttgaaaagacatggtgatttcaccaacaaatgcagacagtgcacatgtggtcaatatgaagatgctgcaggtttgatggctcacaggaaaacctataactgcttagtgcagtacaaagcaaagtggatgatgaacttcctgataatttacatattcttaattttgatcaaagattctgctatagttgtacaagctgctggaactgacttcaccacctgcctagagactgagagtataaattggaactgcactgggccatttttgaacctcgggaattgccaaaagcaacaaaagaaagaaccttacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagtaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaatcgggactttgccaatgaaatgaaagattattactctgggaaacaaacaaagtttgacaaggatttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgaattctgggatgaattattgtacaaacccaacccagcaaaggcctcaaaccttgctagaggaaaggagtcatcttacaacttcaaactagcaatttcatcaaagtctataaagatctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatccgtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaaactcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacaagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcccagaattgttgctgtgcaaaaccatgagattaagattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaattccttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaaattgaagcatctatggcccttgtcgatgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagcattattggttattatctatgtactactacctatatgctttaagttaagggatacccttagaaagcatgaagatgcatataagagagagatgaaaattagatag

SEQ ID NO: 4274 - RNA, 4326 nt, synthetic construct
  misc_feature 1..4326: note = derived and/or modified CDS sequence (wt) from LACV(LAC76-40)__U70206.1__GP
  source 1..4326: mol_type = other RNA
atgatttgtatattggtgctgattacagttgcagctgcaagcccagtgtatcaaaggtgtttccaagatggggctatagtgaagcaaaacccatccaaagaagcagttacagaggtgtgcctgaaagatgatgtcagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagattcttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggcataatttacaataagtcgtgcaaaaaatgcaaattatgtggcttagtgtatcatccattcacagagtgtggcacacattgtgtctgtggtgcccgctatgatacttcggatagaatgaaactgcacagagcttctggattgtgccctggttataaaagcctaagagctgccagagtcatgtgcaagtcgaaagggcctgcatcaatattgtctataattactgcggtactggtcttaacctttgtgacaccaatcaactccatggttttaggagagagtaaagaaacctttgaacttgaagatcttccagacgacatgttggaaatggcatcgagaataaattcttattatctcacctgtatcttgaattatgctgtaagctggggtcttgttatcattggattgttgatcgggctgctatttaagaaataccagcacagattcttaaatgtttacgcaatgtactgtgaagaatgtgacatgtatcatgacaagtctgggttgaaaagacatggtgatttcaccaacaaatgcagacagtgcacatgtggtcaatatgaagatgctgcaggtttgatggctcacaggaaaacctataactgcttagtgcagtacaaagcaaagtggatgatgaacttcctgataatttacatattcttaattttgatcaaagattctgctatagttgtacaagctgctggaactgacttcaccacctgcctagagactgagagtataaattggaactgcactgggccatttttgaacctcgggaattgccaaaagcaacaaaagaaagaaccttacaccaacattgcaactcagttaaagggactaaaggcaatttccgtactagatgtccctataataacagggataccagatgatattgcgggtgccttaagatatatagaagagaaggaagatttccatgtccagctaactatagaatatgcgatgttaagtaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagcttgccaggtatggcaaatttcaaatatgatgaattctgggatgaattattgtacaaacccaacccagcaaaggcctcaaaccttgctagaggaaaggagtcatcttacaacttcaaactagcaatttcatcaaagtctataaaaacctgcaaggatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccattggccaggaggagctggatgcggtaaagaaatccaaatgttgggaaattgaatatcctgacgtaaagctcatccaagaaggtgatgggactaaaagctgtagaatgaaagattctgggaactgcaatgttgcaactaacagatggccagtgatacaatgtgagaatgacaaattttactactcagagcttcaaaaagattatgacaaaactcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcaaaaacttcaaacgagcctatctctattcaagtatgcaaaaacaaaaaacttgccgcacatcaaaccaatttataaatacataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatgcaaaattgtactcaactggcccaacatcagggataaatactaaacatgatgaattgtgtactggcccatgcccagcaaatattaatcatcaggttgggtggctgacatttgcaagagagaggacaagctcatggggatgcgaagagtttggttgcctggctgtaagtgatgggtgtgtatttgggtcatgccaagatataataaaagaagaactgtctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcccagaattgttgctgtgcaaaaccatgagattaagattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgataatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaaattgaagcatctatggcccttgtcgacgcaaagcctatcatagaactagcaccagttgatcagacagcatatataagagaaaaagatgagaggtgtaaaacttggatgtgtagggtaagagatgaaggactgcaggtcatcttggagccatttaaaaatttattcggatcttatattgggatattttacacatttattatatctatagtagcattattggttattatctatgtactactacctatatgctttaagttaagggacacccttagaaagcatgaagatgcatataagagagagatgaaaattagatag

SEQ ID NO: 4275 - RNA, 4326 nt, synthetic construct
  misc_feature 1..4326: note = derived and/or modified CDS sequence (wt) from LACV(LAC79-283)__U70207.1__GP
  source 1..4326: mol_type = other RNA
atgattcgcatactggtgctgattgcagttacagctgcaagcccagtgtatcaaaggtgcttccaagatggggctatagtgaagcaaaacccatccaaagaagcagtcacagaggtgtgcctgaaagatgatgttagcatgatcaaaacagaggccaggtatataagaaatgcaacaggggttttttcaaacaatgttgcaataaggaaatggctagtctctgattggcatgattgcaggcctaagaggatcattgggggacacatcaatgtaatagaagttggtgatgacctatcgctgcatactgaatcatatgtttgcagcgcagattgtacaataggtgtagacaaagagactgcgcaggtcagacttcagacagatactacaaatcattttgaaattgcaggcactactgtgaagtcaggatggttcaaaagcacgacatatataactcttgatcaaacctgcgaacaccttaaagtttcctgtggcccaaaatctgtacaattccatgcctgcttcaatcagcatatgtcttgcgtcagatttttacacagaacaatattgcctggctccattgccaattccatatgtcagaatattgaaatcataattttagttacacttactctattaatctttatattgttaagtattctaagtaagacttatatatgttatttattaatgcctatatttatccccatagcatatatatacggtataatttacaataagtcgtgcaaaaaatgcaaactatgcggcctagtgtatcatccattcacagagtgtggcacgcattgtgtctgtggtgcccgctatgatacttcagatagaatgaaactgcacagagcttctggattgtgccctggttataaaagcctaagagctgccagagtcatgtgcaagtcgaaagggcctgcatcaatattatctataattactgcagtactagtcttaacctttgtaacaccaatcaactctatggttttaggagaaagtaaagaaacgtttgagcttgaagagcttccagatgacatgttgggaatggcatctaggataaactcttattattttacctgcatcttaaattatgctgtaagctggggtcttgttatcattgggttgttgaccggactgctttttaagaaataccaacacagatttttaaatgtttatgcaatgtactgtgaggaatgtgacatgtatcatgacaagtctgggttgaaaagacatggtgacttcactaacaaatgcaggcagtgcacatgcggccaatatgaagatgccacaggcttgatggcccacaggaaaacctataactgcttagtgcagtacaaagcaaagtggatgatgaatttcctggtaatttacatattcttaattttaatcaaagattctgctatagttgtacaagctgctggaaccgatttcaccacctgcctagagactgagagtataaattggaactgcactgggccgtttttgaacctcgggaattgtcaaaagcagcaaaagaaggaaccttacaccaacattgcaacccaattaaaggggctaaaggcaatttccgtactagatatccctataataacagggattccggatgatattgcaggtgctttaagatatatagaagaaagggaagatttccatgtccagctaactatagaatacgcaatgctgagtaagtactgtgactattacacccaattctcagataactcaggatacagtcagacaacatggagggtgtacttaaggtctcatgattttgaggcatgtatactatatccaaatcagcatttttgcagatgtgtgaaaaatggtgaaaagtgcagcagctccaattgggattttgccaatgaaatgaaggatttttactctgggaaacaaacaaagtttgataaagacttaaatctagccctaacagctttgcatcatgctttcagggggacctcatctgcatatatagcaacaatgctctcaaaaaagtccaatgatgacttgattgcatacacaaataagataaaaacaaaatttccaggtaatgcattgttgaaggctataatagattatatagcatatatgaaaagtttgccaggtatggcaaatttcaaacatgatgagttctgggatgaattattgtacaaacccaacccagcaaaagcctcaaaccttgctagaggaaaggagtcttcttacaactttaaactagcaatttcatcaaaatctataaaaacctgcaagaatgttaaggatgtcgcctgcttatcaccaaggtcaggtgctatatatgcttcaataattgcgtgtggtgaacctaatgggccaagtgtgtatagaaaaccatcaggtggtgtattccaatctagcactgatcggtctatatactgcttactagatagccattgtctagaagagtttgaggctatcagccaggaagagctggacgcagtgaaaaaatccaaatgttgggaaattgaatatcctgacgtaaaacccctccaagaaggcgatgggactaaaagctgtaggatgaaagattctgggaactgcaatgttgcaactaacagatggccagtgatacaatgcgagaatgacaaattttactactcagagcttcaaaaagattatgataaaactcaagatattggtcattattgcttaagccctggatgtactactgtccggtaccctattaatccaaagcatatctctaactgtaattggcaggtaagtagatccagtatagcgaagatagacgtgcacaatattgaagacattgaacagtataagaaggctataactcaaaaactccaaacaagcctatctctattcaagtatgcaaaaacaaaaaacttgccacacatcaaaccaatttataaatatataactatagaaggaacagaaactgcagaaggtatagagagtgcatacattgaatcagaggtgcctgcattagctgggacatctatcgggttcaaaatcaattctaaagagggcaaacacttactagatgttatagcatatgtaaaaagcgcctcatactcttcagtgtatgcaaaattgtactcaactggcccaacatcaggaataaacactaaacatgatgaattgtgtactggcccatgcccagcaaatatcaatcatcaggttgggtggctaacatttgcaagagagaggacaagttcatggggatgtgaagaatttggttgcctagctgtaagtgatgggtgtgtatttgggtcatgccaagatataataaaagaagaactatctgtctataggaaggagaccgaagaagtaactgatgtagaactatgtttaacattttcagacaaaacatattgtacaaacttgaaccctgttactcctattataacagacctatttgaagtacagttcaacactgtagagacttacagcttgcccagaattgttgctgtgcaaaaccacgagattaagattgggcaaataaatgacctaggagtttactctaaaggttgtggaaatgttcaaaaggtcaatggaactgtttatggcaatggagttcccagatttgattacttatgccatttagctagcaggaaggaagtcattgttagaaaatgcttcgacaatgattaccaggcatgcaaattccttcaaagccctgctagttacagacttgaagaagacagtggtactgtgactataattgattacaaaaagatattaggcacaatcaagatgaaggcaattttaggagatgtcaaatataagacatttgctgacagtgtcgatataactgcagaagggtcatgcactggctgtatcaattgctttgagaatattcattgtgaattaacgttgcataccacaattgaagctagctgcccaattaaaagctcgtgcacagtattccatgacaggattcttgtgactccaaatgaaccccaatatgcattaaaaatggtgtgcacagaaaggccagggaataccctcacaattaaagtttgcaatactaagattgaggcatctatggcccttgtcgatgcaaaacctatcatagaactagcaccagttgatcagacagcatacataagagaaaaagatgaaaggtgtaaaacttggatgtgtagggtaagagatgaaggattgcaagtcatcctggaaccattcaaaaatttatttggatcttatattgggatattttacacatttattatatctatggtggcattattggttatcatatatgtgctattgcctatatgctttaagttaagagatacccttagaaagcatgaagatgcatataagagagagatgaagattagatag

SEQ ID NO: 4276 - RNA, 4326 nt, synthetic construct
  misc_feature 1..4326: note = derived and/or modified CDS sequence (wt) from LACV(LAC81-4)__U70208.1__GP
  source 1..4326: mol_type = other RNA
atgattcgcatactggtgctgattgcagttacagctgcaagcccagtgtatcaaaggtgtttccaagatggggctatagtgaagcaaaacccatccaaagaagcagtcacagaggtgtgcctgaaagatgatgttagcatgatcaaaacagaggccaggtatataagaaatgcaacaggggttttttcaaacaatgttgcaataaggaaatggctagtctctgattggcatgattgcaggcctaagaagatcattgggggacacatcaatgtaatagaagttggtgatgacctatcgctgcatactgaatcatatgtttgcagcgcagattgtacaataggtgtagacaaagagactgcgcaggtcagacttcagacagatactacaaatcattttgaaattgcaggcactactgtgaagtcaggatggttcaaaagcacgacatatataactcttgatcaaacctgcgaacaccttaaagtttcctgtggcccaaaatctgtacaattccatgcctgcttcaatcagcatatgtcttgcgtcagatttttacacagaacaatattgcctggctccattgccaattccatatgtcagaatattgaaatcataattttagttacacttactctattaatctttatattgttaagtattctaagtaagacttatatatgttatttattaatgcctatatttatccccatagcatatgtatacggtataatttacaataagtcgtgcaaaaaatgcaaactatgcggcctagtgtatcatccattcacagagtgtggcacacattgtgtctgtggtgcccgctatgatacttcagatagaatgaaacttcacagagcttctggattgtgccctggttataaaagcctaagagctgccagagtcatgtgcaagtcgaaagggcctgcatcaatattatctataattactgcagtactagtcttaacctttgtaacaccaatcaactctatggttttaggagaaagcaaagaaacgtttgagcttgaagagcttccagatgacatgttgggaatggcatctaggataaactcttattattttacctgcatcttaaattatgctgtaagctggggtcttgttatcattgggttgttgaccggactgctttttaagaaataccaacacagatttttaaatgtttatgcaatgtactgtgaggaatgtgacatgtatcatgacaagtctgggttgaaaagacatggtgacttcactaacaaatgcaggcagtgcacatgcggccaatatgaagatgccacaggcttgatggcccacaggaaaacctataactgcttagtgcagtacaaagcaaagtggatgatgaatttcctggtaatttacatattcttaattttaatcaaagattctgctatagttgtacaagctgctggaaccgatttcaccacctgcctagagactgagagtataaattggaactgcactgggccgtttttgaacctcgggaattgtcaaaagcagcaaaagaaggaaccttacaccaacattgcaacccaattaaaggggctaaaggcaatttccgtactagatatccctataataacagggattccggatgatattgcaggtgctttaagatatatagaagaaagggaagatttccatgtccagctaactatagaatacgcaatgctgagtaagtactgtgactattacacccaattctcagataactcaggatacagtcagacaacatggagggtgtacttaaggtctcatgattttgaggcatgtatactatatccaaatcagcatttttgcagatgtgtgaaaaatggtgaaaagtgcagcagctccaattgggattttgccaatgaaatgaaggatttttactctgggaaacaaacaaagtttgataaagacttaaatctagccctaacagctttgcatcatgctttcagggggacctcatctgcatatatagcaacaatgctctcaaaaaagtccaatgatgacttgattgcatacacaaataagataaaaacaaaatttccaggtaatgcattgttgaaggctataatagattatatagcatatatgaaaagtttgccaggtatggcaaatttcaaacatgatgagttctgggatgaattattgtacaaacccaacccagcaaaagcctcaaaccttgctagaggaaaggagtcttcttacaactttaaactagcaatttcatcaaaatctataaaaacctgcaagaatgttaaggatgtcgcctgcttatcaccaaggtcaggtgctatatatgcttcaataattgcgtgtggcgaacctaatgggccaagtgtgtatagaaaaccatcaggtggtgtattccaatctagcactgatcggtctatatactgcttactagatagccattgtctagaagagtttgaggctatcagccaggaagagctggatgcagtgaaaaaatccaaatgttgggaaattgaatatcctgacgtaaaacccctccaagaaggtgatgggactaaaagctgtaggatgaaagattctgggaactgcaatgttgcaactaacagatggccagtgatacaatgcgagaatgacaaattttactactcagagcttcaaaaagattatgataaaactcaagatattggtcattattgcttaagccctggatgtactactgtccggtaccctattaatccaaagcatatctctaactgtaattggcaggtaagtagatccagtatagcgaagatagacgtgcacaatattgaagacattgaacagtataagaaggctataactcaaaaactccaaacaagcctatctctattcaagtatgcaaaaacaaaaaacttgccacacatcaaaccaatttataaatatataactatagaaggaacagaaactgcagaaggtatagagagtgcatacattgaatcagaggtgcctgcattagctgggacatctatcgggttcaaaatcaattctaaagagggcaaacacttactagatgttatagcatatgtaaaaagcgcctcatactcttcagtgtatgcaaaattgtactcaactggcccaacatcaggaataaacactaaacatgatgaattgtgtactggcccatgcccagcaaatatcaatcatcaggttgggtggctaacatttgcaagagagaggacaagttcatggggatgtgaagaatttggttgcctagctgtaagtgatgggtgtgtatttgggtcatgccaagatataataaaagaagaactatctgtctataggaaggagaccgaagaagtaactgatgtagaactatgtttaacattttcagataaaacatattgtacaaacttgaaccctgttactcctattataacagacctatttgaagtacagttcaaaactgtagagacttacagcttgcccagaattgttgctgtgcaaaaccacgagattaagattgggcaaataaatgacctaggagtttactctaaaggttgtggaaatgttcaaaaggtcaatggaactgtttatggcaatggagttcccagatttgattacttatgccatttagctagcagaaaggaagtcattgttagaaaatgcttcgacaatgattaccaggcatgcaaattccttcaaagccctgctagttacagacttgaagaagacagtggtactgtgactataattgattacaaaaagatattaggcacaatcaagatgaaggcaattttaggagatgtcaaatataagacatttgctgacagtgtcgatataactgcagaagggtcatgcactggctgtatcaattgctttgagaatattcattgtgaattaacgttgcataccacaattgaagctagctgcccaattaaaagctcgtgcacagtattccatgacaggattcttgtgactccaaatgaaccccaatatgcattaaaaatggtgtgcacagaaaggccagggaataccctcacaattaaagtttgcaatactaagattgaggcatctatggcccttgtcgatgcaaaacctatcatagaactagcaccagttgatcagacagcatacataagagaaaaagatgaaaggtgtaaaacttggatgtgtagggtaagagatgaaggattgcaagtcatcctggaaccattcaaaaatttatttggatcttatattgggatattttacacatttattatatctatggtggcattattggttatcatatatgtgctattgcctatatgctttaagttaagagacacccttagaaagcatgaagatgcatataagagagagatgaagattagatag

SEQ ID NO: 4277 - RNA, 4326 nt, synthetic construct
  misc_feature 1..4326: note = derived and/or modified CDS sequence (wt) from LACV(LACR56869)__U70205.1__GP
  source 1..4326: mol_type = other RNA
atgatttgtatattggtgctgattacagttgcagctgcaagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaacaatgtcgcaataaggaaatggctagtctctgattggcatgattgcaggcctaagaagatcgttgggggacacatcaatgtaatagaagttggtgacgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgtggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaattgcacagagcttctggattatgccctggttataaaagcctaagagctgccagagtcatgtgcaagtcgaaagggcctgcatcaatattgtctataattactgcggtactagtcttaacctttgtgacaccaatcaactccatggttttaggagagagtaaagaaacctttgaacttgaagatcttccagacgacatgttggaaatggcatcgagaataaattcttattatctcacctgtatcttgaattatgctgtaagctggggtcttgttatcattggattgttgatcgggctgctatttaagaaataccagcacagattcttaaatatttacgcaatgtactgtgaagaatgtgacatgtatcatgacaagtctgggttgaaaagacatggtgatttcaccaacaaatgcagacagtgcacatgtggtcaatatgaagatgctgcaggtttgatggctcacaggaaaacctataactgcttagtgcagtacaaagcaaagtggatgatgaacttcctgataatttacatattcttaattttgatcaaagattctgctatagttgtacaagctgctggaactgacttcaccacctgcctagagactgaaagtataaattggaactgcactgggccatttttgaacctcgggaattgccaaaagcaacaaaagaaagaaccttacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagtaaatactgtgattattatacccaattctcagataactcaggatacagtcagacaacatggagagtgtacttaaggtctcatgattttgaagcctgtatactatatccaaatcagcacttttgcagatgtgtaaagaatggtgagaagtgcagcagctccaattgggactttgccaacgaaatgaaagattattactctgggaaacaaacaaagtttgacaaggacttaaatctagccctaacagctttgcatcatgccttcagggggacctcatctgcatatatggcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgaattctgggatgaattattgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaagtctaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaaactcaagatattggtcactattgcttaagccctggatgtactactgtccggtaccctattaatccaaagcacatctctaactgtaattggcaagtaagcagatctagcatagcgaagatagatgtgcacaatattgaggatattgaacaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttactagatgttatagcatatgtgaaaagtgcctcatactcttcagtgtatacaaaattgtactcaactggcccaacatcagggataaatactaaacatgatgaattgtgtactggcccatgcccagcaaatatcaatcatcaggatgggtggctgacatttgcaagagagaggacaagctcatggggatgcgaagagtttggttgcctggctgtaagtgatgggtgtgtatttgggtcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtggagacctacagcttgcccagaattgttgctgtgcaaaaccatgagattaagattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattatcaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaattgcttcgaaaatatccattgcgaattaacgttgcacaccacaattgaagccagctgcccaattaaaagctcgtgcacagtatttcatgacaggattcttgttactccaaatgaacacaaatatgcattaaaaatggtgtgcacagaaaagccagggaacacactcacaattgaagtctgcaatactaaaattgaagcatctatggcccttgtcgacgcaaagcctatcatagaactagcaccagttgatcagacaacatatataagagaaaaagatgaaaggtgtaaaacttggatgtgtagggtaagagatgaaggactgcaggtcatcttggagccatttaaaaatttatttggatcttatattgggatattttacacatttattatatctatagtagcattattggttattatctatgtactactacctatatgctttaagttaagggatacccttagaaagcatgaagatgcatataagagagagatgaaaattagataa

SEQ ID NO: 4278 - RNA, 4326 nt, synthetic construct
  misc_feature 1..4326: note = derived and/or modified CDS sequence (wt) from LACV(NAT_Crawford_WI_2007)__GU596383.1__GP
  source 1..4326: mol_type = other RNA
atgattcgcatactggtgctgattgcagttacagctgcaagcccagtgtatcaaagatgtttccaagatggggctatagtgaagcaaaacccatccaaagaagcagtcacagaggtgtgcctgaaagatgatgttagcatgatcaaaacagaggccaggtatgtaagaaatgcaacaggggttttttcaaacaatgttgcaataaggaaatggctagtctctgattggcatgattgcaggcctaagaagatcattgggggacacatcaatgtaatagaagttggtgatgacctatcgctgcatactgaatcatatgtttgcagcgcagattgtacaataggtgtagacaaagagactgcgcaggtcagacttcagacagatactacaaatcattttgaaattgcaggcactactgtaaagtcaggatggttcaaaagcacgacatatataactcttgatcaaacctgcgaacaccttaaagtttcctgtggcccaaaatctgtacaattccatgcctgcttcaatcagcatatgtcttgcgtcagatttttacacagaacaatattgcctggctccattgccaattccatatgtcaaaatattgaaatcataattttagttacacttactctattgatctttatattgttaagtattttaagtaagacttatatatgttatttattaatgcctatatttatccccatagcatatgtatacggtataatttacaataagtcgtgcaaaaaatgcaaactatgcggcctagtgtatcatccattcacagagtgtggcacacattgtgtctgtggtgcccgctatgatacttcagatagaatgaaactgcacagagcttctggattgtgccctggttataaaagcctaagagctgccagagtcatgtgcaagtcgaaagggcctgcatcaattttatctataattactgcagtactggtcttaacctttgtaacaccaatcaactctatggttttaggggaaagtaaagaaacgtttgaacttgaagagcttccagatgacatgttggaaatggcatcgaggataaattcttattattttacctgcatcttgaattatgctgtaagctggggtcttgttatcattgggttgttgaccggactgctattcaagaaataccaacacagatttttaaatgtttatgcaatgtactgtgaggaatgtgacatgtatcatgacaagtctgggttaaaaagacatggtgactttaccaacaaatgcaggcagtgtacatgtggccaatatgaagatgccacaggcttgatggcccacaggaaaacctataactgcttagtgcagtacaaagcaaagtggatgatgaatttcctaataatttacatattcttaattttaatcaaagattctgctatagttgtacaagctgctggaaccgatttcaccacttgcctagagactgagagtataaattggaactgcactgggccgtttttgaacctcgggaattgtcaaaagcagcaaaagaaggaaccttacaccaacattgcaacccaattaaaggggctaaaggcaatttccgtactggatatccctataataacagggattccagatgatattgcaggtgctttaaggtatatagaagaaagggaagatttccatgtccagctaactatagaatacgcaatgctgagtaagtactgtgactattacacccaattctcagataactcaggatacagtcaggcaacatggagggtgtacttaaggtctcatgattttgaggcatgtatactatatccaaatcagcatttttgcagatgtgtgaaaaatggtgaaaagtgcagcagctccaattgggattttgccaatgaaatgaaggatttttactctggaaaacaaacaaagtttgataaagacttaaatctggccctaacagctttgcaccatgccttcagggggacctcatctgcatatatagcaacaatgctctcaaaaaagtccaatgatgacttgattgcatacacaaataagataaaaacaaaatttccaggtaatgcattgttgaaggctataatagattatatagcatatatgaaaagtttgccaggtatggcaaatttcaaatatgatgagttctgggatgaattattgtacaaacccaacccagcaaaagcctcaaaccttgctagaggaaaggagtcttcttacaactttaaactagcaatttcatcaaaatctataaaaacctgcaagaatgttaaggatgtcgcctgcttatcaccaaggtcaggtgctatatatgcttcaataattgcgtgtggcgaacccaatgggccaagtgtgtatagaaaaccatcaggtggtgtattccaatctagcactgatcggtctatatactgcttactagatagccattgtctagaagagtttgaggctatcagccaggaagagctggatgcagtgaaaaaatccaaatgttgggaaattgaatatcctgacgtaaaacccctccaagaaagtgatggaactaaaagctgtaggatgaaagattctgggaactgcaatgttgcaactaacagatggccagtgatacaatgcgagaatgacaaattttactactcagagcttcaaaaagattatgataaaactcaagatattggtcattattgcttaagccctggatgtactactgtccggtaccctattaatccaaagcatatctctaactgtaattggcaggtaagcagatccagtatagcgaagatagacgtgcacaatattgaagacattgagcagtataagaaggctataactcaaaaactccaaacaagcctatctctattcaagtatgcaaaaacaaaaaacttgccacacattaaaccaatttataaatatataactatagaaggaacagaaactgcagaaggtatagagagtgcatacattgaatcagaggtgcctgcattagctgggacatctatcgggttcaaaatcaattctaaagagggcaaacacttactagatgttatagcatatgtaaaaagcgcctcatactcttcagtgtatgcaaaattgtactcaactggcccaacatcaggaataaacactaagcatgatgaattgtgtactggcccatgcccagcaaatatcaatcaccaggttgggtggctaacatttgcaagagagaggacaagttcatggggatgtgaagaatttggttgcctagctgtaagtgatgggtgtgtatttggatcatgccaagatataataaaagaagaactatctgtctataggaaggagaccgaagaagtgactgatgtagaactatgtttaacattttcagataaaacatattgtacaaacttgaaccctgttacccctattataacagatctatttgaagtacagttcaaaactgtagagacttacagcttgcccagaattgttgctgtgcaaaaccatgagattaagattgggcaaataaatgacctaggagtttactctaaaggttgtggaaatgttcaaaaggtcaatggaactgtttatggcaatggagttcccagatttgattacttatgccacttagctagcagaaaggaagtcattgttagaaaatgcttcgacaatgattaccaagcatgcaaattccttcaaagccctgctagttacagacttgaagaagacagtggtactgtaactataattgattacaagaagatattaggcacaatcaagatgaaggcaattttaggagatgtcaaatataaaacatttgctgacagtgtcgatataactgcagaagggtcatgcactggctgtatcaattgctttgagaatattcattgtgaattaacgttacataccacaattgaagctagctgcccaattaaaagctcgtgcacagtattccatgacaggattcttgtgactccaaatgaacacaaatatgcattaaaaatggtgtgcacagaaaggccagggaatacactcacaattaaagtttgcaacactaagattgaggcatctatggcccttgtcgatgcaaagcctatcatagaactagcaccagttgatcagacagcatacataagagaaaaggatgaaaggtgtaaaacttggatgtgtagggtaagagatgaaggattgcaagtcatcctggagccattcaaaaatttgtttggatcttatattgggatattttacacatttattatatctatagtggcattattggttatcatctatgtgctattgcctatatgcttcaagttaagagatacccttagaaagcatgaagatgcatataagagagagatgaaaattagatag

SEQ ID NO: 4279 - RNA, 4326 nt, synthetic construct
  misc_feature 1..4326: note = derived and/or modified CDS sequence (wt) from LACV(77)__DQ196119.1__GP
  source 1..4326: mol_type = other RNA
atgatttgtatattggtgctaattacagttgcagctgcaagcccagtgtatcaaaggtgtttccaagatggggctatagtgaagcaaaacccatccaaagaagcagttacagaggtgtgcctgaaagatgatgttagcatgatcaaaacagaggctaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcgagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtacaatttacaataagtcgtgcaaaaaatgcaaattatgtggcttagtgtatcacccattcacagagtgtggcacacattgtatctgtggtgcccgctatgatacttcagatagaatgaaactgcatagagcttctggattgtgccctggttataaaagcctaagagctgccagagtcatgtgcaagtcgaaagggcctgcatcaatattgtctataattactgcggtactggtcttaacctttgtgacaccaatcaactccatggttttaggagagagtaaagaaacctttgaacttgaagatcttccagacgacatgttggaaatggcatcgagaataaattcttattatcttacctgtatcttgaattatgctgtaagctggggtcttgttatcattggattgttgatcgggctgctttttaagaaataccagcacagattcttaaatgtttacgcaatgtactgtgaagaatgtgacatgtatcatgacaagtctgggttgaaaagacatggtgatttcaccaacaaatgcagacagtgcacatgtggtcaatatgaagatgctgcaggtttgatggctcacaggaaaacctataactgcttagtgcagtacaaagcaaagtggatgatgaacttcctgataatttacatattcttaattttgatcaaagattctgctatagttgtacaagctgctggaactgacttcaccacctgcctagagactgagagtataaattggaactgcactgggccatttttgaacctcgggaattgccaaaagcaacaaaagaaagaaccttacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagtaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaatcgggactttgccaatgaaatgaaagattattactctgggaaacaaacaaagtttgacaaggatttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgaattctgggatgaattattgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcagtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaaactcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacaagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagaggcctacagcttgcccagaattgttgctgtgcaaaaccatgagattaagattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaattccttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaaattgaagcatctatggcccttgtcgatgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagcattattggttattatctatgtactactacctatatgctttaagttaagggatacccttagaaagcatgaagatgcatataagagagagatgaaaattagatag

SEQ ID NO: 4280 - RNA, 4326 nt, synthetic construct
  misc_feature 1..4326: note = derived and/or modified CDS sequence (wt) from LACV(LACV/00/NC-M (NC00-283))__GU206112.1__GP
  source 1..4326: mol_type = other RNA
atgattcgcatactggtgctgattgcagttacagctgcaagcccagtgtatcaaaggtgtttccaagatggggctatagtgaagcagaacccatccaaagaagcagttacagaggtgtgcctgaaagatgatgttagcatgatcaaaacagaggccaggtacgtaagaaatgcaacaggagttttttcaaacaacgttgcaataaggaaatggctagtctctgattggcatgattgcaggcctaagaagatcattgggggacacatcaatgtaatagaagttggtgatgacctgtcactccatactgagtcatatgtttgtagcgcagattgtaccataggtgttgacaaagagactgcacaggtcaggcttcagacagataccacaaatcattttgaaattgcaggcactactgtgaagtcaggatggttcaaaagcacgacgtatataactcttgatcaaacctgcgaacaccttaaagtttcctgcggcccaaaatctgtacagttccatgcctgcttcaatcagcacatgtcttgcgtcagatttttacacaggacaatattgcctggttctatagccaattctatatgtcagaatattgaaatcataattttagttacacttactctattaatctttatattgttaagcattttaagtaagacttatatatgttatttattaatgcctatatttatccctatagcatacatgtacggtataatttacaataagtcgtgcaaaaaatgcaaactatgcggcctagtgtatcatccattcacagagtgtggcacacattgcgtctgtggtgctcgctatgatacttcagatagaatgaaactgcacagagcttctggattgtgccccggttataaaagcctaagagctgccagagttatgtgcaagtcaaaagggcctgcatcaatactgtctataattactgcagtactggtcttaacctttgtgacaccaatcaattctatggttttaggggagagtaaagaaacttttgaacttgaagagcttccagacgacatgttggaaatggcatcaagaataaattcttattatttcacctgtatcttaaactatgctgtgagctggggtcttgttatcattggattgttgaccgggctgctatttaagaaatatcagcacagatttttaaatgtttacgcaatgtactgtgaggaatgtgatatgtatcatgacaaatctgggttgaaaaggcatggtgatttcaccaacaaatgcaggcagtgcacatgcggtcaatatgaagatgctgcaggtttgatggcccataggaaaacctataactgcttagtgcaatacaaagcaaaatggatgatgaatttcctgataatttacatattcttaattttaatcaaagattctgctatagttgtacaagctgctggaaccgatttcaccacttgcctagagactgagagtataaattggaactgcactgggccgttcttgaacctcgggaattgtcaaaagcaacaaaagaaagaaccttacaccaacattgcaacccagttaaagggactaaaggcaatttccgtactagatatccctataataacagggataccagatgatatcgcaggtgctttaaaatatatagaagagagggaagatttccatgtccagctaactatagaatacgcaatgctgagtaaatactgtgactattatacccaattctcagacaactcaggatacagtcaaacaacatggagagtgtacttaaggtctcatgattttgaggcatgtatactatatccaaatcagcatttttgcagatgtgtgaaaaatggtgagaagtgcagcagctccaattgggactttgccaatgaaatgaaagattattattcagggaaacaaacaaagtttgataaagacttaaatctagccttaacagccttgcatcatgctttcagggggacttcatctgcatatatagcaacaatgctctcaaaaaaatctaatgatgacttgattgcatacacaaataagataaaaacaaaattcccaggtaatgcattgttgaaggctataatagattatatagcatatatgaaaagtctgccaggtatgacaaatttcaaatatgataaattctgggatgagctattgtacaaacccaacccagcaaaggcttcaaaccttgctagaggaaaggagtcatcttacaacttcaaactagcaatttcatcaaaatctataaaaacctgcaagaatgttaaggatgttgcctgcttatcgccaaggtcaggtgctatatatgcttcaataattgcatgtggtgaacccaatggaccaagtgtgtatagaaaaccatcaggtggtgtattccaatctagcactgatcggtctatatactgcttactagatagccattgtctagaagaatttgaggctatcaaccaggaggaactggatgcagtaaaaaaatccaaatgttgggaaattgaatattctgatgtaaaacccctccaagaaggtgatgggactaaaagctgtagaatgaaagattctgggaactgcaatgttgcaactaacagatggccagtgatacaatgcgagaatgacaaattttactactcagagcttcaaaaagattatgacaaaactcaagatattggtcactattgcttaagccctggatgcactactgttcggtaccctattaatccaaagcatatctctaactgtaattggcaggtgagcagatccagcatagcgaagatagatgtgcacaatattgaagatattgaacagtataagaaggctataactcagaaacttcaaacaagcttatctctattcaagtatgcaaaaacaaaaaacttgccgcacatcaaaccaatttataaatatataactatagaaggaacagaaactgcagaaggtatagagagtgcatacatcgaatcagaggtacctgcactggctgggacatctattggattcaaaatcaattctaaagagggcaaacacttgctagatgttatagcatatgtaaaaagcgcctcatactcttcagtgtatgcaaaattgtactcaactggcccaacatcagggataaatactaaacatgatgaattgtgtactggcccatgcccggcaaatatcaatcatcaggttgggtggctaacatttgcaaaagagaggacaagctcatggggatgcgaagaatttggttgcctggctgtaagtgatgggtgtgtatttgggtcatgccaagatataataaaggaagaactatctgtctataggaaggagaccgaagaagtgactgatgtggaactatgtttaacattttcagacaaaacatactgtacaaacttaaaccctgttacccctattataacggacctatttgaggtacagttcaagactgtagagacttacagcttgcccagaattgttgctgtgcaaaatcatgagattaagattgggcaaataaatgatctaggagtttactctaagggttgtggaaatgttcaaaaggtcaatgggactgtttatggtaatggagttcccagatttgactacctatgccatttagctagcagaaaggaagtcattgttagaaaatgcttcgacaatgattaccaagcatgcaaatttcttcagagccctgctagttacagacttgaagaagacagtggcactgtgactataattgattacaaaaagatattaggcacaatcaagatgaaggcaattttaggagatgtcaaatataaaacatttgctgataatgtcgatataactgcagaagggtcatgcactggctgtatcaactgcttcgagaatatccattgcgaattaacgttgcatactacaattgaagccagctgcccaattaaaagctcatgcacagtattccatgacaggattcttgtgactccaagtgaacacaaatatgcattaaaaatggtgtgcacagaaaagccggggaacacactcacaattaaagtttgcaatactaagattgaagcatctatggcccttgtcgatgcaaagcctatcatagaactagcaccagttgatcagacagcatatataagagaaaaagatgaaaggtgtaaaacttggatgtgtagggtaagagatgaaggactgcaagtcatcttggagccatttaaaaatttatttgggtcttatattgggatattttacacatttattatatctataatggcattattggttatcatctatgtgctattgcctatatgctttaagttaagagatacccttagaaagcatgaagatgcatataagagagagatgaaaattagatag

SEQ ID NO: 4281 - RNA, 4326 nt, synthetic construct
  misc_feature 1..4326: note = derived and/or modified CDS sequence (wt) from LACV(LACV/00/WV-M (WV00-3178))__GU206148.1__GP
  source 1..4326: mol_type = other RNA
atgattcgcatactggtactgattgcaattacagctgcaagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaacaatgttgcaataaggaaatggctagtctctgattggcatgattgcaggcctaagaagatcattgggggacacatcaatgtaatagaagttggtgatgacctgtcgctccatactgaatcatatgtttgcagctcagattgtaccataggtgtggacaaagagactgcgcaggtcagacttcagacagataccacaaatcatttcgaaattgcaggcaccactgtgaagtcaggatggttcaaaagcacgacgtacataactcttgatcaaacctgcgaacatcttaaagtttcctgcggcccaaaatctgtacagttccatgcctgtttcaatcagcatatgtcttgtgttagatttttacacaggacaatattgcctggctctatagccaattccatatgtcagaatattgaaatcataattttagttacacttactctattaatcttcatattgttaagcattttaagtaagacatatatatgctatttattaatgcctatattcatccccatagcatatatatacggtataatttacaataagtcgtgtaaaaaatgcaaactatgcggcctagtgtatcatccatttacagagtgtggcacacattgtgtctgtggtgctcgctatgacacttcagatagaatgaaacttcacagagcttctggattgtgccctggttacaaaagcctaagagctgccagagtcatgtgcaagtcgaaagggcctgcatcaatattgtctataattactgcagtactggtcctaacctttgtgacaccaatcaactccatggttttgggggaaagtaaagaaacttttgaacttgaagagcttccagacgacatgttagaaatggcatcgaggataaattcttattatcttacctgtatcttaaattatgctgtaagctggggtcttgttatcattgggttgttgaccgggctgctatttaagaaatatcagcacagatttttaaatacttacgcaatgtattgtgaggaatgtgacatgtatcatgacaagtctgggttgaaaagacatggtgatttcaccaacaaatgcaggcagtgtacatgtggtcaatatgaagatgccgcagggttgatgacccacaggaaaacctacaactgcttagtgcagtacaaagcaaagtggatgatgaatttcctgataatttacatattcttaattttaatcaaagattctgctataattgtacaagctgctggaactgatttcaccacctgcctagagactgaaagtataaattggaactgtactgggccatttttgaacctcgggaattgtcaaaaacaacaaaagaaagaaccttacaccaacattgcaacccagttgaaggggttaaaggcaatttctgtgctagatatccctataataacagggattccggatgatattgcaggtgctttaagatatatagaagagagggaagatttccatgtccagctaactacagaatatgcaatgctgagcaggtactgtgactattacacccaattctcagacaactcaagatacagccagacaacgtggagagtgtacttaaggtctcatgattttgaggcatgtatactatatccaaatcagcatttttgcagatgtgtgaaaaatggtgagaagtgcagcagctccaattgggactttgccaatgaaatgaaggattattactctgggaaacaaacaaagtttgataaagacttaaatctagccctaacagctttgcaccatgccttcagggggacctcatctgcatatatagcaacaatgctctcaaaaaagtccaatgacgacttgattacatacacaaataagataaaaacaaaattcccaggtaatgcattgttgaaggctataatagattatatagcatatatgaaaagtttgccaggtatggcaaatttcaaatatgatgagttttgggatgaattattgtacaaacccaacccagcaaagacctcaaaccttgctagaggaaaagagtcaacttacaacttcaaactagcaatttcatcaaaatctataaaaacctgcaagaatgttaaggatgttgcctgcctatcgccgaggtcaggtgctatatatgcttcaataattgcgtgtggtgaacctaatgggccaagtgtgtatagaaaaccatcaggtggtgtattccaatctagtactgatcggtctatatactgcttactagatagccattgtctagaggagtttgaggctatcagtcaggaagagctggatgcagtaaaaaaatctaaatgttgggagactgaatatcctgaggtgaaacccctccaagaaagtgatgggactaaaagctgcagaatgaaagattctgggaactgcaacgttgcaactaacagatggccagtaatacaatgcgagaatgataaattttactactcagagcttcaaaaagattatgacaaaactcaagatattggtcattattgcttaagccctggatgtactactgttagataccctattaatccaaagcatatctccaactgtaattggcaggtaagcagatccagcatagcgaagatagatgtgcacaatattgaagacattgaacaatataagaaggctataactcaaaaacttcaaacaagcctatctctatttaagtatgcaaaaacaaaaaacttgccgcatatcaaaccaatttataaatatataactatagaaggaacagaaactgcagaaggtatagagagtgcatacattgaatcagaggtgcctgcattggctgggacatctatcgggttcaaaatcaattctaaagagggcaagcacttgctagatgttatagcatatgtaaaaagcgcctcatactcttcagtatatgcaaaattgtattcaactggcccaacatcagggataaatactaaacatgatgaattgtgtactggcccatgcccagcaaatatcaatcatcaaattgggtggctaacatttgcaaaagagaggacaagctcatggggatgcgaagagttcggttgcctggctgtaagtgatgggtgtgtatttgggtcatgccaagatataataaaagaagaactatctgtctataggaaagagaccgaagaagtgactgatgtagaactatgtttaacattttcagacaaaacatattgtacaaacttaaaccctgttacccctattataacagatctattcgaggtacagttcaaaactgtggagacttacagcttacccagaattgttgctgtgcaaaaccatgaaattaaaattgggcaaataaatgacctaggggtttactctaagggttgtggaaatgttcaaaaggtcaatggaactgtttatggtaatggagttcccagatttgattacttatgccatttagctagcagaaaggaagtcattgttagaaaatgcttcgacaatgattaccaagcatgcaaatttcttcaaagccctgctagttacagacttgaagaagacagtggcactgtgactataattgactacaagaagatattaggcacaatcaagatgaaggcaattttaggagatgtcaaatacaaaacatttgctgaaagtgtcgatataactgcagaagggtcatgcactggctgtatcaattgctttgagaatatccattgtgaattaacgttgcataccacaattgaagccagctgcccaattaaaagctcatgcacagtatttcatgacaggattcttgtgactccaaatgaacacaaatatgcattaaaaatggtgtgcacagaaagaccggggaatacactcacaattaaggtttgcaatactaagattgaggcttcaatgacccttgtcgatgcaaagcctatcatagaactagcaccagttgatcaaacagcatacataagagaaaaagatgaaaggtgtaaaacttggatgtgtagggtaagagacgaaggactgcaagtcatcttggagccatttaaaaatttatttggatcttatattgggatattttatacattcattatatctatagtggcattattggttatcatctatgtgctattgcctatatgctttaagttaagagacacacttagaaagcatgaagatgcatataagagagaaatgaaaattaggtag

SEQ ID NO: 4282 - RNA, 4326 nt, synthetic construct
  misc_feature 1..4326: note = derived and/or modified CDS sequence (wt) from LACV(LACV/03/NY-M (41030016))__GU206130.1__GP
  source 1..4326: mol_type = other RNA
atgatttacatactggtgctaattgcagttacggctgcaagtccagtgtatcaaaggtgtttccaagatggggctatagtgaagcaaaacccatccaaagaggcagtcacagaggtgtgcctaaaagatgatgtcagcatgatcaaaacagaggccagatacataagaaatgcaacaggggtcttttcaaacaatgttgcaataaggaaatggctggtctctgattggcacgactgcaggcccaaaaaaattgttgggggacatattaatgtaatagaggtaggtgatgatctgtcacttcacactgagtcatatgtttgcagcgcagactgtactataggtgtggataaagaaactgcgcaagttagacttcaaacagacactacaaatcattttgagattgcaggcactactgtgaagtcaggatggttcaaaagtacaacatatattactcttgatcaaacttgtgaacatctcaaagtttcctgcggtccgaaatccatacaattccatgcttgttttaaccagcacatgtcctgtgttagatttttacatagaacaatactgcctggttctatagctaactccatatgtcaaaatattgagatcataattttagtcacactcactctattaatcttcatattattaagtatcctaagcaagacttatatatgttacctattgatgcctgtatttattcctatagcatatgtgtatggtatcatttacaataagtcgtgtaaaaaatgcaaactatgtggcttggtataccacccatttacagagtgtggcacacattgtgtttgcggtgctcgctatgatacttctgatagaatgaaactgcatagagcttctgggctatgtcctggttataaaagcttaagagctgccagggttatgtgcaaatcaaaagggcctgcatcaatattatctataattactgcagtattggttttaacctttgtaacaccgatcaattctatggtcctgggggagagtaaagaggtcttcgagctggaggagcttccagatgatatgttggaaatggcactgaggataaatttttactatttcacctgcattctaaattatgctgtgagctggagtcttgttatcattggtctactgactgggctactattcaaaaggtaccagcataagtttttgaatatttatgcaatgtattgtgaagaatgcgatatgtatcatgacaaatctgggctgaaacggcatggtgacttcactaataagtgcaggcaatgtacatgcggccaatatgaggatgcaacagggttgatgacccataggaaaacctacaattgcctagtgcaatataaagcaaaatggataatgaacttcctgataatttacatatttttggtattaataaaggattctgctataatcgtgcaagctgctgggactgactttagctcctgcttagaaaccgaaagtataaattggaattgcaccgggccgttcttgaatctcgggaattgtcagaaacaacaaaagaaggagccctatactaacatcgcagctcagttgaaagggctgagggcaatttcagtgcttgatattcctatgataacagagattccagatgatattgcaagtgccttaagatatatagaagaaagggaggccttccacgtccaattgactgcagaatatgcaatgttgactaggtactgtgattattacacccaattttcagacaattcaggatacagccaaacaacatggagagtgtacttaagatcccatgattttgaggcatgtataatgtatccgaaccagcacttctgcaggtgtgtaaaaaatggtgagaagtgcagcagctccaattgggattttgccaacgaaatgaaggattattactccgggaaacaagcaaagtttgacaaagatttaaatctggctctaacagctttgcaccatgcttttaggggaacttcatctgcatacatagcagcaatgctttcaaaaaaatcaaacgatgacttgattacatatacaaacaagataaagacaaagtttccaggtaatgcattactaaaggctataatagattatatagcatacatgaagggcctaccgggtatggcaagctttaaacatgacgagttttgggatgaattattatacaaacctacaccaacaaaggccccgaatcttgctagagggagagagtcatcttataatttcaagctagcaatttcatcaaagtccataaaaacctgcaaaaatgttaaagatgttgcttgcttatcacctagatcaggtgccatatatgcttcaataatagcatgtggcgaacctaatggaccaagtgtatatagaaaaccatcaaacggtgtatttcaatctagcactgatcaatccatgtattgtcttttagatagccattgcttagaagaatttgaggctattagccaagaagaattggatgcagtgaaaaagtccaaatgttgggagatagaataccctgacataaagcctcttcaagaaagtgatgggaccaaaagctgcagaatgaaggattctgggaattgcaatgttgcaaccaacagatggccagtaatacaatgtgagaatgataaattctactactcagaactccagaaagattatgataagactcaagatatcggccattactgcttgagtcctgggtgcactaccgttcgctatcccatcaatccaaagcatatctctaattgcaattggcaggtgagtagatctagcatagcgaaaatagatgtgcataatattgaagatattgagcaatacaaaaaagctataactcaaaaactccaaacaagtctgtccctttttaaatatgctaaaacaaagaacttgccacacatcaaaccaatttataagtatataaccatagaagggactgaaactgcagaaggaatagagagcgcatacatcgagtcagaagtacctgcgttagctggaacatcaattggattcaaaatcaactccaaagagggtaagcacttactagatgttatagcatatgtaaaaagtgcctcatattcttcagtttacacaaagttatactcaactggaccaacatcaggcataaatacgaaacatgatgaattgtgcactggaccatgtccagcaaacattaatcatcaggttggatggctcacatttgcaaaggaaaggacaagctcatggggctgtgaggagtttggttgcctggctgtaagtgatggatgtgtatttggttcatgccaagatataataaaagaagagctatccgtctataggaaggagactgaagaagtgactgatgtagaattatgtttaacattttctgacaaaacatattgtacaaacttaaatcctgtcacccctattataacagatctgtttgaagtacaattcaaaactgtggagacttacagcttacctagaattgtcgctgtgcagaatcatgagatcaagattggacaaataaatgatttaggggtatattctaaaggatgcggaaacgttcaaaaagttaatgggactgtttatggcaatggggttcctagattcgattatttatgccatttagctagtagaaaagaagtcattgtcagaaaatgttttgacaatgactatcaagcatgtaaattcctccagagtcctgccagttacagacttgaggaggatagtgggactgtaactgtaattgattataaaaaaatactaggcacaattaagatgaaggcaatattgggagatgttaaatacaaaacgtttgctgacaatgttgacataactgcagaaggatcgtgcactggctgcatcaattgttttgaaaacattcactgtgaattaacattgcatacaacaattgaggctagttgcccgattaaaagctcatgcacagtattccatgacaggatacttgtgactccaaatgagcataagtatgcattaaaagtagtgtgcacagaaaagccaggaaatacactaacaatcaaggtttgtaacacaaagattgaagcttcaatggctcttgttgatgcaaaacctatcatagaattggcaccagttgaccagacggcatatataagggaaaaagatgaaagatgtaaaacatggatgtgcagagtaagagatgaaggattacaagttatcctagagccatttaaaaatttatttggttcctatattgggatattttacacatttataatatccatagtagcattattagtcatcatctacatcttattgcctatatgtttcaagctaagagatacccttaggaagcatgaagatgcatataagagagagatgaaaattagatag

SEQ ID NO: 4283 - RNA, 4326 nt, synthetic construct
  misc_feature 1..4326: note = derived and/or modified CDS sequence (wt) from LACV(LACV/06/NY(1)-M (06MS2900303))__GU206118.1__GP
  source 1..4326: mol_type = other RNA
atgatctacatactggtgctaattgcagttacggctgcaagtccggtgtatcaaaggtgtttccaagatggggctatagtgaagcaaaacccatccaaagaggcagtcacagaagtgtgcctaaaagatgatgtcagcatgatcaaaacagaggccagatatataagaaatgcaacaggagttttttcaaacaatgttgcaataaggaaatggctggtctctgattggcacgactgcaggcccaaaaaaattgttgggggacatattaatgtaatagaggttggtgatgatctgtcactccacactgagtcatatgtttgcagcgcagattgtactataggtgtagacaaggaaactgcgcaagttaggcttcaaacagacactacaaatcattttgagattgcaggcactactgtgaagtcaggatggttcaaaagcacaacatatattactcttgatcaaacttgtgaacatctcaaagtttcctgcggtccgaaatctatacaattccatgcttgttttaaccaacacatgtcctgtgttagatttttacatagaacgatactgcctggttctatagccaattccatatgtcagaatattgagatcataattttagtcacactcgctctattaatctttatattattaagtatcttaagcaagacttatatatgttacttattaatgcctgtattcattcctatagcatatgtgtatggtgtcatttataataagtcgtgtaaaaaatgcaaactatgtggtctagtttaccacccatttacagagtgtggcacacattgtgtttgcggtgctcgctatgatacttctgatagaatgaaactgcatagagcttctgggctatgtcctggttataaaagcttaagagctgccagagttatgtgcaaatcaaaagggcctgcatcaatattgtctataattactgcagtgttggtcttaacctttgtcacaccgatcaattccatggtcttgggggaaagtaaagaggtcttcgagcttgaggagcttccagatgatatgctggaaatggcactgaggataaatttttactatttcacctgcattctaaattatgctgtgagctggagtcttgttatcattggcctactgactgggctactattcaaaaggtaccagcataagtttttaaatatttatgcaatgtattgtgaagaatgcgatatgtaccatgacaaatctgggctgaaacgacatggtgacttcactaataagtgcaggcaatgcacatgcggccaatatgaggatgcaacggggttgatgacccataggaaaacctacaattgcctagtgcaatataaagcgaaatggataatgaatttcctgataatctacatatttttggtattaataaaggattctgctataatcgtgcaagctgctggaaccgactttagctcctgcttagaaaccgaaagtataaattggaattgcaccgggccattcttgaatctcgggaattgtcaaaaacaacaaaagaaggagccctatgctaacatcgcagctcagctaaaagggctgaaggcaatttcagtgcttgatattcctatgataacagaaatcccagatgatattgcaagtgctttaagatatatagaagagagggaggctttccacgtccaattgactgcagaatatgcaatgttgactaggtactgtgattattatacccaattttcagacaattcagggtacagccaaacaacatggagagtgtacttgagatcccatgactttgaggcgtgtataatgtatccaaaccagcacttttgcagatgtgtaaaaaatggtgagaagtgcagcagctccaattgggattttgccaacggaatgaaggactattactccggaaaacaagcaaagtttgacaaagatttgaatctggctctaacagctctgcaccatgcttttaggggaacttcatctgcatacatagcaacaatgctttcaaaaaaatcaaacgatgacttgattgcatatacaaacaagataaagacaaagttcccaggcaatgcattactaaaagctataatagattatatagcatacatgaagggcttaccaggtatggcaaactttaaacatgacgagttttgggatgaattattgtacaaacctacaccaacaaaggccccgaatcttgctagagggagagaatcatcttataatttcaagctagcaatttcatcaaagtccataaaaacctgcaaaaatgttaaagatgttgcttgcttatcacccagatcaggtgccatatatgcttcaataatagcatgtggcgaacctaatggaccaagtgtatatagaaaaccattaaatggtgtatttcaatctagtactgaccaatcaatgtattgtctgttagacagccattgcttagaagaatttgaggctatcagccaagaagaattggatgcagtgaaaaagtccaaatgttgggagatagaatactctgacataaagcctcttcaagaaagtgatggaaccaaaagctgcagaatgaaggattctggaaattgcaatgttgcaaccaacagatggccagtgatacaatgtgaaaatgataaattctactattcagaactccagaaagattatgataagactcaagatattggccattactgcttaagtcctgggtgcactactgttcgctaccccatcaatccaaagcatatctctaattgcaattggcaggtaagtagatctagcatagcgaaaatagatgtgcataatattgaagatattgagcagtacaaaaaagctataactcaaaaactccaaacaagtctgtccctttttaaatatgctaaaacaaagaacttgccacacatcaaaccaatttataagtatataaccatagaagggaccgaaactgcagaaggaatagagagcgcatacatcgagtcagaagtacctgcattagctggaacatcaattggattcaaaatcaactccaaagagggtaagcacttactagatgttatagcatatgtaaaaagtgcctcatattcttcagtgtacacaaagttatactcaactggaccaacatcaggcataaatacgaaacatgatgaattgtgcaccggaccatgtccagcaaacattaatcatcaggttggatggctcacatttgcaaaggagaggacaagctcatggggctgtgaagagtttggttgcctggctgtaagtgatggatgtgtatttggttcgtgccaagatataataaaagaagagctatccgtctataggaaagaaactgaagaagtgactgatgtagaattatgcttaacattttctgacaaaacatattgtacaaacttaaacccagtcactcctatcataacagacctgtttgaggtacagttcaagactgtagagacttacagcttacctagaattgtcgctgtacagaatcatgagatcaagattggacaaataaatgatttaggggtatattctaaaggatgcggaaatgttcaaaaagtcaatgggactgtttatggcaatggagttcctagattcgattatttatgccatttagctagtagaaaagaagtcattgttagaaaatgttttgacaatgattatcaggcatgtaaattcctccagagtcctgccagttacagacttgaggaggatagtgggactgtaactgtaatcgattataaaaaaatactaggtacaattaagatgaaggcaatattgggagatgttaaatacaaaacgtttgctgataatgttgacataactgcagaaggatcatgcactggctgcatcaattgttttgaaaacattcactgtgaattaacattgcataccacaattgaggctagttgcccgattaaaagctcatgcacagtgttccatgacaggatactcgtgactccaaatgagcataagtatgcattaaaagtagtatgcacagaaaagccaggaaatacactaacaatcaaggtttgtaacactaagattgaagcttcaatggccctcgttgatgcaaaacctatcatagaattagcaccagttgaccaaacggcatatataagggaaaaagacgaaagatgtaagacttggatgtgcagagtaagagatgaaggattacaagttatcttagagccatttaaaaatttatttggttcctatattgggatattttacacatttataatatctatagtaacattattggtcatcatttatatcttattgcctatatgtttcaaggtaagagatactcttaggaagcatgaagatgcatataagagagagatgaaaattagatag

SEQ ID NO: 4284 - RNA, 4326 nt, synthetic construct
  misc_feature 1..4326: note = derived and/or modified CDS sequence (wt) from LACV(LACV/06/NY(2)-M (06MS350140))__GU206109.1__GP
  source 1..4326: mol_type = other RNA
atgatctacatactggtgctaattgcagttacggctgcaagtccggtgtatcaaaggtgtttccaagatggggctatagtgaagcaaaacccatccaaagaggcagtcacagaagtgtgcctaaaagatgatgtcagcatgatcaaaacagaggccagatatataagaaatgcaacaggagttttttcaaacaatgttgcaataaggaaatggctggtctctgattggcacgactgcaggcccaaaaaaattgttgggggacatattaatgtaatagaggttggtgatgatctgtcactccacactgagtcatatgtttgcagcgcagattgtactataggtgtagacaaggaaactgcgcaagttaggcttcaaacagacactacaaatcattttgagattgcaggcactactgtgaagtcaggatggttcaaaagcacaacatatattactcttgatcaaacttgtgaacatctcaaagtttcctgcggtccgaaatctatacaattccatgcttgttttaaccaacacatgtcctgtgttagatttttacatagaacgatactgcctggttctatagccaattccatatgtcagaatattgagatcataattttagtcacactcgctctattaatctttatattattaagtatcttaagcaagacttatatatgttacttattaatgcctgtattcattcctatagcatatgtgtatggtgtcatttataataagtcgtgtaaaaaatgcaaactatgtggtctagtttaccacccatttacagagtgtggcacacattgtgtttgcggtgctcgctatgatacttctgatagaatgaaactgcatagagcttctgggctatgtcctggttataaaagcttaagagctgccagagttatgtgcaaatcaaaagggcctgcatcaatattgtctataattactgcagtgttggtcttaacctttgtcacaccgatcaattccatggtcttgggggaaagtaaagaggtcttcgagcttgaggagcttccagatgatatgctggaaatggcactgaggataaatttttactatttcacctgcattctaaattatgctgtgagctggagtcttgttatcattggcctactgactgggctactattcaaaaggtaccagcataagtttttaaatatttatgcaatgtattgtgaagaatgcgatatgtaccatgacaaatctgggctgaaacgacatggtgacttcactaataagtgcaggcaatgcacatgcggccaatatgaggatgcaacggggttgatgacccataggaaaacctacaattgcctagtgcaatataaagcgaaatggataatgaatttcctgataatctacatatttttggtattaataaaggattctgctataatcgtgcaagctgctggaaccgactttagctcctgcttagaaaccgaaagtataaattggaattgcaccgggccattcttgaatctcgggaattgtcaaaaacaacaaaagaaggagccctatgctaacatcgcagctcagctaaaagggctgaaggcaatttcagtgcttgatattcctatgataacagagatcccagatgatattgcaagtgctttaagatatatagaagagagggaggctttccacgtccaattgactgcagaatatgcaatgttgactaggtactgtgattattatacccaattttcagacaattcagggtacagccaaacaacatggagagtgtacttgagatcccatgactttgaggcgtgtataatgtatccaaaccagcacttttgcagatgtgtaaaaaatggtgagaagtgcagcagctccaattgggattttgccaacgaaatgaaggactattactccggaaaacaagcaaagtttgacaaagatttgaatctggctctaacagctctgcaccatgcttttaggggaacttcatctgcatacatagcaacaatgctttcaaaaaaatcaaacgatgacttgattgcatatacaaacaagataaagacaaagttcccaggcaatgcattactaaaagctataatagattatatagcatacatgaagggcttaccaggtatggcaaactttaaacatgacgagttttgggatgaattattgtacaaacctacaccaacaaaggccccgaatcttgctagagggagagaatcatcttataatttcaagctagcaatttcatcaaagtccataaaaacctgcaaaaatgttaaagatgttgcttgcttatcacccagatcaggtgccatatatgcttcaataatagcatgtggcgaacctaatggaccaagtgtatatagaaaaccattaaatggtgtatttcaatctagtactgaccaatcaatgtattgtctgttagacagccattgcttagaagaatttgaagctattagccaagaagaattggatgcagtgaaaaagtccaaatgttgggagatagaataccctgacataaagcctcttcaagaaagtgatggaaccaaaagctgcagaatgaaggattctggaaattgcaatgttgcaaccaacagatggccagtgatacaatgtgaaaatgataaattctactattcagaactccagaaagattatgataagactcaagatattggccattactgcttaagtcctgggtgcactactgttcgctaccccatcaatccaaagcatatctctaattgcaattggcaggtaagtagatctagcatagcgaaaatagatgtgcataatattgaagatattgagcagtacaaaaaagctataactcaaaaactccaaacaagtctgtccctttttaaatatgctaaaacaaagaacttgccacacatcaaaccaatttataagtatataaccatagaagggaccgaaactgcagaaggaatagagagcgcatacatcgagtcagaagtacctgcattagctggaacatcaattggattcaaaatcaactccaaagagggtaagcacttactagatgttatagcatatgtaaaaagtgcctcatattcttcagtgtacacaaagttatactcaactggaccaacatcaggcataaatacgaaacatgatgaattgtgcaccggaccatgtccagcaaacattaatcatcaggttggatggctcacatttgcaaaggagaggacaagctcatggggctgtgaagagtttggttgcctggctgtaagtgatggatgtgtatttggttcgtgccaagatataataaaagaagagctatccgtctataggaaagaaactgaagaagtgactgatgtagaattatgcttaacattttctgacaaaacatattgtacaaacttaaacccagtcactcctatcataacagacctgtttgaggtacagttcaagactgtagagacttacagcttacctagaattgtcgctgtacagaatcatgagatcaagattggacaaataaatgatttaggggtatattctaaaggatgcggaaatgttcaaaaagtcaatgggactgtttatggcaatggagttcctagattcgattatttatgccatttagctagtagaaaagaagtcattgttagaaaatgttttgacaatgattatcaggcatgtaaattcctccagagtcctgccagttacagacttgaggaggatagtgggactgtaactgtaatcgattataaaaaaatactaggtacaattaagatgaaggcaatattgggagatgttaaatacaaaacgtttgctgataatgttgacataactgcagaaggatcatgcactggctgcatcaattgttttgaaaacattcactgtgaattaacattgcataccacaattgaggctagttgcccgattaaaagctcatgcacagtgttccatgacaggatactcgtgactccaaatgagcataagtatgcattaaaagtagtatgcacagaaaagccaggaaatacactaacaatcaaggtttgtaacactaagattgaagcttcaatggccctcgttgatgcaaaacctatcatagaattagcaccagttgaccaaacggcatatataagggaaaaagacgaaagatgtaagacttggatgtgcagagtaagagatgaaggattacaagttatcttagagccatttaaaaatttatttggttcctatattgggatattttacacatttataatatctatagtaacattattggtcatcatttatatcttattgcctatatgtttcaagctaagagatactcttaggaagcatgaagatgcatataagagagagatgaaaattagatag

SEQ ID NO: 4285 - RNA, 4326 nt, synthetic construct
  misc_feature 1..4326: note = derived and/or modified CDS sequence (wt) from LACV(LACV/06/NY(3)-M (06MS270036))__GU206121.1__GP
  source 1..4326: mol_type = other RNA
atgatctacatactggtgctaattgcagttacggctgcaagtccggtgtatcaaaggtgtttccaagatggggctatagtgaagcaaaacccatccaaagaggcagtcacagaagtgtgcctaaaagatgatgtcagcatgatcaaaacagaggccagatatataagaaatgcaacaggagttttttcaaacaatgttgcaataaggaaatggctggtctctgattggcacgactgcaggcccaaaaaaattgttgggggacatattaatgtaatagaggttggtgatgatctgtcactccacactgagtcatatgtttgcagcgcagattgtactataggtgtagacaaggaaactgcgcaagttaggcttcaaacagacactacaaatcattttgagattgcaggcactactgtgaagtcaggatggttcaaaagcacaacatatattactcttgatcaaacttgtgaacatctcaaagtttcctgcggtccgaaatctatacaattccatgcttgttttaaccaacacatgtcctgtgttagatttttacatagaacgatactgcctggttctatagccaattccatatgtcagaatattgagatcataattttagtcacactcgctctattaatctttatattattaagtatcttaagcaagacttatatatgttacttattaatgcctgtattcattcctatagcatatgtgtatggtgtcatttataataagtcgtgtaaaaaatgcaaactatgtggtctagtttaccacccatttacagagtgtggcacacattgtgtttgcggtgctcgctatgatacttctgatagaatgaaactgcatagagcttctgggctatgtcctggttataaaagcttaagagctgccagagttatgtgcaaatcaaaagggcctgcatcaatattgtctataattactgcagtgttggtcttaacctttgtcacaccgatcaattccatggtcttgggggaaagtaaagaggtcttcgagcttgaggagcttccagatgatatgctggaaatggcactgaggataaatttttactatttcacctgcattctaaattatgctgtgagctggagtcttgttatcattggcctactgactgggctactattcaaaaggtaccagcataagtttttaaatatttatgcaatgtattgtgaagaatgcgatatgtaccatgacaaatctgggctgaaacgacatggtgacttcactaataagtgcaggcaatgcacatgcggccaatatgaggatgcaacggggttgatgacccataggaaaacctacaattgcctagtgcaatataaagcgaaatggataatgaatttcctgataatctacatatttttggtattaataaaggattctgctataatcgtgcaagctgcaggaaccgactttagctcctgcttagaaaccgaaagtataaattggaattgcaccgggccattcttgaatctcgggaattgtcaaaaacaacaaaagaaggagccctatgctaacatcgcagctcagctaaaagggctgaaggcaatttcagtgcttgatattcctatgataacagagatcccagatgatattgcaagtgctttaagatatatagaagagagggaggctttccacgtccaattgactgcagaatatgcaatgttgactaggtactgtgattattatacccaattttcagacaattcagggtacagccaaacaacatggagagtgtacttgagatcccatgactttgaggcgtgtataatgtatccaaaccagcacttttgcagatgtgtaaaaaatggtgagaagtgcagcagctccaattgggattttgccaacggaatgaaggactattactccggaaaacaagcaaagtttgacaaagatttgaatctggctctaacagctctgcaccatgcttttaggggaacttcatctgcatacatagcaacaatgctttcaaaaaaatcaaacgatgacttgattgcatatacaaacaagataaagacaaagttcccaggcaatgcattactaaaagctataatagattatatagcatacatgaagggcttaccaggtatggcaaactttaaacatgacgagttttgggatgaattattgtacaaacctacaccaacaaaggccccgaatcttgctagagggagagaatcatcttataatttcaagctagcaatttcatcaaagtccataaaaacctgcaaaaatgttaaagatgttgcttgcttatcacccagatcaggtgccatatatgcttcaataatagcatgtggcgaacctaatggaccaagtgtatatagaaaaccattaaatggtgtatttcaatctagtactgaccaatcaatgtattgtctgttagacagccattgcttagaagaatttgaagctattagccaagaagaattggatgcagtgaaaaagtccaaatgttgggagatagaatactctgacataaagcctcttcaagaaagtgatggaaccaaaagctgcagaatgaaggattctggaaattgcaatgttgcaaccaacagatggccagtgatacaatgtgaaaatgataaattctactattcagaactccagaaagattatgataagactcaagatattggccattactgcttaagtcctgggtgcactactgttcgctaccccatcaatccaaagcatatctctaattgcaattggcaggtaagtagatctagcatagcgaaaatagatgtgcataatattgaagatattgagcagtacaaaaaagctataactcaaaaactccaaacaagtctgtccctttttaaatatgctaaaacaaagaacttgccacacatcaaaccaatttataagtatataaccatagaagggaccgaaactgcagaaggaatagagagcgcatacatcgagtcagaagtacctgcattagctggaacatcaattggattcaaaatcaactccaaagagggtaagcacttactagatgttatagcatatgtaaaaagtgcctcatattcttcagtgtacacaaagttatactcaactggaccaacatcaggcataaatacgaaacatgatgaattgtgcaccggaccatgtccagcaaacattaatcatcaggttggatggctcacatttgcaaaggagaggacaagctcatggggctgtgaagagtttggttgcctggctgtaagtgatggatgtgtatttggttcgtgccaagatataataaaagaagagctatccgtctataggaaagaaactgaagaagtgactgatgtagaattatgcttaacattttctgacaaaacatattgtacaaacttaaacccagtcactcctatcataacagacctgtttgaggtacagttcaagactgtagagacttacagcttacctagaattgtcgctgtacagaatcatgagatcaagattggacaaataaatgatttaggggtatattctaaaggatgcggaaatgttcaaaaagtcaatgggactgtttatggcaatggagttcctagattcgattatttatgccatttagctagtagaaaagaagtcattgttagaaaatgttttgacaatgattatcaggcatgtaaattcctccagagtcctgccagttacagacttgaggaggatagtgggactgtaactgtaatcgattataaaaaaatactaggtacaattaagatgaaggcaatattgggagatgttaaatacaaaacgtttgctgataatgttgacataactgcagaaggatcatgcactggctgcatcaattgttttgaaaacattcactgtgaattaacattgcataccacaattgaggctagttgcccgattaaaagctcatgcacagtgttccatgacaggatactcgtgactccaaatgagcataagtatgcattaaaagtagtatgcacagaaaagccaggaaatacactaacaatcaaggtttgtaacactaagattgaagcttcaatggccctcgttgatgcaaaacctatcatagaattagcaccagttgaccaaacggcatatataagggaaaaagacgaaagatgtaagacttggatgtgcagagtaagagatgaaggattacaagttatcttagagccatttaaaaatttatttggttcctatattgggatattttacacatttataatatctatagtaacattattggtcatcatttatatcttattgcctatatgtttcaagctaagagatactcttaggaagcatgaagatgcatataagagagagatgaaaattagatag

SEQ ID NO: 4286 - RNA, 4326 nt, synthetic construct
  misc_feature 1..4326: note = derived and/or modified CDS sequence (wt) from LACV(LACV/65/OH-M (W17258))__GU206124.1__GP
  source 1..4326: mol_type = other RNA
atgattcgcatactggtgctgattgcagttacagctgcaaacccagtgtatcaaaggtgtttccaagatggggctatagtgaagcaaaacccatccaaagaagcagtcacagaagtgtgcctgaaagatgatgttagcatgatcaaaacagaagccaggtatataagaaatgcaacaggggttttttcaaacaatgttgcaataaggaaatggctagtctctgattggcatgattgcaggcctaagaagatcattgggggacacatcaatgtgatagaagttggtgatgacctatcgctgcatactgaatcatatgtttgcagcgcagattgtacaataggtgtagacaaagagactgcgcaggtcagacttcagacagatactacaaatcattttgaaattgcaggtactactgtgaagtcaggatggttcaaaagcacgacatatataactcttgatcaaacctgcgaacaccttaaagtttcctgtggcccaaaatctgtacaattccatgcctgcttcaatcagcatatgtcttgcgtcagatttttacacagaacagtattgcctggctccattgccaattccatatgtcagaatattgaaatcataattttagttacacttactctattaatctttatattgttaagtattttaagtaagacttatatatgttatttattaatgcctatatttatccccatagcatatgtatacggtataatttataataagtcgtgcaaaaaatgcaaactatgcggcctagtgtatcatccattcacagagtgtggcacacattgtgtctgtggtgcccgctatgatacttcagatagaatgaaactgcacagagcttctggattgtgccctggttataaaagcctaagagctgccagagttatgtgcaagtcgaaagggcctgcatcaatattatctataattactgcagtactggtcttaacctttgtaacaccaatcaactctatggttttaggggaaagtaaagaaacgtttgaacttgaagagcttccagatgacatgttggaaatggcatcgaggatagattcttattatttcacctgcatcttgaattatgctgtaagctggggtcttgttatcattgggttgttgaccggactgctatttaagaaataccaacacagatttttaaatgtttatgcaatgtactgtgaggaatgtgacatgtatcatgacaagtctgggttgaaaagacatggtgacttcaccaacaaatgcaggcagtgtacatgtggccaatatgaagatgccacaggcttgatggcccacaggaaaacctataactgcttagtgcagtacaaagcaaagtggatgatgaatttcctaataatttacatatttttaattttaatcaaagattctgctatagttgtacaagctgctggaaccgatttcaccacctgcctagagactgagaatataaactggaactgcactgggccgtttttgaacctcgggaattgtcaaaagcagcaaaagaaggaaccttacaccaacattgcaacccaattaaagggcctaaaggcaatttccgtactagatatccctataataacagggattccggatgatattgcaggtgctttaagatatatagaagaaaaggaagatttccatgtccagctaactatagaatacgcaatgctgagtaaatactgtgactattacacccaattctcagataactcaggatacagtcagacaacatggagggtgtacttaaggtcccatgattttgaggcatgtatactatatccaaatcagcatttttgcagatgtgtgaaaaatggtgaaaagtgcagcagctccaattgggattttgccaatgaaatgaaggatttttactctgggaaacaaacaaagtttgataaagacttaaatctagccctaacagctttgcatcatgccttcagggggacctcatctgcatatatagcaacaatgctctcaaaaaagtccaatgatgatttgattgcatacacaaataagataaaaacaaaatttccaggtaatgcattgttgaaggctataatagattatatagcatatatgaaaagtttaccaggtatggcaaatttcaaatatgatgagttctgggatgaattattgtacaaacccaacccagcaaaagcctcaaaccttgctagaggaaaggagtcatcttacaactttaaactagcaatttcatcaaaatctataaaaacctgcaagaatgttaaggatgtcgcctgcttatcaccaaggtcaggtgctatatatgcttcaataattgcttgcggcgaacccaatgggccaagtgtgtatagaaaaccatcaggtggtgtattccaatctagcactgatcggtctatatactgcttactagatagccattgtctagaagagtttgaggctatcagccaggaagagctggatgcagtgaaaaaatccaaatgttgggaaattgaatatcctgacgtaaaacccctccaagaaggtgatggaactaaaagctgtaggatgaaagattctgggaactgcaatgttgcaactaacagatggccagtgatacaatgcgagaatgacaaattttattactcagagcttcaaaaagattatgataaaactcaagatattggtcattattgcttaagccctggatgtactactgtccggtaccctattaatccaaagcatatctctaactgtaattggcaggtaagcagatccagtatagcgaagatagacgtgcacaatattgaagacattgaacagtataagaaggctataactcaaaaactccaaacaagcctatctctattcaagtatgcaaaaacaaaaaacttgccacacatcaaaccaatttataaatatataactatagaaggaacagaaactgcagaaggtatagagagtgcatacattgaatcagaggtgcctgcattagctgggacatctatcgggttcaaaatcaattctaaagagggcaaacacttactagatgttatagcatatgtaaaaagcgcctcatactcttcagtgtatgcaaaattgtactctactggcccaacatcaggaataaacactaaacatgatgaattgtgtactggcccatgcccagcgaatatcaatcatcaggttggatggctaacatttgcaagagagaggacaagttcatggggatgtgaagaatttggttgcctagctgtaagtgatgggtgtgtatttgggtcatgccaagatataataaaagaagaactatctgtctataggaaggagaccgaagaagtgactgatgtagaactatgtttaacattttcagataaaacatattgtacaaacttgaaccctgttactcctattataacagatctatttgaagtacagttcaaaactgtagagacttacagcttgcccagaattgttgctgtgcaaaaccatgagattaagattgggcaaataaatgacctaggagtttactctaaaggttgtggaaatgttcaaaaggtcaatggaactgtttatggcaatggagttcccagatttgattacttatgccacttagctagcagaaaggaagtcattgttagaaaatgcttcgacaatgattaccaggcatgcaaattccttcaaagccctgctagttacagacttgaggaagacagtggtactgtaactataattgattacaagaagatattaggcacaatcaagatgaaggcaattttaggagatgtcaaatataagacatttgctgacagtgtcgatataactgcagaagggtcatgcactggctgtatcaattgctttgagaatattcattgtgaattaacgttgcataccacaattgaagctagctgcccaatcaaaagctcgtgcacagtattccatgacaggattcttgtgactccaaatgaacacaaatatgcattaaaaatggtgtgcacagaaaagccaggaaatacactcacaattaaagtttgcaacactaagattgaggcatctatggcccttgtcgatgcaaagcctatcatagaactagcaccagttgatcagacagcatacataagagaaaaggatgaaaggtgtaaaacttggatgtgtagggtaagagatgaaggattgcaagtcatcctggagccattcaaaaatttgtttggatcttatattgggatattttacacatttattatatctatagtggcattattggttatcatctatgtgctattgcctatatgctttaagttaagagatacccttagaaagcatgaagatgcatataagagagagatgaaaattagatag

SEQ ID NO: 4287 - RNA, 4326 nt, synthetic construct
  misc_feature 1..4326: note = derived and/or modified CDS sequence (wt) from LACV(LACV/67/NY-M (67-8109))__GU206115.1__GP
  source 1..4326: mol_type = other RNA
atgatttgtatattggtgctaattacagttgcagctgcaagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtacaatttacaataagtcgtgcaaaaaatgcaaattatgtggcttagtgtatcacccattcacagagtgtggcacacattgtgtctgtggtgcccgctatgatacttcagatagaatgaaactgcatagagcttctggattgtgccctggttataaaagcctaagagctgccagagtcatgtgcaagtcgaaagggcctgcatcaatattgtctataattactgcggtactggtcttaacctttgtgacaccaatcaactccatggttttaggagagagtaaagaaacctttgaacttgaagatcttccagacgacatgttggaaatggcatcgagaataaattcttattatcttacctgtatcttgaattatgctgtaagctggggtcttgttatcattggattgttgatcgggctgctttttaagaaataccagcacagattcttaaatgtttacgcaatgtactgtgaagaatgtgacatgtatcatgacaagtctgggttgaaaagacatggtgatttcaccaacaaatgcagacagtgcacatgtggtcaatatgaagatgctgcaggtttgatggctcacaggaaaacctataactgcttagtgcagtacaaagcaaagtggatgatgaacttcctgataatttacatattcttaattttgatcaaagattctgctatagttgtacaagctgctggaactgacttcaccacctgcctagagactgagagtataaattggaactgcactgggccatttttgaacctcgggaattgccaaaagcaacaaaagaaagaaccttacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagtaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaatcgggactttgccaatgaaatgaaagattattactctgggaaacaaacaaagtttgacaaggatttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgaattctgggatgaattattgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcagtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaaactcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacaagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcccagaattgttgctgtgcaaaaccatgagattaagattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaattccttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaaattgaagcatctatggcccttgtcgatgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagcattattggttattatctatgtactactacctatatgctttaagttaagggatacccttagaaagcatgaagatgcatataagagagagatgaaaattagatag

SEQ ID NO: 4288 - RNA, 4326 nt, synthetic construct
  misc_feature 1..4326: note = derived and/or modified CDS sequence (wt) from LACV(LACV/74/NY-M (74-32813))__GU206142.1__GP
  source 1..4326: mol_type = other RNA
atgattcgcatgctggtgctgattgtagttacggctgcaagcccagtgtatcagagatgtttccaagatggggctatagtgaagcaaaacccatccaaagaggcagtcacagaagtgtgcctaaaagatgatgttagcatgatcaaaacagaggccaggtatgtaaaaaatgcaacaggagttttctcaaacaatgttgcaataaggaagtggttagtctctgattggcatgactgcagacctaagaagatcgttggggggcacatcaatgtaatagaagttggtgatgacctgtcgcttcatactgaatcatatgtttgcagtgcagattgtaccataggtgtagacaaggaaacagcacaggtcagacttcaaacagataccacaaaccattttgaaatagcaggtactactgtgaagtcaggatggttcaaaagcacaacatatataactctagatcagacctgtgaacacctcaaagtttcctgcggcccaaaatctgtacagttccatgcctgcttcaatcagcatatgtcctgtgtcagattcttacacaggacaatattgcctggttccatagctaattccatatgtcagaatattgaaatcataattttagttacacttaccttattaatcttcatactgttaagcattttaagtaagacttatatatgttatttgttaatgcccatattcatccccatagcatatatgtacggtgtaatttacaataagtcatgcaaaaagtgcaagctatgcggcctagtgtatcatccattcacagagtgtggcacgcattgtgtctgtggtgctcgctatgatacttccgatagaatgaaactacacagagcttctggattgtgccctggttataaaagcctaagagctgccagagtcatgtgcaaatcaaaagggcctgcatcaatattgtctataattactgcagtgctggttctaacctttgtgacaccaatcaactccatggttttaggggaaagtaaggaaacctttgaacttgaagagcttccagacgacatgctggaaatggcattaaggataaattcttattacttcacctgtatcttaaattatgctgtaagctggggtcttattattgctggattattggttggactgatatttaaaaaataccagcataggttcttaaatatttatgcaatgtactgtgaagaatgtaacatgtatcatgacaaatctgggctgaagagacacggtgacttcaccaacaaatgtagacaatgcacatgtggtcaatatgaagatgctacaggtttgataactcacaggaaaacctataactgtttagtgcagtacaaagcaaagtggatgatgaatttcctaataatttacatattcttaattttgatcaaagattctgccatagttgtacaagctactgggacagatttcaccacctgcctagagactgagagtataaattggaactgcactgggccattcctaaaccttggaaactgccaaaagcaacaaaagaaagaaccttacacaaatattgcaacccagctaaaagggctaaaagcaatttccgtactagatatccctataattacgagtatcccagacgacattgcaggtgctttaagatatatagaggaaaaggaagatttccatgtccaactaactacagaatatgcaatgctgagtaagtactgtgactattatacccagttctcagataactcaggatatagtcaaacaacatggagagtatacttgagatctcatgattttgaggcatgcatactatatccaaatcagcatttctgcaagtgtgtgaaaaatggtgaaaagtgtagcagctccaattgggactttgccaatgaaatgaagaattattactctgggaaacaagcaaaatttgataaagatttaaacctagctctaacagctttgcatcatgccttcagagggacctcatctgcatatatagcagcaatgctctcaaagaagtccaatgatgatttgattgcatatacaaataagataaaagcaaaatttccaggtaatgcactattgaaggctataatagattatatagcatacatgaaaggtttgccagaaatggcaaatttcaaatatgacgagttctgggatgaattattgtacaaacctaacccagcaaaagcctcaaatcttgctaggggaaaagagtcatcctacaacttcaagttagcaatttcgtcaaaatctataaaaacctgtaagaatgttaaggatgttgcctgcttatcaccaaggtcaggtgctatatactcttcaataattgcatgcggtgaacccaacgggccaagtgtgtatagaaaaccatcaggtggtgtatttcaatccagtactgaccggtctatatattgtttgctagacagccattgtctagaggagtttgaggctatcagtcaagaggaactggatgcagtaaaaaaatccaagtgttgggagattgaatatcctgacgtaagacccctccaagaaagtgacggggctaaaagctgtagaatgaaagattctgggaattgtaatgttgcaactaacagatggccagtaatgcaatgcgagaatgacaaattttattattcagaacttcaaaaagattatgacaaaactcaagatattggtcattattgcttaagccctggatgtaccactatccggtaccctattaatccaaagcatatctctaattgtaattggcaggtaagcagatccagcatagcaaagatagacgtacataatgttgaagatattgaacaatataaaaaggctataacccaaaagcttcaaacaagcttgtctctattcaagtatgcaaaaacaaaaaatctgccgcacattaagccaatttataaatacataactatagaaggaacagaaactgcagaagggatagagagcgcatatattgaatcagaagtgcctgcattggctgggacatctgttgggttcaaaattaattctaaagagggcaaacacttgctagatgttatagcatatgtaaaaagtgcatcgtactcttcagtatatgcgaaattatactcaactggcccaacatcaggaataaatactaaacatgatgaattgtgtactggcccatgcccagcaaatatcaatcatcaagttgggtggctcacatttgcaagagagaggacaagttcatggggatgcgaagagtttggttgcctggctgtaagtgatgggtgcgtgttcgggtcatgccaagacataataaaagaagaactatctgtctataggaaggagaccgaagaagtgaccaatgttgagctatgtttaacattttcagacaagacatattgcacaaacttaaaccctgttacccctattataacagatctatttgaggtacagtttaaaactgtagagacttacagcttgcccagaattgttgccgtgcaaaaccatgagattaagattgggcaaataaatgatctaggggtttactctaagggatgtgggaatgttcaaaaggttaatggaactgtttatggcaatggggtccccagatttgattacttatgtcacttagctagtagaaaggaagtcatcgttagaaaatgctttgataatgattaccaagcatgcaaattccttcaaagccctgctagttatagacttgaagaagacagcggtactgtgactataattgattataagaaaatattaggcacaatcaagatgaaggcaattttaggagatgtcaaatacaaaacatttgctgacagtgttgatataactgcagaagggtcgtgtgctggctgtatcaattgctttgagaatattcattgtgaattaacgctgcataccacaattgaagccagctgcccaattaaaagttcttgcacagtattccatgataggattcttgtaaccccaaatgaacacaaatatgcattaaaaatggtatgcacagaaaagccagggaatacactcaccattaaagtctgcaatactagaattgaagcttcaatggcccttgttgatgcaaagcctatcatagaattagcaccagttgatcagacggcatatataagagaaaaagatgaaagatgcaaaacttggatgtgtagggtaagggatgaagggctgcaggttatcttagagccatttaaaaacttgtttggatcttatattgggatattttacacatttattatatctataatagcattgttggttatcatctatgtactactgcctatatgcttcaaattaagggatacccttagaaagcacgatgatgcatataagagagagatgaaaattagataa

SEQ ID NO: 4289 - RNA, 4326 nt, synthetic construct
  misc_feature 1..4326: note = derived and/or modified CDS sequence (wt) from LACV(LACV/93/MO-H)__GU206139.1__GP
  source 1..4326: mol_type = other RNA
atgatttgtatattggtgctgattacagttgcagctgcaagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaacaatgtcgcaataaggaaatggctagtctctgattggcatgattgcaggcctaagaagatcgttgggggacacatcaatgtaatagaagttggtgacgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgtggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaattgcacagagcttctggattatgccctggttataaaagcctaagagctgccagagtcatgtgcaagtcgaaagggcctgcatcaatattgtctataattactgcggtactagtcttaacctttgtgacaccaatcaactccatggttttaggagagagtaaagaaacctttgaacttgaagatcttccagacgacatgttggaaatggcatcgagaataaattcttattatctcacctgtatcttgaattatgctgtaagctggggtcttgttatcattggattgttgatcgggctgctatttaagaaataccagcacagattcttaaatatttacgcaatgtactgtgaagaatgtgacatgtatcatgacaagtctgggttgaaaagacatggtgatttcaccaacaaatgcagacagtgcacatgtggtcaatatgaagatgctgcaggtttgatggctcacaggaaaacctataactgcttagtgcagtacaaagcaaagtggatgatgaacttcctgataatttacatattcttaattttgatcaaagattctgctatagttgtacaagctgctggaactgacttcaccacctgcctagagactgaaagtataaattggaactgcactgggccatttttgaacctcgggaattgccaaaagcaacaaaagaaagaaccttacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagtaaatactgtgattattatacccaattctcagataactcaggatacagtcagacaacatggagagtgtacttaaggtctcatgattttgaagcctgtatactatatccaaatcagcacttttgcagatgtgtaaagaatggtgagaagtgcagcagctccaattggggctttgccaacgaaatgaaagattattactctgggaaacaaacaaagtttgacaaggacttaaatctagccctaacagctttgcatcatgccttcagggggacctcatctgcatatatggcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgaattctgggatgaattattgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcctcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaagtctaaatgttgggaaattgaatatcctgacgtaaagctcatccaagaaggcgatgggactaaaagctgtagaatgaaagattctgggaactgcaatgttgcaactaacagatggccagtgatacaatgtgataatgacaaattttactactcagagcttcaaaaagattatgacaaaactcaagatattggtcactattgcttaagccctggatgtactactgtccggtaccctattaatccaaagcacatctctaactgtaattggcaagtaagcagatctagcatagcgaagatagatgtgcacaatattgaggatattgaacaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttactagatgttatagcatatgtgaaaagtgcctcatactcttcagtgtatacaaaattgtactcaactggcccaacatcagggataaatactaaacatgatgaattgtgtactggcccatgcccagcaaatatcaatcatcaggatgggtggctgacatttgcaagagagaggacaagctcatggggatgcgaagagtttggttgcctggctgtaagtgatgggtgtgtatttgggtcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtggagacctacagcttgcccagaattgttgctgtgcaaaaccatgagattaagattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattatcaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaattgcttcgaaaatatccattgcgaattaacgttgcacaccacaattgaagccagctgcccaattaaaagctcgtgcacagtatttcatgacaggattcttgttactccaaatgaacacaaatatgcattaaaagtggtgtgcacagaaaagccagggaacacactcacaattgaagtctgcaatactaaaattgaagcatctatggcccttgtcgacgcaaagcctatcatagaactagcaccagttgatcagacaacatatataagagaaaaagatgaaaggtgtaaaacttggatgtgtagggtaagagatgaaggactgcaggtcatcttggagccatttaaaaatttatttggatcttatattgggatattttacacatttattatatctatagtagcattattggttattatctatgtactactacctatatgctttaagttaagggatacccttagaaagcatgaagatgcatataagagagagatgaaaattagataa

SEQ ID NO: 4290 - RNA, 4326 nt, synthetic construct
  misc_feature 1..4326: note = derived and/or modified CDS sequence (wt) from LACV(LACV/95/OH-H (CCH-MB96))__GU206136.1__GP
  source 1..4326: mol_type = other RNA
atgattcgcatactggtgctgattgcagttacagctgcaagcccagtgtatcaaaggtgcttccaagatggggctatagtgaagcaaaacccatccaaagaagcagttacagaggtgtgcctgaaagatgatgttagcatgatcaaaacagaggccaggtatataaggaatgcaacaggggttttttcaaacaatgttgcaataaggaaatggctagtctctgattggcatgattgcaggcctaagaagatcattgggggacacatcaatgtaatagaagttggtgatgacctatcgctccatactgaatcatatgtttgcagtgcagattgtactataggtgtagacaaagagactgcgcaggtcagacttcagacagataccacaaatcattttgaaattgcaggcactactgtgaagtcaggatggttcaagagcacgacatatataactcttgatcaaacctgcgaacaccttaaagtttcctgcggcccaaaatctgtacagttccatgcctgcttcaatcagcatatgtcttgtgtcagatttttacacaggacaatattgcctggctccattgccaattccatatgtcagaatattgaaatcataattttagttacacttactctattaatctttatattgttaagcattttaagtaagacttatatatgttatttattaatgcctatattcatccccatagcatatgtatacggtataatttacaacaagtcgtgcaaaaaatgcaaactatgcggcctagtgtatcacccattcacagagtgtggcacacattgtgtctgtggtgctcgctatgatacttcagatagaatgaaactgcacagagcttctggactgtgccctggttataaaagtctaagagctgccagagtcatgtgcaagtcgaaagggcctgcatcaatattatctatgattactgcagtactggtcttaacctttgtgacgccaatcaactctatggttttaggggaaagtaaagaaacgtttgaacttgaagagctcccagacgacatgttggaaatggtatcgaggataaattcttattattttacctgtatcttgaattatgctgtaagctggggtcttataatcattgggttgttgactggactgctatttaagaaataccagcacagatttttaaatgtttacgcaatgtactgtgaggaatgtgacatgtatcatgacaagtctgggctgaaaagacatggtgatttcaccaacaaatgcaggcaatgtacatgtggtcaatatgaagatgccgcaggcttgatggcccacaggaaaacctataactgcttagtgcagtacaaagcaaaatggatgatgaatttcctgataatttacatattcttaattttaatcaaagattctgctatagttgtacaagctgctggaactgatttcaccacctgcctagagactgagagtataaattggaactgcactgggccatttttgaacctcgggaactgtcaaaagcagcaaaagaaggaaccttacaccaacattgcaacccaattaaaggggctaaaggcaatttccgtactagatattcctataataacagggattccggatgatattgcaggtgctttaagatatatagaagaaagggaagatttccatgtccagctaactatagaatacgcaatgctgagtaagtactgtgactattacacccaattctcagacaactcaggatacagtcagacaacatggagggtgtacttaaggtctcatgattttgaggcatgtatactatatccaaatcaacatttctgcaggtgtgtgaaaaatggtgagaagtgcagcagctccaattggggctttgccaatgaaatgaaggatttttactctgggaaacaaacaaagtttgataaagacttaaacctagccctaacagctttgcatcatgccttcagggggacctcatctgcatatatagcaacagtgctttcaaaaaagtccaatgatgacttgattgcatacacaaacaagataaaaacaaaattcccaggtaatgcattgttgaaggctataatagattatatagcatatatgaaaagtttgccaggtatggcaaatttcaaatatgatgagttctgggatgaattattgtacaaacccaacccagcaaaagcctcaaaccttgctagaggaaaggagtcatcttacaattttaaactagcaatttcatcaaaatctataaaaacctgcaagaatgttaaggatgttgcctgtttatcaccaaggtcaggtgctatatatgcttcaataattgcatgtggtgaacccagtgggccaagtgtgtatagaaaaccaccaggtggtgtattccaatctagcactgatcggtctatatactgcttactagatagccattgtctagaagaatttgaagctatcagccaggaggagctagatgcagtgaaaaaatccaaatgttgggagattgaatatcctgatgtaaagcccctccaagaaagtgatgggactaaaagctgtagaatgaaagattctggaaactgcaatgttgcaactaacagatggccagtgatacaatgcgagaatgacaaattttactactcagagcttcaaaaagattatgataaaactcaagatattggtcattattgcttaagccctggatgtactactgtccggtaccctattaatccaaagcatatctctaactgtaattggcaggtaagcagatccagcatagcgaagatagatgtgcataatattgaagacattgaacaatataagaaggctataactcaaaaacttcaaacaagcctatctctattcaagtatgcaaaaacaaaaaacttgccgcacatcaaaccaatttataaatatataactatagaaggaacagaaactgcagaaggtatagagagtgcatacattgaatcagaagtgcctgcattggctgggacatctatcgggttcaaaatcaattctaaagagggcaagcacttgctagatgttatagcatatgtaaaaagcgcctcatactcttcagtgtatacaaaattgtactcaactggcccaacatcaggaataaatactaaacatgatgaattatgtactggcccgtgcccagcaaatatcaatcatcaggttgggtggctaacatttgcaagagagaggacaagctcatggggatgtgaagaatttggttgcctggctgtaagtgatggatgtgtatttgggtcatgccaggatataataaaagaagaactatctgtctataggaaggagaccgaagaagtgactgatgtagaactatgtttaacattttcagataaaacatattgtacaaacttgaaccctgtaacccctattataacagatctattcgaagtacagttcaaaactgtagagacttacagcttgcccagaattgtcgctgtgcaaaaccatgaaattaagattgggcaaataaatgacctaggagtttactctaggggttgtggaaatgttcaaaaggtcaatggaaccgtttatggcaatggagttcctagatttgattacttatgccatttagctagcagaaaggaggttattgttagaaaatgctttgacaatgattaccaagcgtgcaaatttcttcaaagccctgctagttacagacttgaagaagacagtggtactgtgactataattgattacaagaagatattaggcacaatcaagatgaaggcaattttaggagatgtcaaatataagacatttgctgacagtgtcgatataactgcagaagggtcatgcactggctgtatcaattgctttgagaatatccattgtgaattaacgttgcataccacaattgaagccagctgtccaattaaaagctcatgcacagtattccatgacaggattcttgtgactccaaatgaacacaaatatgcattaaaaatggtgtgcacagaaaagccagggaatacactcacaattaaagtttgcaatactaagattgaggcatctatggcccttgtcgacgcaaagcctattatagaactagcaccagttgatcagacagcatatataagagaaaaagatgaaaggtgtaaaacctggatgtgtagggtaagagatgaaggattgcaggtcatcctggagccattcaaaaatttatttggatcttatattgggatattttacacatttattatatctatagtggcattattggttatcatctatgtgctattgcctatatgctttaagttaagagatacccttagaaagcatgaagatgcatataagagagagatgaaaattagatag

SEQ ID NO: 4291 - RNA, 4326 nt, synthetic construct
  misc_feature 1..4326: note = derived and/or modified CDS sequence (wt) from LACV(LACV/95/WV-H)__GU206133.1__GP
  source 1..4326: mol_type = other RNA
atgatttgtatattggtgctaattacagttgcagctgcaagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtacaatttacaataagtcgtgcaaaaaatgcaaattatgtggcttagtgtatcacccattcacagagtgtggcacacattgtgtctgtggtgcccgctatgatacttcagatagaatgaaactgcatagagcttctggattgtgccctggttataaaagcctaagagctgccagagtcatgtgcaagtcgaaagggcctgcatcaatattgtctataattactgcggtactggtcttaacctttgtgacaccaatcaactccatggttttaggagagagtaaagaaacctttgaacttgaagatcttccagacgacatgttggaaatggcatcgagaataaattcttattatcttacctgtatcttgaattatgctgtaagctggggtcttgttatcattggattgttgatcgggctgctttttaagaaataccagcacagattcttaaatgtttacgcaatgtactgtgaagaatgtgacatgtatcatgacaagtctgggttgaaaagacatggtgatttcaccaacaaatgcagacagtgcacatgtggtcaatatgaagatgctgcaggtttgatggctcacaggaaaacctataactgcttagtgcagtacaaagcaaagtggatgatgaacttcctgataatttacatattcttaattttgatcaaagattctgctatagttgtacaagctgctggaactgacttcaccacctgcctagagactgagagtataaattggaactgcactgggccatttttgaacctcgggaattgccaaaagcaacaaaagaaagaaccttacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagtaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggatttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgaattctgggatgaattattgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcagtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaaactcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacaagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcccagaattgttgctgtgcaaaaccatgagattaagattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaattccttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaaattgaagcatctatggcccttgtcgatgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagcattattggttattatctatgtactactacctatatgctttaagttaagggatacccttagaaagcatgaagatgcatataagagagagatgaaaattagatag

SEQ ID NO: 4292 - RNA, 4326 nt, synthetic construct
  misc_feature 1..4326: note = derived and/or modified CDS sequence (wt) from LACV(LACV/96/WV-M (WV96-3955))__GU206145.1__GP
  source 1..4326: mol_type = other RNA
atgatttacatactggtgctaattgcagttacagctgcaagtccagtatatcaaaggtgttttcaggatggggctatagtgaagcaaaacccatccaaagaggcagtcacggaggtgtgcctaaaggatgatgtcagtatgatcaaaacagaagccagatacataagaaatgcgacaggagttttttcaaacaatgttgcaataaggaaatggttggtctctgattggcatgactgcaggcccaagaaaatcactgggggacatattaatgtgatagaggttggtgatgatctatcactccacactgaatcatatgtttgcagtgcagactgtactataggtgtagacaaggagacggcgcaagtcaggcttcaaacagataccacgaaccattttgaaattgcaggtaccactgtaaaatcaggatggttcaaaagcacaacatatatcactcttgaccagacttgtgaacatcttaaggtgtcttgcggcccaaaatctgtgcagttccatgcctgcttcaatcagcatatgtcctgtgttagatttttacataggacaatactgcccggttctatagctaattctatatgccagaatattgaaatcataattttagtcacactcactctattaatctttatattgttaagtattctaagtaagacttatatatgttatttactaatgcctatattcatccctatagcatatgtgtatggtataatctacaataagtcatgcaaaaaatgcaaactatgcggtctggtgtatcatccattcacagaatgcggcacacactgtgtctgtggtgctcgctatgatacttccgatagaatgaaactgcatagagcctctggactgtgtcctggttataaaagcttgagagctgctagggtcatgtgtaagtcaaaagggcctgcatccatattatctataattactgcagtactagtcttaacatttgtgacaccaatcaattccatggttttaggggaaagtaaagaagtcttcgaacttgaagagcttccggacgacatgttagagatggcattgaggataaattcctattatttcacctgtattctaaattatgctgtgagctggggccttattatcattggattgttgactgggctactatttaaaaagtaccaacatagatttttgaatatttatgcgatgtattgtgaagagtgtgacatgtatcatgataaatccgggctgaaaaggcatggtgatttcactaacaaatgcaggcaatgtacatgcggccaatatgaagatgctgcaggattaatgactcacagaaaaacttacaattgtttggtgcaatataaagcaaaatggataatgaattttttgatagtttacatatttttgattctaatcaaggattctgccataattgtacgagctgccggaactgactttagctcctgcttagaaacagaaatcataaattggaactgcactgggccatttttgaatctcgggaattgccaaaggcaacaaaaaaaggagccttatgctaacattgcagctcaattaaaaggattgaaagcaatttcagtgcttgacatccctatgataacagaaataccagatgacatcgcaagtgcattaagatatatagaagagagagaggctttccatgtccaattgactgcagaatacgcaatgctgagtagatattgtgattattatacccaattctcagacaactcaggatatagtcagacaacatggagagtatatttgaggtctcacgatttcgaggcatgtatactataccctaatcaacacttttgcagatgtgtgaaaaacggtgagaaatgcagcagtgccaattgggattttgccaatgaaatgaaagattattattctggaaaacaagcaaagtttgataaagacttaaacttggctctgacagctatgcaccatgccttcagggggacttcatctgcatatatggcagcaatgctctcaaagaagtcaaatgatgacttgatcacatatacaaataaattaaagacaaagttccccggtaatgcgttgctgaaggccataatagactatatagcatatatgaaaggcttaccaggtatggcaaattttaaacatgatgaattttgggatgaattactatacaaacccacaccaacaaaggccccaaatcttgctagaggaagagaatcatcctacaattttgaattggcaatttcatcaaaatccataaaaacctgcaaaaatgttaaagatgttgcttgtttatcacccagatcaggcgccatatatgcatcaataatagcatgtggtgaacccaatgggccaagtgtatacaggaagccatcaggcggtgtcttccagtccagcactgaccaatctatgtattgtttgctggatagtcattgcttggaagaatttgaagctatcagccaggaagaattggatgcggtgaagaaatcgaaatgttgggaaatagaataccctgacgtaaagctcctccaagaaaatgatggaaccaaaagctgtagaatgaaagactctggaaattgtaatgttgcaaccaacagatggccagtaatacaatgtgaaaatgacaaattttactactcagagcttcaaaaagattatgataagacccaggatattggccactattgcttgagtcctgggtgtgctactatccggtaccccattaatccaaagcatatctctaattgcaattggcaagtgagtagatctagcatagcaaaaatagatgtgcataatattgaagacattgagcaatataaaaaagccataactcaaaaacttcaaacaagtctatccctttttaaatatgccaaaacaaaaaacttgccgcacatcaaacctatttacaaatatataactatagaaggaaccgaaactgcagagggaatagaaagcgcgtatattgaatcagaagtgcctgcattagctgggacatccattggattcaaaatcaactccaaggagggcaaacatttattagatgttatagcttatgtgaaaagtgcctcatactcttcagtatacacaaaattgtattcaaccggcccaacatcaggtgtaaacactaagcatgatgaattgtgcactggcccatgcccagcaaatattaaccatcaggttggatggttaacatttgcaagagagagaacaagttcatggggctgtgaagagtttggttgcctagcagtaagtgatggatgcgtatttgggtcatgccaagatataataaaagaagagctgtctgtctataggaaggaaaccgaggaagtaactgatgtggagctatgtttaacattctcagacaaaacatactgtacaaatttaaatcccgtcacccctattataacagatctatttgaggtgcaattcaaaactgtagagacttacagcttgcccaggattgttgccgtacaaaatcatgagatcaagattggtcaaataaatgatttaggagtgtattctaaagggtgtggaaatgttcagaaggtcaatgggaccatttatggtaatggagtccctagatttgattacttgtgtcatttagctagtagaaaagaggttattgttaggaaatgttttgataatgactatcaagcatgtaaattcctccagagccctgctagttacagacttgaggaggatagtgggactgtgactataatcgattacaaaaaaatactaggtacaattaagatgaaggcaattttaggggatgttaaatacaaaacatttgctgataatgttgatataactgcagaagggtcttgcactggctgtattaattgctttgagaatatccactgtgaattgacattgcataccacaattgaagccagctgtccaattaaaagctcatgcacagtgtttcatgataggatccttgtgactccaaacgaacataaatatgctttgaaagtagtgtgcactgaaaagccagggaatacgctcacaatcaaagtgtgtaacacaaagattgaagctgcaatggctcttgttgacgcaaaacccatcatagaattggcaccggttgatcaaacagcatacataagggaaaaggatgagagatgtaaaacttggatgtgcagagtacgggacgaaggattacaggtcattttggaaccatttaaaaacttatttggatcctatattgggatattttatacatttattatatccatagtggcattattagtcatcatttacatcttattgcctatatgtttcaaattaagagatactctcaggaagcatgaggatgcatataagagagagatgaaaattaggtaa

SEQ ID NO: 4293 - RNA, 4326 nt, synthetic construct
  misc_feature 1..4326: note = derived and/or modified CDS sequence (wt) from LACV(LACV/97/NC-M (NC97-7306))__GU206127.1__GP
  source 1..4326: mol_type = other RNA
atgattcgcatactggtgctgattgcagttacagctgcaagcccagtgtatcaaaggtgcttccaagatggggctatagtgaagcaaaacccatccaaagaagcagttacagaggtgtgcctgaaagatgatgttagcatgatcaaaacagaggccaggtatataaggaatgcaacaggggttttttcaaacaatgttgcaataaggaaatggctagtctctgattggcatgattgcaggcctaagaagatcattgggggacacatcaatgtaatagaagttggtgatgacctatcgctccatactgaatcatatgtttgcagtgcagactgtactataggtgtagacaaagagactgcgcaggtcagacttcagacagataccacaaatcattttgaaattgcaggcactactgtgaagtcaggatggttcaagagcacgacatatataactcttgatcaaacctgcgaacaccttaaagtttcctgcggcccaaaatctgtacagttccatgcctgcttcaatcagcatatgtcttgtgtcagatttttacacaggacaatattgcctggctccattgccaattccatatgtcagaatattgaaatcataattttagttacacttactctattaatctttatattgttaagcattttaagtaagacttatatatgttatttattaatgcctatattcatccccatagcatatgtatacggtataatttacaataagtcgtgcaaaaaatgcaaactatgcggcctagtgtatcatccattcacagagtgtggcacacattgtgtctgtggtgctcgctatgatacttcagatagaatgaaactacacagagcttctggactgtgccctggttataaaagtctaagagctgccagagtcatgtgcaagtcgaaagggcctgcatcaatattatctatgattactgcagtactggtcttaacctttgtgacgccaatcaactctatggttttaggggaaagtaaagaaacgtttgaacttgaagagcttccagacgacatgttggaaatggtatcgaggataaattcttattattttacctgtatcttgaattatgctgtaagctggggtcttattatcattgggttgttgactggactgctatttaagaaataccagcacagatttttaaatgtttacgcaatgtactgtgaggaatgtgacatgtatcatgacaagtctgggttgaaaagacatggcgatttcaccaacaaatgcaggcaatgtacatgtggtcaatatgaagatgccgcaggcttgatggcccacaggaaaacctataactgcttagtgcagtacaaagcaaagtggatgatgaatttcctgataatttacatattcttaattttaatcaaagattctgctatagttgtacaagctgctggaactgatttcaccacctgcctagagactgagagtataaattggaactgcactgggccatttttgaacctcgggaattgtcaaaaacagcaaaagaaggaaccttacaccaacattgcaacccaattaaaggggctaaaggcaatttccgtactagatatccctataataacagggattccggatgatattgcaggtgctttaagatatatagaagaaagggaagatttccatgtccagctaactatagaatacgcaatgctgagtaagtactgtgactattacacccaattctcagacaactcaggatacagtcagacaacatggagggtatacttaaggtctcatgattttgaggcatgtatactatatccaaatcaacatttctgcaggtgtgtgaaaaatggtgagaagtgcagcagctccaattgggactttgccaatgaaatgaaggatttttactctgggaaacaaacaaagtttgataaagacttaaacctagccctaacagctttgcatcatgccttcagggggacctcatctgtatatatagcaacaatgctttcaaaaaagtccaatgatgacttgattgcatacacaaacaagataaaaacaaaattcccaggtaatgcattgttgaaggctataatagattatatagcatatatgaaaagtttgccaggtatggcaaatttcaaatatgatgagttctgggatgaattattatacaaacccaacccagcaaaagcctcaaaccttgctagaggaaaggagtcatcttacaattttaaactagcaatttcatcaaaatctataaaaacctgcaagaatgttaaggatgttgcctgtttatcaccaaggtcaggcgctatatatgcttcaataattgcatgtggtgaacccaatgggccaagtgtgtatagaaaaccaccaggtggtgtattccaatctagcactgatcggtctatatactgcttactagatagccattgtctagaagagtttgaagctatcagccaggaggagctagatgcagtgaaaaaatccaaatgttgggagattgaatatcctgatgtaaagcccctccaagaaagtgatgggactaaaagctgtagaatgaaagattctgggaactgcaatgttgcaactaacagatggccagtgatacaatgcgagaatgacaaattttactactcagagcttcaaaaagattatgataaaactcaagatattggtcattattgcttaagccctggatgtactactgtccggtaccctattaatccaaagcatatctctaactgtaattggcaggtaagcagatccagcatagcgaagatagatgtgcataatattgaagacattgaacaatataagaaggctataactcaaaaacttcaaacaagcctatctctattcaagtatgcaaaaacaaaaaacttgccgcacatcaaaccaatttataaatatataactatagaaggaacagaaactgcagaaggtatagagagtgcatacattgaatcagaggtgcctgcattggctgggacatctatcgggttcaaaatcaactctaaagagggcaagcacttgctagatgttatagcatatgtaaaaagcgcctcatactcttcagtgtatacaaaattgtactcaactggcccaacatcaggaataaatactaaacatgatgaattatgtactggcccatgcccagcaaatatcaatcatcaggttgggtggctaacatttgcaagagagaggacaagctcatggggatgtgaagaatttggttgcctggctgtaagtgatggatgtgtatttggttcatgccaggatataataaaagaagaactatctgtctataggaaggagaccgaagaagtgactgatgtagaactatgtttaacattttcagataaaacatattgtacaaacttgaaccctgttacccctattataacagatctatttgaagtacagttcaaaactgtagagacttacagcttgcccagaattgtcgctgtgcaaaaccatgaaattaagattgggcaaataaatgacctaggagtttactctaaggcttgtggaaatgttcaaaaggtcaatggaaccgtttatggcaatggagttcctagatttgattacttatgccatttagctagcagaaaggaggtcattgttagaaaatgctttgacaatgattaccaggcgtgcaaatttcttcaaagccctgctagttacagacttgaagaagacagtggtactgtgactataattgattacaagaagatattaggcacaatcaagatgaaggcaattttaggagatgtcaaatataagacatttgctgacagtgtcgatataactgcagaagggtcatgcactggctgtatcaattgctttgagaatatccattgcgaattaacgttgcataccacaattgaagccagctgtccaattaaaagctcatgcacagtattccatgacaggattcttgtgactccaaatgaacacaaatacgcattaaaaatggtgtgcacagaaaggccagggaatacacttacaattaaagtttgcaatactaagattgaggcatctatggcccttgtcgacgcaaagcctattatagaactagcaccagttgatcagacagcatatataagagaaaaagatgaaaggtgtaaaacctggatgtgtagggtaagagatgaaggattgcaggtcatcctggagccattcaaaaatttatttggatcttatattgggatattttacacatttattatatctatagtggcattattggttatcatctatgtgctattgcctatatgctttaagttaagagatacccttagaaagcatgaagatgcatataagagagagatgaaaattagatag

SEQ ID NO: 4294 - RNA, 4326 nt, synthetic construct
  misc_feature 1..4326: note = derived and/or modified CDS sequence (wt) from LACV(LACV/human/1960)__EF485031.1__GP
  source 1..4326: mol_type = other RNA
atgatttgtatattggtgctaattacagttgcagctgcaagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtacaatttacaataagtcgtgcaaaaaatgcaaattatgtggcttagtgtatcacccattcacagagtgtggcacacattgtgtctgtggtgcccgctatgatacttcagatagaatgaaactgcatagagcttctggattgtgccctggttataaaagcctaagagctgccagagtcatgtgcaagtcgaaagggcctgcatcaatattgtctataattactgcggtactggtcttaacctttgtgacaccaatcaactccatggttttaggagagagtaaagaaacctttgaacttgaagatcttccagacgacatgttggaaatggcatcgagaataaattcttattatcttacctgtatcttgaattatgctgtaagctggggtcttgttatcattggattgttgatcgggctgctttttaagaaataccagcacagattcttaaatgtttacgcaatgtactgtgaagaatgtgacatgtatcatgacaagtctgggttgaaaggacatggtgatttcaccaacaaatgcagacagtgcacatgtggtcaatatgaagatgctgcaggtttgatggctcacaggaaaacctataactgcttagtgcagtacaaagcaaagtggatgatgaacttcctgataatttacatattcttaattttgatcaaagattctgctatagttgtacaagctgctggaactgacttcaccacctgcctagagactgagagtataaattggaactgcactgggccatttttgaacctcgggaattgccaaaagcaacaaaagaaagaaccttacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagtaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggatttaaatctagccctaacagctttgcatcatgccttcagggggacctcatctgcatatatagcaacaatgctctcaaaaaagtccaatgatgacttgattgcatacacaaataagataaaaacaaaattcccaggtgatgcattgttgaaggctataatagattatatagcatatatgaaaagtttgccaggtatggcaaatttcaaatatgatgaattctgggatgaattattgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcagtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaaactcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacaagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcccagaattgttgctgtgcaaaaccatgagattaagattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaattccttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaaattgaagcatctatggcccttgtcgatgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagcattattggttattatctatgtactactacctatatgctttaagttaagggatacccttagaaagcatgaagatgcatataagagagagatgaaaattagatag

SEQ ID NO: 4295 - RNA, 4326 nt, synthetic construct
  misc_feature 1..4326: note = derived and/or modified CDS sequence (wt) from LACV(LACV/mosquito/1978)__EF485037.1__GP
  source 1..4326: mol_type = other RNA
atgattcgcatactggtgctgattgcagttacagctgcaagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaacaatgttgcaataagaaaatggctagtctctgattggcatgattgcaggcctaagaagatcattggggggcacatcaatgtaatagaagttagtgatgacctgtcactccatactgaatcatatgtttgcagcgcagattgtaccataggtgtagacaaggagactgcacaggtcaggcttcagacagataccacaaatcattttgaaattgcaggcactactgtgaagtcaggatggttcaaaagtacgacgtacataactcttgatcaaacctgcgaacaccttaaagtttcctgcggcccaaaatctgtacagttccatgcctgcttcaatcagcatatgtcttgcgtcagatttttacacaggacaatattgcctggatccatagccaattccatatgtcagaatattgaaatcataattttagttacacttactctattaatctttatattgttaagcattttaagcaagacttatatatgttatttattaatgcctatatttatccctatagcatacatgtacggtataatttacaataagtcgtgcaaaaaatgtaaactatgcggcctagtgtatcatccattcacagagtgtggcacacattgtgtctgcggtgctcgctatgatacttcagatagaatgaaactgcatagagcttctggattgtgccctggttataaaagcctaagagctgccagagtcatgtgcaagtcgaaagggcctgcatcaatattgtctataattactgcagtactggtcttaacctttgtaacaccaatcaactctatggttttaggggagagtaaagaaacttttgaacttgaagagcttccagacgacatgttggaaatggcatcgagaataaattcttattatttcacctgtatcttaaattatgctgtaagctggggtcttgttatcattggattgttgaccgggctgctatttaagaaatatcagcacagatttttaaatatttacgcaatgtactgtgaggaatgtgacatgtatcatgacaagtctgggttgaaaagacatggtgatttcaccaataaatgcaggcagtgcacatgtggtcaatatgaagatgccgcaggtttgatggcccacaggaaaacctataactgcttagtgcagtacaaagcaaagtggatgatgaatttcctgataatttacatattcttaattttaatcaaagattctgctatagttgtacaagctgctggaaccgatttcaccacctgcctagagactgagagcatagattggaactgcactgggccatttttgaacctcgggaattgccaaaagcaacaaaagaaagaaccttacaccaacattgcaacccaattaaagggactaaaggcaatttccgtgctagatatccctataataacaaggataccagatgatattgcaggtgctttaagatatatagaagaaagggaagatttccatgtccagctaactacagaatatgcgatgctgagtaaatactgtgactattatacccaattctcagacaattcaggatacagtcagacaacatggagagtgtacttaaggtctcatgattttgaggcatgtatactatatccaaatcagaatttttgcagatgtgtgaaaaatggtgagaaatgcagcagctctaattgggattttgccaatgaaatgaaagattattaccccgggaaacaagcaaagtttgataaagacttaaatctagccctaacagctttgcatcatgccttcagggggacttcatctgcatatatagcaacaatgctctcaaaaaagtccaatgatgacttgattgcatacacaaataagataaaaacaaaattcccaggcaatgcattgttgaaggctataatagattatatagcatatatgaaaagtctgccaggtatggcaaatttcaaatatgatgaattctgggatgaattattgtacaagcccaacccagcaaaggcctcaaaccttgctagaggaaaggagtcatcttacaacttcaaattagcaatttcatcaaagtctataaaaacctgcaagaatgttaaggatgttgcctgcttatcgccaaggtcaggtgctatatatgcttcaataattgcatgtggcgaacccaatggaccaagtgtgtatagaaaaccatcaggcggtgtatttcaatctagcactgatcgatctatatactgcttactagacagccattgtctagaagaatttgaggctatcagccaggaggaactggatgcagtaaaaaaatccaaatgttgggaaattgaatattctgatgtaaaacccctccaagaaggtaatgggactaaaagctgtaggatgaaagattctgggaactgcaatgttgcaactaacagatggccagtgatacaatgtgagaatgacaaattttactactcagagcttcaaaaagattatgacaaaactcaagatattggtcattattgcttaagccctggatgtactactgttcggtaccctattaatccaaagcatatctctaactgtaattggcaggtgagcagatccagcatagcgaagatagatgtgcacaatattgaagatattgaacagtataagaaggctataactcaaaaacttcaaacaagcttatctctatttaagtatgcaaaaacaaaaaacttaccgcacatcaaaccaatttataaatatataactatagaaggaacagaaactgcagaaggtatagagagtgcatacatcgaatcagaggtacctgctttggctgggacatctatcggattcaaaatcaattctaaagagggcaagcacttgctagatgttatagcatatgtaaaaagcgcctcatactcttcagtgtatgcaaagttatactcaactggcccaacatcagggataaatactaaacatgatgaattgtgtactggcccatgcccagcaaatatcaatcatcaggttgggtggctaacatttgcaaaagagaggacaagctcatggggatgcgaagagtttggttgcctggctgtaagtgatgggtgtgtatttgggtcgtgccaagatataataaaagaagagctatctgtctataggaaagagaccgaggaagtgactgatgtagaactatgtttaacattttcagacaaaacatattgtacaaacttaaaccctgttacccctattataacggacctatttgaggtacagttcaaaactgtagagacttacagcttgcccagaattgttgctgtgcaaaatcatgagattaagattgggcaaataaatgatctaggagtttactctaagggttgtggaaatgttcaaaaggtcaatggaactgtttatggcaatggagttcccagatttgactacctatgccatttagctagcagaaaggaagtcattgttaggaaatgcttcgacaatgattaccaagcatgcaaatttcttcaaagccctgctagttacagacttgaagaagacagcggcactgtgactataattgattacaaaaagatattaggcacaattaagatgaaggcaattttaggagatgtcaaatataaaacatttgctgatagtgtcgatataactgcagaagggtcatgcactggctgtatcaactgcttcgagaatatccattgcgaattaacgttgcataccacaattgaagccagttgtccaattaaaagctcatgcacagtattccatgacaggattcttgtgactccaaatgaacacaaatatgcattaaaaatggtgtgtacagaaaagccgggaaacacactcacaattaaagtttgcaatactaagattgaagcatctatggcccttgttgacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattggaatattttacacatttattatatctatagtggcattattggctatcatctatgtgctattgcctatatgctttaagttaagagatacccttagaaagcatgaagatgcatataagagagagatgaaaattagatag

SEQ ID NO: 4296 - RNA, 4323 nt, synthetic construct
  misc_feature 1..4323: note = derived and/or modified CDS sequence (wt) from LACV__KP271111.1__GP
  source 1..4323: mol_type = other RNA
atgattcgcatactggtactgattgcagttacagctgcaagcccagtgtatcaaaggtgtttccaagatggggctatagtgaagcaaaacccatccaaagaagcagttacagaggtgtgcctgaaagatgatgttagcatgatcaaaacagaggccaggtacgtaagaaatgcaacaggagttttttcaaacaatgttgcaataaggaaatggctagtctctgactggcatgattgcagacctaagaagatcattgggggacacatcaatgtaatagaagttggtgatgacctgtcactccatactgaatcatatgtttgtagcgcagattgtagcataggtgttgacaaagagactgcacaggtcaggcttcagacagataccacaaatcactttgaaattgcaggcactactgtgaagtcagggtggtttaaaagcacgacgtatataactcttgatcaaacctgcgaacaccttaaagtttcctgcggcccaaaatctgtacagttccatgcctgcttcaatcagcacatgtcttgcgtcagatttttacacaggacaatattgcctggctctatagccaattctatatgtcagaatattgaaatcataattttagttacacttactctattaatctttatattgttaagcattttaagtaagacttatatatgttatttattaatgcctatatttatccctatagcatacatgtacggtataatttacaataagtcgtgcaaaaaatgcaaactatgcggcctagtgtatcatccattcacagagtgtggcacacattgcgtctgtggtgctcgctatgatacttcagatagaatgaaactgcacagagcttctggattgtgccctggttataaaagcctaagagctgccagagttatgtgcaagtcgaaagggcctgcatcaatattgtctataattactgcagtactggtcttaacctttgtgacaccaatcaattctatggttttaggggagagtaaagaaacttttgaacttgaagagcttccagacgatatgttggaaatggcatcaagaataaattcttattatttcacctgtatcttaaattatgctgtaagctggggtcttgttatcattggattgttgaccgggctgctatttaagaaatatcagcacagatttttaaatgtttacgcaatgtactgtgaggagtgtgacatgtaccatgacaagtctgggttgaaaagacatggtgatttcactaacaaatgcaggcagtgcacatgtggtcagtatgaagatgctgcaggtttgatggcccacaggaaaacctataactgcttagtgcagtacaaagcaaaatggatgatgaatttcctgataatttatatattcttaattttaatcaaagattctgctatagttgtacaagctgctggaactgatttcaccacttgcctagagactgagagtataaattggaactgcacagggccattcttgaacctcgggaattgtcaaaagcaacaaaagaaagaaccttacaccaacattgcaacccagttaaagggactaaaggcaatttccgtactagatatccctataataacagggataccagatgatatcgcaggtgctttaagatatatagaagagagggaagacttccatgtccagctaactatagaatatgcaatgctgagtaaatactgtgactattatacccaattctcagacaactcaggatacagtcaaacaacatggagagtgtacttaaggtctcatgattttgaggcatgtatactatatccaaatcagcatttttgcagatgtgtgaaaaatggtgagaagtgcagcagctccaattgggactttgccaacgaaatgaaagattattactcagggaaacaaacaaagtttgataaagacttaaatctagccctaacagctttgcatcatgctttcagggggacttcatctgcatatatagcaacaatgctctcaaaaaaatccaacgatgacttgattgcatacacaaataagataaaagcaaaattcccaggtaatgcattgttgaaggctataatagattatatagcatatatgaaaagtctgccaggtatggcaaatttcaaatatgatgaattctgggatgagttattgtacaaacccaacccagcaaaggcttcaaaccttgctagaggaaaggagtcttcttacaacttcaaactagcaatttcatcaaaatctataaaaacctgcaagaatgttaaggatgttgcctgcttatcgccaaggtcaggtgctatatatgcttcaataattgcatgtggtgaacccaatggaccaagtgtgtatagaaaaccatcaggtggtgtattccaatctagcactgatcggtctatatactgcttactagatagccattgtctagaagaatttgaggctattaaccaggaggaactggatgcagtaaaaaaatcaaaatgttgggaaattgaatattctgatgtgaagcccctccaagaaggtgatggaactaaaagctgtagaatgaaagattctgggaactgcaatgttgcaactaacagatggccagtgatacaatgcgagaatgacaaattttactactcagagcttcaaaaagattatgacaaaactcaagatattggtcattattgcttaagtcctggatgtactactgttcggtaccctattaatccaaagcatatctctaactgtaattggcaggtgagcagatccagcatagcgaagatagatgtgcacaatattgaagatattgaacagtataagaaggctataactcagaaacttcaaacaagcttatctctattcaagtatgcaaaaacaaagaatttgccgcacatcaagccaatttacaaatatataactatagagggaacagaaactgcagaaggtatagagagtgcatacatcgaatcagaggtacctgcattggctgggacatctatcggattcaaaatcaattctaaagagggcaagcacttgctagatgttatagcatatgtaaaaagcgcctcatactcttcagtgtatgcaaaattgtactcaactggcccaacatcagggataaatactaaacatgatgaattgtgtactggcccatgcccggcaaatatcaatcatcaggttgggtggctaacatttgcaaaagagaggacaagctcatggggatgcgaagagtttggttgcctggctgtaagtgatgggtgtgtattcgggtcatgccaagatataataaaagaagaactatctgtctataggaaggagaccgaagaagtgactgatgtagaactatgtttaacattttcagacaaaacatactgtacaaacttaaaccctgttacccctattataacagacctatttgaggtacagttcaagactgtagagacttacagcttgcccagaattgttgctgtgcaaaatcatgagattaagattgggcaaataaatgatctaggagtttactctaagggttgtggaaatgtccaaaagatcaacggaactgtttatggcaatggagttcccagatttgactatctatgccatttagctagcagaaaggaagtcattgttagaaaatgcttcgacaatgattaccaagcatgcaaatttcttcagagccctgctagttacagacttgaagaagacagtggcactgtgactataattgattacaaaaagatattaggcacaatcaagatgaaggcaattctaggagatgtcaaatataaaacatttgctgatagtgtcgatataactgcagaagggtcatgcactggctgtatcaactgcttcgagaatatccattgcgaattaacgttgcatactacaattgaagccagctgcccaattaaaagctcatgcacagtattccatgataggattcttgtgactccaaatgaacacaaatatgcattaaaaatggtgtgcacagaaaagccggggaacacactcacaattaaagtttgcaatactaagattgaagcatctatggcccttgtcgatgcaaagcctatcatagaactagcaccagttgatcagacagcatatataagagaaaaagatgaaaggtgtaaaacttggatgtgtagggtaagagatgaaggactgcaggtcatcttggagccatttaaaaatttgtttgggtcttatattgggatattttacacatttattatatctatagtggcattattggttattgtctatgtgctattgcctatatgctttaagttaagagatacccttagaaagcacgaagatgcatataagagagagatgaaaattaga

SEQ ID NO: 4297 - RNA, 4263 nt, synthetic construct
  misc_feature 1..4263: note = derived and/or modified CDS sequence (wt) from OROV(BeAn19992)__NC_005775.1__GP
  source 1..4263: mol_type = other RNA
atggcgaatttaataattatttcaatggttctgggcgttgcctatgggcatccgctttcaacaagtcaaattggtgaccgctgttttgctggtggtaacctcttcaaggagatgaacttgagtgtaggacttggcgaaatatgtgttaaagatgacatatctattgttaagagtactactgtttttagcaagaataaaccagctcttgaggcaactacaaaattttatagatcttttattgtgaaagattggtctgagtgcaatccagtgctagacaaatttggaaattttatggttttaagtgttgatgataatggccatataatacctaaaatgtatacatgtagagcagcatgtgatattagattaaacaaagataatgccgaaataatattatcgtcaacaaaactcaaccactttgaaattgtcgggacaacttcgacatcaggctggttcaagaacacaataacaaacaacttagaacatacatgcgagcatgtaaccgtaaattgtggtcagaaatcagtaaaattccatgcatgctttagacaacataggggttgtataagattctttaaaggaacatatatgccatactcaatgattgaagcaatgtgcgttaacatagagctaataattctgacattatatatctttgctgcaattatatttgcattaattataacaaagagttatgtggcatacttgctcctgccgttattttatccagtgacgtggttttacggaaaggtttataaaaagattaattcttgcccaaattgtctacttgcatctcaccctttcaccagctgccctaaattctgtatatgcggttctaggtttagttgcacagaagctcttaaggtacatagaatgggaaaggactgcttaggttataagtctctaagcaaagctagacagatgtgtaaatcgaaaagctggtccttcacagcagctatattaactggattaatattgatggaattcatctcaccaattgcaggagagagaatgtataagcttgaggagctggctgatgagtttataaagctaacagagcaggtaaatattttagaaagagaaatggaagtcttgaagcagtcaataattgttatgtttgcaatcattttggtattgttgctttttgaaaatatgatattcaaccggcttttccgcattttttatcgttcttgctccatgtgcggcttgatacattatagaccaggactcaagatcgatttaaccaaaactaacagatgtggtagttgcatctgtggattcgacgagcagcaatcatctggttttgaatatgaaatatttctaaaggatatgcatgtccagaaagaatcatgcaaatttagtccaagagtaaaccactttaggaatattaaagctttattatttgcacttgtaatctgtgctactatatatacagtttatgcagatgaagattgcttatctaaagatattaaaataacatatcaagagttgcacaattgcataggtccaaagataatgggcgatacttgtgtatcaaagagtgaattgtattctgatttattctcaaaaaatctagtcacagaatatgataaaaaatattttgaacccgatactgtaaatgatcaattcaacaagatagagtttgcccaagatgcacatagaatgatactattagaaagaatactttacaagacagaatgtgaaatgctaagcttaaaaaagaacagtggaccttataatgttgcctggcgcacatatttaaaaaatcataatatagacttatgcagtaggcacaactataaaatgatatgtcagtgtattaatacacactctatgtgtaataatacagatatagattataacaaagagatcgaaacatattataaaagcaatgctgcagcctatagagctgacctgaacaccataatggacacattaaaaacagcattcagagggcttacaaaggtcctaattgaaaattatatagaaaaagatgactctgatgctcttaaggccttatttagtaatattactgattctgttcaggacaattatcagatgattggaatattgaaatttgccagtaagctattagatattaaccttggtagatccacccgctcagctcatcattctataatgacaaacgaaattcccaaatctaatccttttactgattacagttattctaatctgaatataaaggagtgcatgtcaccagagagcttgaaatgttttaagaagagaggcagtacaccgcatacaaaccacctgctttgcaagatagacaacaaatataaagcatttgactggccagagatagaaacaattcaaaaaggtcaaaaattgtgccttggtgacagtcattgcaacttggaatttacagccataactgcagacaagattatgtcattaactaactgttataaagaatctttcactgcgcaaccagcagatatgcaggctggaattaaaaaatgctcagctgatgaaattggagaatgtacaacacttgaagacaagacatggccaattatattctgtggtggcaaatattactactctgatagcaaggagcatgccaaggacggttctatcaacaattattgtttaaccaacaaatgctctgaacaacgtttcccaatacatgaaaattggttcaaaaaatgtaattgggacaagacccacaaagaatttagcactatgagacaaataaactataatgatataacttcttatagaaaggcaatagaatctgagataggaacagatttgatgacacaccattataagcccacaaagaaccttccacatgttgtaccaaggtatcatagtatagatgtacaaggtacagaatcaacagagggtattatcaatggtttcatacaaaatacaatacctgctattagtggtctaggtgtcggttatcatctgaattttcaaagcaatcagttatttgacatagttatttttgtgaaaaaagctgtatataaagcacagtaccagaaagcatacaccacaggtcctagcatatccataaatattgaacacaacgaaagatgcacaggccactgccccgaaaagattcctgcaaaagaaggttggttaacattttctaaagagcatactagttcttggggatgtgaagaatatggctgtcttgctatagatacaggctgtctatatggctcttgtcaagatgtcatacgcccagaattagatgtttataagaagattggcagtgaggtatcactgatagaaatatgtataactttgcctcatgaaacttattgcaatgatatggacatattagaaccgattataggagataaattaagtgcatcctttcagaatacacagactaatcaacttccgacccttatagcttataaaaaagggaagatatacacaggtcaaatcaacgatattggaaacacagcattgcagtgcggctcaatccaagtaatcaatggatcaactatcggaactggcagccccaaatttgattatatatgccatgctatgagaaggaaagatgttattgtaaggaagtgtttcaatgacaattatcagtcgtgcactaggctagaaaaacggaacgacttgatcccttatagaaaaggcgatgtcatcgaagtatcaaaaacaggatcgaacatgggccaaatgacatttaaaatagaactaggtgatatcaactataaaatatttactaaatcaatagatcttcaaatgtctggcatttgtgctgggtgcattgactgtgctgaaggcatttcatgctctataaatgctgaagtgccagccgaaacagtctgccattgcaaaacaaactgtgaagattttataaacaatatagtgttttcaccgcaaatcaagaattacaatataaaagtccactgtaaatctaaagttgaaaaaataacagcacatatctgtgggagagacattgatttacagttaacaattaagccatacaatcagaagatagacttgtcgcagttagatgaatcaaattacataagggaagaggacctccagtgtggaacatggttatgtaaagtgcaaaaagaggggattgatattatatttaaaggattattttcaggcttagggagatattggaccatattaatttattcaattataggtgtggtaataattgtgatattggtttatatcctgttgcccataggtcggcttttaaaagcattcctaatcagacatgaaatagaatatgccatggagcagaaaatcaagtag

SEQ ID NO: 4298 - RNA, 4263 nt, synthetic construct
  misc_feature 1..4263: note = derived and/or modified CDS sequence (wt) from OROV(BeH759021)__KP691607.1__GP
  source 1..4263: mol_type = other RNA
atggcgaatttaataattatttcaatggttctgagcgttgcctacgggcatcctctttcaacaagtcaaattggtgaccgctgtttcgctggtggtaacctcttcaaggagatgaacttgagtgtaggacttggcgaaatatgtgttaaagatgacatatctattgttaaaagtactactgtttttagtaagaatagaccagctcttgaggcaaccacaaaattttatagatcttttattgtgaaagattggtctgagtgcaatccagtgctagataaatttggaaattttatggttttaagtgttgatgataatggccatataatgcctaaaatgtacacatgtagagcagcatgtgatattagattaaacaaagataatgctgaaataatattatcgtcaacaaagctcaaccacttcgaaattgtcggaacaacttcgacatcaggctggttcaaaaacacaataacaaacaatttggaacacacatgcgagcatgtgaccgtaaattgtggtcagaaatcagtaaaattccatgcatgctttagacaacataggggttgtataagattctttaaaggaacatatatgccatactcaatgattgaagcaatgtgtgttaacatagagctaataattctgacattatatatctttgctgcaattatatttgcattaattataacaaagagttatgtggcatacctgctcctgccgttattttatccagtgacatggttttacggaaaggtttataaaaagattaattcctgcccaaattgtctacttgcatctcatcctttcaccagctgccctaaaatctgtatatgcggttctagatttagttgcacagaagctcttaaggtgcatagaatgggtaaggactgcttaggttataaatctctaagcaaagctagacagatgtgtaagtcgaaaagctggtcctttacagcagctatattaactggattaatattgatggaatttatctcaccaattgcaggagagagaatgtataagcttgaggagttagctgatgagtttataaagctaacagagcaggtaaatattttagaaagagaaatggaagtcttgaagcagtcaataattgttatgtttgcaatcattttggtattgttgctttttgaaaatatgatattcaaccggcttttcagcattttttatcgttcttgctccatgtgtggtttgatacattatagaccaggactcaagattgatttaaccaaaactaataaatgcggtagttgcatctgtggattcaatgagcagcaatcatctggttttgaatatgaaatatttctaaaggatatgcatatccagaaagaatcatgcaaatttagtccaagagtaaaccactttaggaatattaaagctttattatttgcacttgtaatctgtgctactatatatacagtttatgcagatgaagattgcttgtctaaagacattaaaataacatatcaagagttgcataattgcataggcccaaagataatgggcaacacttgtgtatcaaagaatgaattgtattctgatttattctcaaaaaatctagtcacagaatatgataaaaaatattttgaacctgatactgtaaatgatcaattcaacaaaatagagtttgcccaagatgcacatagaatgatactattagaaagaatactttacaagacagaatgtgaaatgctaagcttaaaaaagaacagtggaccttataatgttgcctggcgcacatatttaaaaaatcataatatagacctatgcagtaggcacaactataaaatgatatgtcagtgtattaatacacactctatgtgtaagaacacagatatagattacaacaaagagatcgaaacatattataaaagcaatgctgcagcctatagagctgacctgaacaccataatggacacattaaaaacggcattcagagggcttacaaaggtcctaattgaaaattatatagaaaaagatgactctgatgctcttaaggctttatttagtaatattactgattctgtccaggacaattatcagatgattggaatattgaaatttgccagtaagctattagatattaaccttggtagatccacccgctcagctcatcattctataatgacaaacgaaattcccaaatctaatccttttactgattacagttattccaatgtgaacataaaggagtgcatgtcaccagagagcttgaaatgttttaagaagagagacagtacaccgcatacaaaccacctgctttgcaagatagacagcaaatataaagcatttgactggccagagatagaaacaattcaaaaaggtcaaaaattgtgtcttggtgacagtcattgcaacttggaatttacagccataactgcagataagattatgtcattaactaactgttataaggaatctttcactgcgcaaccagcagatatgcagactggaattaaaaaatgctcagctgatgaaattggagaatgtacaacacttgaagacaagacatggccgatcgtattctgtggtggcaaatattactactctgatagcaaagagcatgccaaggacggttctatcaacaactattgtttaacaaacaaatgctctgaacaacgttttccaatacatgaaaattggtttaaaaaatgtaattgggacaagacccacaaagaatttagcactatgagacagataaactataatgatataacttcttatagaaaagcaatagaatctgagataggatcagatttgatgacacaccattataagcccacaaagaaccttccacatgttgtgccaaggtatcatagtatagatgtacaaggtacagaatcaacagagggtattatcaatggtttcatacaaaatacaatacctgctattagtggtctaggtgtcggttatcatctgaatttcaaaggcaatcagttatttgacatagttatttttgtgaaaaaagctgtatataaagcacagtaccagaaagcatacaccacaggtcccagtatatccataaatattgaacacaatgaaagatgtacaggccactgccccgaaaagattcctgcaaaagaaggttggctaacattttctaaagaacatactagttcttggggatgtgaagaatatggctgtcttgctatagatacaggctgtctatatggttcttgtcaagatgtcatacgcccagaattagatgtttataagaagattggcagtgaagtatcactgatagaaatatgcataactttgcctcatgaaacttattgcaatgatatggatatattagaaccgattataggtgataaattaagtgcatcctttcagaatacgcagactaaccaacttccgacccttatagcttataaaaaagggaaaatatacacaggtcaaatcaatgatattggaaatacagcattgcagtgcggctcaatccaagtaattaatgggtcaactatcggaactggcagccccaaattcgattatatatgccatgctatgagaaggaaagatgttattgtaaggaagtgtttcaatgacaattatcagtcatgcactaggttagaaaaacggaatgacttgatcccttatagaaaaggcgatgtcattgaagtatcaaaaacaggatcaaacatgggccaaatgacattcaaaatagaactaggtgatgtcaactataaaatattcactaaatcaatagatcttcaaatgtctggcatttgtgctgggtgcattgactgtgctgaaggtatttcatgctctataaatgctgaagtgccggccgaaacagtctgccattgtaaaacaaactgtgaagattttataaataatatagtgttttcaccacaaatcaagaattacaatataaaagtccactgtaaatctaaagttgaaaagataatagcacatatctgtgggagagacatcgatttacaattaactgttaaaccatacaatcagaagatagatttgtcgcagttagatgaatcaaattacataagggaagaggatctccagtgcgggacatggttatgtaaagtgcaaaaagagggggttgatattatattcaaaggattattttcaggcttagggagatattggaccatattgatttattcaattataggtgtggtaataattgtgatattggtttatatcctgttgcccataggtcggcttttaaaagcattcctaatcagacatgaaatagaatatgccatggagcaaaaaatcaagtag

SEQ ID NO: 4299 - RNA, 4263 nt, synthetic construct
  misc_feature 1..4263: note = derived and/or modified CDS sequence (wt) from OROV(BeH759022)__KP691610.1__GP
  source 1..4263: mol_type = other RNA
atggcgaatttaataattatttcaatggctctgagcgttgcctacgggcatcctctttcaacaagtcaaattggtgaccgctgtttcgctggtggtaacctcttcaaggagatgaacttgagtgtaggacttggcgaaatatgtgttaaagatgacatatctattgttaaaagtactactgtttttagtaagaatagaccagctcttgaggcaaccacaaaattttatagatcttttattgtgaaagattggtctgagtgcaatccagtgctagataaatttggaaattttatggttttaagtgttgatgataatggccatataatgcctaaaatgtacacatgtagagcagcatgtgatattagattaaacaaagataatgctgaaataatattatcgtcaacaaagctcaaccacttcgaaattgtcggaacaacttcgacatcaggctggttcaaaaacacaataacaaacaatttggaacacacatgcgagcatgtgaccgtaaattgtggtcagaaatcagtaaaattccatgcatgctttagacaacataggggttgtataagattctttaaaggaacatatatgccatactcaatgattgaagcaatgtgtgttaacatagagctaataattctgacattatatatctttgctgcaattatatttgcattaattataacaaagagttatgtggcatacctgctcctgccgttattttatccagtgacatggttttacggaaaggtttataaaaagattaattcctgcccaaattgtctacttgcatctcatcctttcaccagctgccctaaaatctgtatatgcggttctagatttagttgcacagaagctcttaaggtgcatagaatgggtaaggactgcttaggttataaatctctaagcaaagctagacagatgtgtaagtcgaaaagctggtcctttacagcagctatattaactggattaatattgatggaatttatctcaccaattgcaggagagagaatgtataagcttgaggagttagctgatgagtttataaagctaacagagcaggtaaatattttagaaagagaaatggaagtcttgaagcagtcaataattgttatgtttgcaatcattttggtattgttgctttttgaaaatatgatattcaaccggcttttcagcattttttatcgttcttgctccatgtgtggtttgatacattatagaccaggactcaagattgatttaaccaaaactaataaatgcggtagttgcatctgtggattcaatgagcagcaatcatctggttttgaatatgaaatatttctaaaggatatgcatatccagaaagaatcatgcaaatttagtccaagagtaaaccactttaggaatattaaagctttattatttgcacttgtaatctgtgctactatatatacagtttatgcagatgaagattgcttgtctaaagacattaaaataacatatcaagagttgcataattgcataggcccaaagataatgggcaacacttgtgtatcaaagaatgaattgtattctgatttattctcaaaaaatctagtcacagaatatgataaaaaatattttgaacctgatactgtaaatgatcaattcaacaaaatagagtttgcccaagatgcacatagaatgatactattagaaagaatactttacaagacagaatgtgaaatgctaagcttaaaaaagaacagtggaccttataatgttgcctggcgcacatatttaaaaaatcataatatagacctatgcagtaggcacaactataaaatgatatgtcagtgtattaatacacactctatgtgtaagaacacagatatagattacaacaaagagatcgaaacatattataaaagcaatgctgcagcctatagagctgacctgaacaccataatggacacattaaaaacggcattcagaggacttacaaaggtcctaattgaaaattatatagaaaaagatgactctgatgctcttaaggctttatttagtaatattactgattctgtccaggacaattatcagatgattggaatattgaaatttgccagtaagctattagatattaaccttggtagatccacccgctcagctcatcattctataatgacaaacgaaattcccaaatctaatccttttactgattacagttattccaatgtgaacataaaggagtgcatgtcaccagagagcttgaaatgttttaagaagagagacagtacaccgcatacaaaccacctgctttgcaagatagacagcaaatataaagcatttgactggccagagatagaaacaattcaaaaaggtcaaaaattgtgtcttggtgacagtcattgcaacttggaatttacagccataactgcagataagattatgtcattaactaactgttataaggaatctttcactgcgcaaccagcagatatgcagactggaattaaaaaatgctcagctgatgaaattggagaatgtacaacacttgaagacaagacatggccgatcgtattctgtggtggcaaatattactactctgatagcaaagagcatgccaaggacggttctatcaacaactattgtttaacaaacaaatgctctgaacaacgttttccaatacatgaaaattggtttaaaaaatgtaattgggacaagacccacaaagaatttagcactatgagacagataaactataatgatataacttcttatagaaaagcaatagaatctgagataggatcagatttgatgacacaccattataagcccacaaagaaccttccacatgttgtgccaaggtatcatagtatagatgtacaaggtacagaatcaacagagggtattatcaatggtttcatacaaaatacaatacctgctattagtggtctaggtgtcggttatcatctgaatttcaaaggcaatcagttatttgacatagttatttttgtgaaaaaagctgtatataaagcacagtaccagaaagcatacaccacaggtcccagtatatccataaatattgaacacaatgaaagatgtacaggccactgccccgaaaagattcctgcaaaagaaggttggctaacattttctaaagaacatactagttcttggggatgtgaagaatatggctgtcttgctatagatacaggctgtctatatggttcttgtcaagatgtcatacgcccagaattagatgtttataagaagattggcagtgaagtatcactgatagaaatatgcataactttgcctcatgaaacttattgcaatgatatggatatattagaaccgattataggtgataaattaagtgcatcctttcagaatacgcagactaaccaacttccgacccttatagcttataaaaaagggaaaatatacacaggtcaaatcaatgatattggaaatacagcattgcagtgcggctcaatccaagtaattaatgggtcaactatcggaactggcagccccaaattcgattatatatgccatgctatgagaaggaaagatgttattgtaaggaagtgtttcaatgacaattatcagtcatgcactaggttagaaaaacggaatgacttgatcccttatagaaaaggcgatgtcattgaagtatcaaaaacaggatcaaacatgggccaaatgacattcaaaatagaactaggtgatgtcaactataaaatattcactaaatcaatagatcttcaaatgtctggcatttgtgctgggtgcattgactgtgctgaaggtatttcatgctctataaatgctgaagtgccggccgaaacagtctgccattgtaaaacaaactgtgaagattttataaataatatagtgttttcaccacaaatcaagaattacaatataaaagtccactgtaaatctaaagttgaaaagataatagcacatatctgtgggagagacatcgatttacaattaactgttaaaccatacaatcagaagatagatttgtcgcagttagatgaatcaaattacataagggaagaggatctccagtgcgggacatggttatgtaaagtgcaaaaagagggggttgatattatattcaaaggattattttcaggcttagggagatattggaccatattgatttattcaattataggtgtggtaataattgtgatattggtttatatcctgttgcccataggtcggcttttaaaagcattcctaatcagacatgaaatagaatatgccatggagcaaaaaatcaagtag

SEQ ID NO: 4300 - RNA, 4263 nt, synthetic construct
  misc_feature 1..4263: note = derived and/or modified CDS sequence (wt) from OROV(BeH759040)__KP691616.1__GP
  source 1..4263: mol_type = other RNA
atggcgaatttaataattatttcaatgattctgagcgttgcctacgggcatcctctttcaacaagtcaaattggtgaccgctgtttcgctggtggtaacctcttcaaggagatgaacttgagtgtaggacttggcgaaatatgtgttaaagatgacatatctattgttaaaagtactactgtttttagtaagaatagaccagctcttgaggcaaccacaaaattttatagatcttttattgtgaaagattggtctgagtgcaatccagtgctagataaatttggaaattttatggttttaagtgttgatgataatggccatataatgcctaaaatgtacacatgtagagcagcatgtgatattagattaaacaaagataatgctgaaataatattatcgtcaacaaagctcaaccacttcgaaattgtcggaacaacttcgacatcaggctggttcaaaaacacaataacaaacaatttggaacacacatgcgagcatgtgaccgtaaattgtggtcagaaatcagtaaaattccatgcatgctttagacaacataggggttgtataagattctttaaaggaacatatatgccatactcaatgattgaagcaatgtgtgttaacatagagctaataattctgacattatatatctttgctgcaattatatttgcattaattataacaaagagttatgtggcatacctgctcctgccgttattttatccagtgacatggttttacggaaaggtttataaaaagattaattcctgcccaaattgtctacttgcatctcatcctttcaccagctgccctaaaatctgtatatgcggttctagatttagttgcacagaagctcttaaggtgcatagaatgggtaaggactgcttaggttataaatctctaagcaaagctagacagatgtgtaagtcgaaaagctggtcctttacagcagctatattaactggattaatattgatggaatttatctcaccaattgcaggagagagaatgtataagcttgaggagttagctgatgagtttataaagctaacagagcaggtaaatattttagaaagagaaatggaagtcttgaagcagtcaataattgttatgtttgcaatcattttggtattgttgctttttgaaaatatgatattcaaccggcttttcagcattttttatcgttcttgctccatgtgtggtttgatacattatagaccaggactcaagattgatttaaccaaaactaataaatgcggtagttgcatctgtggattcaatgagcagcaatcatctggttttgaatatgaaatatttctaaaggatatgcatatccagaaagaatcatgcaaatttagtccaagagtaaaccactttaggaatattaaagctttattatttgcacttgtaatctgtgctactatatatacagtttatgcagatgaagattgcttgtctaaagacattaaaataacatatcaagagttgcataattgcataggcccaaagataatgggcaacacttgtgtatcaaagaatgaattgtattctgatttattctcaaaaaatctagtcacagaatatgataaaaaatattttgaacctgatactgtaaatgatcaattcaacaaaatagagtttgcccaagatgcacatagaatgatactattagaaagaatactttacaagacagaatgtgaaatgctaagcttaaaaaagaacagtggaccttataatgttgcctggcgcacatatttaaaaaatcataatatagacctatgcagtaggcacaactataaaatgatatgtcagtgtattaatacacactctatgtgtaagaacacagatatagattacaacaaagagatcgaaacatattataaaagcaatgctgcagcctatagagctgacctgaacaccataatggacacattaaaaacggcattcagagggcttacaaaggtcctaattgaaaattatatagaaaaagatgactctgatgctcttaaggctttatttagtaatattactgattctgtccaggacaattatcagatgattggaatattgaaatttgccagtaagctattagatattaaccttggtagatccacccgctcagctcatcattctataatgacaaacgaaattcccaaatctaatccttttactgattacagttattccaatgtgaacataaaggagtgcatgtcaccagagagcttgaaatgttttaagaagagagacagtacaccgcatacaaaccacctgctttgcaagatagacagcaaatataaagcatttgactggccagagatagaaacaattcaaaaaggtcaaaaattgtgtcttggtgacagtcattgcaacttggaatttacagccataactgcagataagattatgtcattaactaactgttataaggaatctttcactgcgcaaccagcagatatgcagactggaattaaaaaatgctcagctgatgaaattggagaatgtacaacacttgaagacaagacatggccgatcgtattctgtggtggcaaatattactactctgatagcaaagagcatgccaaggacggttctatcaacaactattgtttaacaaacaaatgctctgaacaacgttttccaatacatgaaaattggtttaaaaaatgtaattgggacaagacccacaaagaatttagcactatgagacagataaactataatgatataacttcttatagaaaagcaatagaatctgagataggatcagatttgatgacacaccattataagcccacaaagaaccttccacatgttgtgccaaggtatcatagtatagatgtacaaggtacagaatcaacagagggtattatcaatggtttcatacaaaatacaatacctgctattagtggtctaggtgtcggttatcatctgaatttcaaaggcaatcagttatttgacatagttatttttgtgaaaaaagctgtatataaagcacagtaccagaaagcatacaccacaggtcccagtatatccataaatattgaacacaatgaaagatgtacaggccactgccccgaaaagattcctgcaaaagaaggttggctaacattttctaaagaacatactagttcttggggatgtgaagaatatggctgtcttgctatagatacaggctgtctatatggttcttgtcaagatgtcatacgcccagaattagatgtttataagaagattggcagtgaagtatcactgatagaaatatgcataactttgcctcatgaaacttattgcaatgatatggatatattagaaccgattataggtgataaattaagtgcatcctttcagaatacgcagactaaccaacttccgacccttatagcttataaaaaagggaaaatatacacaggtcaaatcaatgatattggaaatacagcattgcagtgcggctcaatccaagtaattaatgggtcaactatcggaactggcagccccaaattcgattatatatgccatgctatgagaaggaaagatgttattgtaaggaagtgtttcaatgacaattatcagtcatgcactaggttagaaaaacggaatgacttgatcccttatagaaaaggcgatgtcattgaagtatcaaaaacaggatcaaacatgggccaaatgacattcaaaatagaactaggtgatgtcaactataaaatattcactaaatcaatagatcttcaaatgtctggcatttgtgctgggtgcattgactgtgctgaaggtatttcatgctctataaatgctgaagtgccggccgaaacagtctgccattgtaaaacaaactgtgaagattttataaataatatagtgttttcaccacaaatcaagaattacaatataaaagtccactgtaaatctaaagttgaaaagataatagcacatatctgtgggagagacatcgatttacaattaactgttaaaccatacaatcagaagatagatttgtcgcagttagatgaatcaaattacataagggaagaggatctccagtgcgggacatggttatgtaaagtgcaaaaagagggggttgatattatattcaaaggattattttcaggcttagggagatattggaccatattgatttattcaattataggtgtggtaataattgtgatattggtttatatcctgttgcccataggtcggcttttaaaagcattcctaatcagacatgaaatagaatatgccatggagcaaaaaatcaagtag

SEQ ID NO: 4301 - RNA, 4263 nt, synthetic construct
  misc_feature 1..4263: note = derived and/or modified CDS sequence (wt) from OROV(BeH759146)__KP691631.1__GP
  source 1..4263: mol_type = other RNA
atggcgaatttaataattatctcaatggttctgagcgttgcctacgggcatcctctttcaacaagtcaaattggtgaccgctgtttcgctggtggtaacctcttcaaggagatgaacttgagtgtaggacttggcgaaatatgtgttaaagatgacatatctattgttaaaagtactactgtttttagtaagaatagaccagctcttgaggcaaccacaaaattttatagatcttttattgtgaaagattggtctgagtgcaatccagtgctagataaatttggaaattttatggttttaagtgttgatgataatggccatataatgcctaaaatgtacacatgtagagcagcatgtgatattagattaaacaaagataatgctgaaataatattatcgtcaacaaagctcaaccacttcgaaattgtcggaacaacttcgacatcaggctggttcaaaaacacaataacaaacaatttggaacacacatgcgagcatgtgaccgtaaattgttgtcagaaatcagtaaaattccatgcatgctttagacaacataggggttgtataagattctttaaaggaacatatatgccatactcaatgattgaagcaatgtgtgttaacatagagctaataattctgacattatatatctttgctgcaattatatttgcattaattataacaaagagttatgtggcatacctgctcctgccgttattttatccagtgacatggttttacggaaaggtttataaaaagattaattcctgcccaaattgtctacttgcatctcatcctttcaccagctgccctaaaatctgtatatgcggttctagatttagttgcacagaagctcttaaggtgcatagaatgggtaaggactgcttaggttataaatctctaagcaaagctagacagatgtgtaagtcgaaaagctggtcctttacagcagctatattaactggattaatattgatggaatttatctcaccaattgcaggagagagaatgtataagcttgaggagttagctgatgagtttataaagctaacagagcaggtaaatattttagaaagagaaatggaagtcttgaagcagtcaataattgttatgtttgcaatcattttggtattgttgctttttgaaaatatgatattcaaccggcttttcagcattttttatcgttcttgctccatgtgtggtttgatacattatagaccaggactcaagattgatttaaccaaaactaataaatgcggtagttgcatctgtggattcaatgagcagcaatcatctggttttgaatatgaaatatttctaaaggatatgcatatccagaaagaatcatgcaaatttagtccaagagtaaaccactttaggaatattaaagctttattatttgcacttgtaatctgtgctactatatatacagtttatgcagatgaagattgcttgtctaaagacattaaaataacatatcaagagttgcataattgcataggcccaaagataatgggcaacacttgtgtatcaaagaatgaattgtattctgatttattctcaaaaaatctagtcacagaatatgataaaaaatattttgaacctgatactgtaaatgatcaattcaacaaaatagagtttgcccaagatgcacatagaatgatactattagaaagaatactttacaagacagaatgtgaaatgctaagcttaaaaaagaacagtggaccttataatgttgcctggcgcacatatttaaaaaatcataatatagacctatgcagtaggcacaactataaaatgatatgtcagtgtattaatacacactctatgtgtaagaacacagatatagattacaacaaagagatcgaaacatattataaaagcaatgctgcagcctatagagctgacctgaacatcataatggacacattaaaaacggcattcagagggcttacaaaggtcctaattgaaaattatatagaaaaagatgactctgatgctcttaaggctttatttagtaatattactgattctgtccaggacaattatcagatgattggaatattgaaatttgccagtaagctattagatattaaccttggtagatccacccgctcagctcatcattctataatgacaaacgaaattcccaaatctaatccttttactgattacagttattccaatgtgaacataaaggagtgcatgtcaccagagagcttgaaatgttttaagaagagagacagtacaccgcatacaaaccacctgctttgcaagatagacagcaaatataaagcatttgactggccagagatagaaacaattcaaaaaggtcaaaaattgtgtcttggtgacagtcattgcaacttggaatttacagccataactgcagataagattatgtcattaactaactgttataaggaatctttcactgcgcaaccagcagatatgcagactggaattaaaaaatgctcagctgatgaaattggagaatgtacaacacttgaagacaagacatggccgatcgtattctgtggtggcaaatattactactctgatagcaaagagcatgccaaggacggttctatcaacaactattgtttaacaaacaaatgctctgaacaacgttttccaatacatgaaaattggtttaaaaaatgtaattgggacaagacccacaaagaatttagcactatgagacagataaactataatgatataacttcttatagaaaagcaatagaatctgagataggatcagatttgatgacacaccattataagcccacaaagaaccttccacatgttgtgccaaggtatcatagtatagatgtacaaggtacagaatcaacagagggtattatcaatggtttcatacaaaatacaatacctgctattagtggtctaggtgtcggttatcatctgaatttcaaaggcaatcagttatttgacatagttatttttgtgaaaaaagctgtatataaagcacagtaccagaaagcatacaccacaggtcccagtatatccataaatattgaacacaatgaaagatgtacaggccactgccccgaaaagattcctgcaaaagaaggttggctaacattttctaaagaacatactagttcttggggatgtgaagaatatgtctgtctcgctatagatacaggctgtctatatggttcttgtcaagatgtcatacgcccagaattagatgtttataagaagattggcagtgaagtatcactgatagaaatatgcataactttgcctcatgaaacttattgcaatgatatggatatattagaaccgattataggtgataaattaagtgcatcctttcagaatacgcagactaaccaacttccgacccttatagcttataaaaaagggaaaatatacacaggtcaaatcaatgatattggaaatacagcattgcagtgcggctcaatccaagtaattaatgggtcaactatcggaactggcagccccaaattcgattatatatgccatgctatgagaaggaaagatgttattgtaaggaagtgtttcaatgacaattatcagtcatgcactaggttagaaaaacggaatgacttgatcccttatagaaaaggcgatgtcattgaagtatcaaaaacaggatcaaacatgggccaaatgacattcaaaatagaactaggtgatgtcaactataaaatattcactaaatcaatagatcttcaaatgtctggcatttgtgctgggtgcattgactgtgctgaaggtatttcatgctctataaatgctgaagtgccggccgaaacagtctgccattgtaaaacaaactgtgaagattttataaataatatagtgttttcaccacaaatcaagaattacaatataaaagtccactgtaaatctaaagttgaaaagataatagcacatatctgtgggagagacatcgatttacaattaactgttaaaccatacaatcagaagatagatttgtcgcagttagatgaatcaaattacataagggaagaggatctccagtgcgggacatggttatgtaaagtgcaaaaagagggggttgatattatattcaaaggattattttcaggcttagggagatattggaccatattgatttattcaattataggtgtggtaataattgtgatattggtttatatcctgttgcccataggtcggcttttaaaagcattcctaatcagacatgaaatagaatatgccatggagcaaaaaatcaagtag

SEQ ID NO: 4302 - RNA, 4263 nt, synthetic construct
  misc_feature 1..4263: note = derived and/or modified CDS sequence (wt) from OROV(BeH759620)__KP691622.1__GP
  source 1..4263: mol_type = other RNA
atggcgaatttaataattatttcaatggttctgagcgttgcctacgggcatcctctttcaacaagtcaaattggtgaccgctgtttcgctggtggtaacctcttcaaggagatgaacttgagtgtaggacttggcgaaatatgtgttaaagatgacatatctattgttaaaagtactactgtttttagtaagaatagaccagctcttgaggcaaccacaaaattttatagatcttttattgtgaaagattggtctgagtgcaatccagtgctagataaatttggaaattttatggttttaagtgttgatgataatggccatataatgcctaaaatgtacacatgtagagcagcatgtgatattagattaaacaaagataatgctgaaataatattatcgtcaacaaagctcaaccacttcgaaattgtcggaacaacttcgacatcaggctggttcaaaaacacaataacaaacaatttggaacacacatgcgagcatgtgaccgtaaattgtggtcagaaatcaataaaattccatgcatgctttagacaacataggggttgtataagattctttaaaggaacatatatgccatactcaatgattgaagcaatgtgtgttaacatagagctaataattctgacattatatatctttgctgcaattatatttgcattaattataacaaagagttatgtggcatacctgctcctgccgttattttatccagtgacatggttttacggaaaggtttataaaaagattaattcctgcccaaattgtctacttgcatctcatcctttcaccagctgccctaaaatctgtatatgcggttctagatttagttgcacagaagctcttaaggtgcatagaatgggtaaggactgcttaggttataaatctctaagcaaagctagacagatgtgtaagtcgaaaagctggtcctttacagcagctatattaactggattaatattgatggaatttatctcaccaattgcaggagagagaatgtataagcttgaggagttagctgatgagtttataaagctaacagagcaggtaaatattttagaaagagaaatggaagtcttgaagcagtcaataattgttatgtttgcaatcattttggtattgttgctttttgaaaatatgatattcaaccggcttttcagcattttttatcgttcttgctccatgtgtggtttgatacattatagaccaggactcaagattgatttaaccaaaactaataaatgcggtagttgcatctgtggattcaatgagcagcaatcatctggttttgaatatgaaatatttctaaaggatatgcatatccagaaagaatcatgcaaatttagtccaagagtaaaccactttaggaatattaaagctttattatttgcacttgtaatctgtgctactatatatacagtttatgcagatgaagattgcttgtctaaagacattaaaataacatatcaagagttgcataattgcataggcccaaagataatgggcaacacttgtgtatcaaagaatgaattgtattctgatttattctcaaaaaatctagtcacagaatatgataaaaaatattttgaacctgatactgtaaatgatcaattcaacaaaatagagtttgcccaagattcacatagaatgatactattagaaagaatactttacaagacagaatgtgaaatgctaagcttaaaaaagaacagtggaccttataatgttgcctggcgcacatatttaaaaaatcataatatagacctatgcagtaggcacaactataaaatgatatgtcagtgtattaatacacactctatgtgtaagaacacagatatagattacaacaaagagatcgaaacatattataaaagcaatgccgcagcctatagagctgacctgaacaccataatggacacattaaaaacggcattcagagggcttacaaaggtcctaattgaaaattatatagaaaaagatgactctgatgctcttaaggctttatttagtaatattactgattctgtccaggacaattatcagatgattggaatattgaaatttgccagtaagctattagatattaaccttggtagatccacccgctcagctcatcattctataatgacaaacgaaattcccaaatctaatccttttactgattacagttattccaatgtgaacataaaggagtgcatgtcaccagagagcttgaaatgttttaagaagagagacagtacaccgcatacaaaccacctgctttgcaagatagacagcaaatataaagcatttgactggccagagatagaaacaattcaaaaaggtcaaaaattgtgtcttggtgacagtcattgcaacttggaatttacagccataactgcagataagattatgtcattaactaactgttataaggaatctttcactgcgcaaccagcagatatgcagactggaattaaaaaatgctcagctgatgaaattggagaatgtacaacacttgaagacaagacatggccgatcgtattctgtggtggcaaatattactactctgatagcaaagagcatgccaaggacggttctatcaacaactattgtttaacaaacaaatgctctgaacaacgttttccaatacatgaaaattggtttaaaaaatgtaattgggacaagacccacaaagaatttagcactatgagacagataaactataatgatataacttcttatagaaaagcaatagaatctgagataggatcagatttgatgacacaccattataagcccacaaagaaccttccacatgttgtgccaaggtatcatagtatagatgtacaaggtacagaatcaacagagggtattatcaatggtttcatacaaaatacaatacctgctattagtggtctaggtgtcggttatcatctgaatttcaaaggcaatcagttatttgacatagttatttttgtgaaaaaagctgtatataaagcacagtaccagaaagcatacaccacaggtcccagtatatccataaatattgaacacaatgaaagatgtacaggccactgccccgaaaagattcctgcaaaagaaggttggctaacattttctaaagaacatactagttcttggggatgtgaagaatatggctgtcttgctatagatacaggctgtctatatggttcttgtcaagatgtcatacgcccagaattagatgtttataagaagattggcagtgaagtatcactgatagaaatatgcataactttgcctcatgaaacttattgcaatgatatggatatattagaaccgattataggtgataaattaagtgcatcctttcagaatacgcagactaaccaacttccgacccttatagcttataaaaaagggaaaatatacacaggtcaaatcaatgatattggaaatacagcattgcagtgcggctcaatccaagtaattaatgggtcaactatcggaactggcagccccaaattcgattatatatgccatgctatgagaaggaaagatgttattgtaaggaagtgtttcaatgacaattatcagtcatgcactaggttagaaaaacggaatgacttgatcccttatagaaaaggcgatgtcattgaagtatcaaaaacaggatcaaacatgggccaaatgacattcaaaatagaactaggtgatgtcaactataaaatattcactaaatcaatagatcttcaaatgtctggcatttgtgctgggtgcattgactgtgctgaaggtatttcatgctctataaatgctgaagtgccggccgaaacagtctgccattgtaaaacaaactgtgaagattttataaataatatagtgttttcaccacaaatcaagaattacaatataaaagtccactgtaaatctaaagttgaaaagataatagcacatatctgtgggagagacatcgatttacaattaactgttaaaccatacaatcagaagatagatttgtcgcagttagatgaatcaaattacataagggaagaggatctccagtgcgggacatggttatgtaaagtgcaaaaagagggggttgatattatattcaaaggattattttcaggcttagggagatattggaccatattgatttattcaattataggtgtggtaataattgtgatattggtttatatcctgttgcccataggtcggcttttaaaagcattcctaatcagacatgaaatagaatatgccatggagcaaaaaatcaagtag

SEQ ID NO: 4303 - RNA, 4263 nt, synthetic construct
  misc_feature 1..4263: note = derived and/or modified CDS sequence (wt) from OROV(BeAn19991)__KP052851.1__GP
  source 1..4263: mol_type = other RNA
atggcgaatttaataattatttcaatggttctgggcgttgcctatgggcatccgctttcaacaagtcaaattggtgaccgctgttttgctggtggtaacctcttcaaggagatgaacttgagtgtaggacttggcgaaatatgtgttaaagatgacatatctattgttaagagtactactgtttttagcaagaataaaccagctcttgaggcaactacaaaattttatagatcttttattgtgaaagattggtctgagtgcaatccagtgctagacaaatttggaaattttatggttttaagtgttgatgataatggccatataatacctaaaatgtatacatgtagagcagcatgtgatattagattaaacaaagataatgccgaaataatattatcgtcaacaaaactcaaccactttgaaattgtcgggacaacttcgacatcaggctggttcaagaacacaataacaaacaacttagaacatacatgcgagcatgtaaccgtaaattgtggtcagaaatcagtaaaattccatgcatgctttagacaacataggggttgtataagattctttaaaggaacatatatgccatactcaatgattgaagcaatgtgcgttaacatagagctaataattctgacattatatatctttgctgcaattatatttgcattaattataacaaagagttatgtggcatacttgctcctgccgttattttatccagtgacgtggttttacggaaaggtttataaaaagattaattcttgcccaaattgtctacttgcatctcaccctttcaccagctgccctaaaatctgtatatgcggttctaggtttagttgcacagaagctcttaaggtacatagaatgggtaaggactgcttaggttataagtctctaagcaaagctagacagatgtgtaaatcgaaaagctggtccttcacagcagctatattaactggattaatattgatggaattcatctcaccaattgcaggagagagaatgtataagcttgaggagctggctgatgagtttataaagctaacagagcaggtaaatattttagaaagagaaatggaagtcttgaagcagtcaataattgttatgtttgcaatcattttggtattgttgctttttgaaaatatgatattcaaccggcttttccgcattttttatcgttcttgctccatgtgcggcttgatacattatagaccaggactcaagatcgatttaaccaaaactaacagatgtggtagttgcatctgtggattcgacgagcagcaatcatctggttttgaatatgaaatatttctaaaggatatgcatgtccagaaagaatcatgcaaatttagtccaagagtaaaccactttaggaatattaaagctttattatttgcacttgtaatctgtgctactatatatacagtttatgcagatgaagattgcttatctaaagatattaaaataacatatcaagagttgcacaattgcataggtccaaagataatgggcgatacttgtgtatcaaagagtgaattgtattctgatttattctcaaaaaatctagtcacagaatatgataaaaaatattttgaacctgatactgtaaatgatcaattcaacaagatagagtttgcccaagatgcacatagaatgatactattagaaagaatactttacaagacagaatgtgaaatgctaagcttaaaaaagaacagtggaccttataatgttgcctggcgcacatattttaaaaatcataatatagacttatgcagtaggcacaactacaaaatgatatgtcagtgtattaatacacactctatgtgtaagaatacagatatagattataacaaagagatcgaaacatattataaaagcaatgctgcagcctatagagctgacctgaacaccataatggacacattaaaaacagcattcagagggcttacaaaggtcctaattgaaaattatatagaaaaagatgactctgatgctcttaaggccttatttagtaatattactgattctgttcaggacaattatcagatgattggaatattgaaatttgccagtaagctattagatattaaccttggtagatccacccgctcagctcatcattctataatgacaaacgaaattcccaaatctaatccttttactgattacagttattctaatctgaatataaaggagtgcatgtcaccagagagcttgaaatgttttaagaagagagacagtacaccgcatacaaaccacctgctttgcaagatagacaacaaatataaagcatttgactggccagagatagaaacaattcaaaaaggtcaaaaattgtgccttggtgacagtcattgcaacttggaatttacagccataactgcagacaagattatgtcattaactaactgttataaagaatctttcactgcgcaaccagcagatatgcaggctggaattaaaaaatgctcagctgatgaaattggagaatgtacaacacttgaagacaagacatggccaattatattctgtggtggcaaatattactactctgatagcaaggagcatgccaaggacggttctatcaacaattattgtttaaccaacaaatgctctgaacaacgtttcccaatacatgaaaattggttcaaaaaatgtaattgggacaagacccacaaagaatttagcactatgagacaaataaactataatgatataacttcttatagaaaggcaatagaatctgagataggaacagatttgatgacacaccattataagcccacaaagaaccttccacatgttgtaccaaggtatcatagtatagatgtacaaggtacagaatcaacagagggtattatcaatggtttcatacaaaatacaatacctgctattagtggtctaggtgtcggttatcatctgaatttcaaaggcaatcagttatttgacatagttatttttgtgaaaaaagctgtatataaagcacagtaccagaaagcatacaccacaggtcctagcatatccataaatattgaacacaacgaaagatgcacaggccactgccccgaaaagattcctgcaaaagaaggttggttaacattttctaaagagcatactagttcttggggatgtgaagaatatggctgtcttgctatagatacaggctgtctatatggctcttgtcaagatgtcatacgcccagaattagatgtttataagaagattggcagtgaggtatcactgatagaaatatgtataactttgcctcatgaaacttattgcaatgatatggacatattagaaccgattataggagataaattaagtgcatcctttcagaatacacagactaatcaacttccgacccttatagcttataaaaaagggaagatatacacaggtcaaatcaacgatattggaaacacagcattgcagtgcggctcaatccaagtaatcaatggatcaactatcggaactggcagccccaaatttgattatatatgccatgctatgagaaggaaagatgttattgtaaggaagtgtttcaatgacaattatcagtcgtgcactaggctagaaaaacgaaacgacttgatcccttatagaaaaggcgatgtcatcgaagtatcaaaaacaggatcgaacatgggccaaatgacatttaaaatagaactaggtgatatcaactataaaatatttactaaatcaatagatcttcaaatgtctggcatttgtgctgggtgcattgactgtgctgaaggcatttcatgctctataaatgctgaagtgccagccgaaacagtctgccattgcaaaacaaactgtgaagattttataaacaatatagtgttttcaccgcaaatcaagaattacaatataaaagtccactgtaaatctaaagttgaaaaaataacagcacatatctgtgggagagacattgatttacagttaacaattaagccatacaatcagaagatagacttgtcgcagttagatgaatcaaattacataagggaagaggacctccagtgtggaacatggttatgtaaagtgcaaaaagaggggattgatattatatttaaaggattattttcaggcttagggagatattggaccatattaatttattcaattataggtgtggtaataattgtgatattggtttatatcctgttgcccataggtcggcttttaaaagcattcctaatcagacatgaaatagaatatgccatggagcagaaaatcaagtag

SEQ ID NO: 4304 - RNA, 4263 nt, synthetic construct
  misc_feature 1..4263: note = derived and/or modified CDS sequence (wt) from OROV(Tr9760)__AF312381.2__GP
  source 1..4263: mol_type = other RNA
atggcgaatttaataattatttcgatggttctgagcattgcctatgggcatccgctctcaacaagtcaaattggtgaccgctgttttgctggtggtaacctcttcaaggagatgaacttgagtgtaggacttggcgaaatatgtgttaaagatgacatatctattgttaagagtactactgtttttagcaagaataaactggctcttgaagcaactacaaaattttatagatcctttatcgtaaaagactggtctgagtgcaatccagtgctagacaaatttggaaattttatggttttaagtgttgatgataacggccatacaatacctaaaatgtatacatgtagagcagcatgtgatattagattaaacaaagataatgccgaaataatattatcgtcaacaaaactcaaccactttgaaattgtcgggacaacttcgacatcaggctggtttaagaacacaataacaaacaacctagaacatacatgcgagcatgtaactgtaaattgtggtcagaaatcagtaaaattccatgcatgctttagacaacataggggttgtgtaagattttttaaagggacatatatgccacactcaatgatcgaagcaatgtgcgttaacatagagctaataattctgacattatatatctttgctgcaattatatttgcactaattataacaaagagttatgtagcatacctgctcctgccgttattttatccagcaacgtggttttatggaaaggtttataaaaagattaattcttgcccaaactgtctacttgcatctcaccctttcaccagctgccccaaaatctgtatatgcggttctaggtttagttgcacagaagctcttaaggtgcatagaatgggtaaggactgcttaggctataaatctctaagcaaagctagacagatgtgtaaatcgaaaagctggtccttcacagcagctatattaactggattaatattgatggaattcatctcaccaattgcaggagagagaatgtataagcttgaggagttggccgatgagtttataaagctaacagagcaggtgaatattctagaaagagaaatggaagtcttgaagcagtcaataattgttatgtttgcaatcattttagtattgttactttttgaaaatatgatattcaaccggcttttccgcattttttatcgttcttgctccatgtgcggcttgatacattatagaccaggactcaaaatcgatttaaccaaaactaacagatgtggcagttgcatctgtggattcgacgagcagcagtcgtctggttttgaatatgaaatatttttaacggatatgcatgtccaaaaagaatcatgcaaattcagtccaagagtaaaccactttaggaatactaaagctttattatttgcacttgtaatctgtgctaccatatatacagtttatgcagatgaagattgcttatctaaagatattaaaataacatatcaagagttgcacaactgcataggtccaaagataatgggcgatacttgtgtatcaaagagtgaattgtattctgatttattctcaaaaaatctagtcacagaatatgataaaaaatattttgaacctgatactgtaaatgatcaattcaacaagatagaatttgcccaagatgcacatagaatgatactattagaaagaatactttacaagacagaatgtgaaatgctaagcttaaaaaagaacagtggaccttataatgttgcctggcgcacacatttaaaaaatcataatatagacttatgcagtaggcacaactacaaaatgatatgtcagtgtattaatgcacactctatgtgtaagaatacagacatagattataacaaagagatcgaaacatattacaaaagcaatgctgcagcctatagagctggcctgaacaccataatggacacattaaaaacagcattcagagggcttacaaaggtcctaattgaaaattatatagaaaaagatgactctgatgctcttaaggccttatttagtaatattactgattctgtccaggacaactatcagatgattggaatattgaaatttgctagtaagctattagatattaaccttggtagatccacccgctcagctcatcattctataatgacaaacgaaattcccaaatctaatccttttactgattacagttattctaatgttaatataaaggaatgcatgtcgccagagagcttgaaatgttttaagaagagagacagtacaccgcatacaaaccacctgctttgcaagatagacaacaaatataaagcatttgactggccagagatagaaacaattcaaaaaggtcaaaaattatgccttggtgacagtcattgcaacttggaatttacagccataactgcagacagaattatgtcattaactaactgttataaagaatctttcactgcgcaaccagcagatatgcaggctggaattaaaaaatgctcggctgatgaaataggagaatgtacaacacttgaagacaagacatggccaattgtattctgtagcggcaaatattactactctgatagcaaggagcatgccaaagacggttctatcaacaattattgtttaaccaacaaatgttctgaacaacgtttcccaatacatgaaaattggttcaaaaaatgtaattgggacaagacccacaaagaatttaggccatatgagacaaataactataatgatataacttcttatagaaaagcaatagaatctgagataggaacagatttgatgacacaccattataagcccacaaagaaccttccacatgttgtaccaaggtatcatagtatagatgtacaaggtacagaatcaacagagggtattatcaatggtttcatacaaaatacaatacctgctattagtggtctagatgttggttatcatctgaatttcaaaggcaatcagttatttgacatagttatttttgtaaaaaaagctgtatataaagcacagtaccagaaagcatacaccacaggtcctagcatatccataaatattgaacataacgaaagatgcacaggccactgccccgaaaagattcctgcaaaagaaggttggttaacattttctaaagagcatactagttcttggggatgtgaagaatatggctgtcttgctatagatacaggctgtttatatggctcttgtcaagatgtcatacgcccagaattagatgtttataagaagattggcagtgaggcatcactgatagaaatatgtataactttgcctcatgaaacttattgcaatgatatggacatattagaaccgattataggagataaattaagtgcatcctttcagaatacacagactaatcaacttccgacccttatagcttataaaaagggaaaaatatacacaggtcaaatcaatgatattggaaacacagcattgcagtgcggctcaatccaagtaatcaatggatcaactatcggaactggcagcccaaaatttgattatatatgccatgctatgagaaggaaagatgttatcgtaaggaagtgtttcaatgacaactatcagtcgtgcactaggctagaaaagcgaaatgacttgattccttatagaaaaggcgatgtcatcgaagtatcaaaaacaggatcgaacatgggccaaatgacatttaaaatagaactaggtgatattaactataaaatatttactaaatcagtagatcttcaaatgtctggcatttgtgctgggtgcattgactgtgctgaaggtatttcatgctctataaatgctgaagtgccagccgaaacagtctgccattgcaaaacaaactgtgaagattttataaacaatatagtgttttcaccgcaaatcaagaattacaatataaaagtccactgtaaatctaaggttgaaaaaataacagcacatatctgtgggagagacattgatttacagttgacagttaagccatacaatcagaagatagacttgtcgcagttagatgaatcaaattacataagggaagaggacctccagtgtggaacatggttatgtaaggtgcaaaaagaggggattgatattatgtttaaaggattattttcaggcttagggagatattggaccatattaatttattcaattataggtgtggtaataattgtgatattggtttatatcctattgcccataggtcgccttttaaaagcattcctaatcagacatgaaatagaatatgccatggagcagaaaatcaagtag

SEQ ID NO: 4305 - RNA, 4263 nt, synthetic construct
  misc_feature 1..4263: note = derived and/or modified CDS sequence (wt) from OROV(TRVL-9760)__KC759123.1__GP
  source 1..4263: mol_type = other RNA
atggcgaatttaataattatttcgatggttctgagcattgcctatgggcatccgctctcaacaagtcaaattggtgaccgctgttttgctggtggtaacctcttcaaggagatgaacttgagtgtaggacttggcgaaatatgtgttaaagatgacatatctattgttaagagtactactgtttttagcaagaataaactggctcttgaagcaactacaaaattttatagatcctttatcgtaaaagactggtctgagtgcaatccagtgctagacaaatttggaaattttatggttttaagtgttgatgataacggccatataatacctaaaatgtatacatgtagagcagcatgtgatattagattaaacaaagataatgccgaaataatattatcgtcaacaaaactcaaccactttgaaattgtcgggacaacttcgacatcaggctggtttaagaacacaataacaaacaacctagaacatacatgcgagcatgtaactgtaaattgtggtcagaaatcagtaaaattccatgcatgctttagacaacataggggttgtataagattttttaaagggacatatatgccatactcaatgatcgaagcaatgtgcgttaacatagagctaataattctgacattatatatctttgctgcaattatatttgcactaattataacaaagagttatgtagcatacctgctcctgccgttattttatccagcaacgtggttttatggaaaggtttataaaaagattaattcttgcccaaactgtctacttgcatctcaccctttcaccagctgccccaaaatctgtatatgcggttctaggtttagttgcacagaagctcttaaggtgcatagaatgggtaaggactgcttaggctataaatctctaagcaaagctagacagatgtgtaaatcgaaaagctggtccttcacagcagctatattaactggattaatattgatggaattcatctcaccaattgcaggagagagaatgtataagcttgaggagttggccgctgagtttataaagctaacagagcaggtgaatattctagaaagagaaatggaagtcttgaagcagtcaataattgttatgtttgcaatcattttagtattgttactttttgaaaatatgatattcaaccggcttttccgcattttttatcgttcttgctccatgtgcggcttgatacattatagaccaggactcaaaatcgatttaaccaaaactaacagatgtggcagttgcatctgtggattcgacgagcagcagtcgtctggttttgaatatgaaatatttttaaaggatatgcatgtccaaaaagaatcatgcaaattcagtccaagagtaaaccactttaggaatactaaagctttattatttgcacttgtaatctgtgctaccatatatacagtttatgcagatgaagattgcttatctaaagatattaaaataacatatcaagagttgcacaactgcataggtccaaagataatgggcgatacttgtgtatcaaagagtgaattgtattctgatttattctcaaaaaatctagtcacagaatatgataaaaaatattttgaacctgatactgtaaatgatcaattcaacaagatagaatttgcccaagatgcacatagaatgatactattagaaagaatactttacaagacagaatgtgaaatgctaagcttaaaaaagaacagtggaccttataatgttgcctggcgcacatatttaaaaaatcataatatagacttatgcagtaggcacaactacaaaatgatatgtcagtgtattaatgcacactctatgtgtaagaatacagacatagattataacaaagagatcgaaacatattacaaaagcaatgctgcagcctatagagctgacctgaacaccataatggacacattaaaaacagcattcagagggcttacaaaggtcctaattgaaaattatatagaaaaagatgactctgatgctcttaaggccttatttagtaatattactgattctgtccaggacaactatcagatgattggaatattgaaatttgctagtaagctattagatattaaccttggtagatccacccgctcagctcatcattctataatgacaaacgaaattcccaaatctaatccttttactgattacagttattctaatgttaatataaaggaatgcatgtcgccagagagcttgaaatgttttaagaagagagacagtacaccgcatacaaaccacctgctttgcaagatagacaacaaatataaagcatttgactggccagagatagaaacaattcaaaaaggtcaaaaattatgccttggtgacagtcattgcaacttggaatttacagccataactgcagacagaattatgtcattaactaactgttataaagaatctttcactgcgcaaccagcagatatgcaggctggaattaaaaaatgctcggctgatgaaataggagaatgtacaacacttgaagacaagacatggccaattgtattctgtagcggcaaatattactactctgatagcaaggagcatgccaaagacggttctatcaacaattattgtttaaccaacaaatgttctgaacaacgtttcccaatacatgaaaattggttcaaaaaatgtaattgggacaagacccacaaagaatttagcactatgagacaaataaactataatgatataacttcttatagaaaagcaatagaatctgagataggaacagatttgatgacacaccattataagcccacaaagaaccttccacatgttgtaccaaggtatcatagtatagatgtacaaggtacagaatcaacagagggtattatcaatggtttcatacaaaatacaatacctgctattagtggtctaggtgttggttatcatctgaatttcaaaggcaatcagttatttgacatagttatttttgtaaaaaaagctgtatataaagcacagtaccagaaagcatacaccacaggtcctagcatatccataaatattgaacataacgaaagatgcacaggccactgccccgaaaagattcctgcaaaagaaggttggttaacattttctaaagagcatactagttcttggggatgtgaagaatatggctgtcttgctatagatacaggctgtttatatggctcttgtcaagatgtcatacgcccagaattagatgtttataagaagattggcagtgaggcatcactgatagaaatatgtataactttgcctcatgaaacttattgcaatgatatggacatattagaaccgattataggagataaattaagtgcatcctttcagaatacacagactaatcaacttccgacccttatagcttataaaaagggaaaaatatacacaggtcaaatcaatgatattggaaacacagcattgcagtgcggctcaatccaagtaatcaatggatcaactatcggaactggcagcccaaaatttgattatatatgccatgctatgagaaggaaagatgttatcgtaaggaagtgtttcaatgacaactatcagtcgtgcactaggctagaaaagcgaaatgacttgattccttatagaaaaggcgatgtcatcgaagtatcaaaaacaggatcgaacatgggccaaatgacatttaaaatagaactaggtgatattaactataaaatatttactaaatcagtagatcttcaaatgtctggcatttgtgctgggtgcattgactgtgctgaaggtatttcatgctctataaatgctgaagtgccagccgaaacagtctgccattgcaaaacaaactgtgaagattttataaacaatatagtgttttcaccgcaaatcaagaattacaatataaaagtccactgtaaatctaaggttgaaaaaataacagcacatatctgtgggagagacattgatttacagttgacagttaagccatacaatcagaagatagacttgtcgcagttagatgaatcaaattacataagggaagaggacctccagtgtggaacatggttatgtaaggtgcaaaaagaggggattgatattatgtttaaaggattattttcaggcttagggagatattggaccatattaatttattcaattataggtgtggtaataattgtgatattggtttatatcctattgcccataggtcgccttttaaaagcattcctaatcagacatgaaatagaatatgccatggagcagaaaatcaagtag

SEQ ID NO: 4306 - RNA, 4263 nt, synthetic construct
  misc_feature 1..4263: note = derived and/or modified CDS sequence (wt) from OROV(TVP-19244/DEI-216)__KP795073.1__GP
  source 1..4263: mol_type = other RNA
atggcgaatctaataattatttcaatgatcctgggcattgcctatggacatccgctctcaacaagtcagattggtgaccgctgttttgctggtggtatcctttttaaagaaatgaatctgagtgtgggacttggcgaaatatgtgttaaagacgatatatctattgttaagagtacaactgcctttagtaagaatgcactggcacttgaagcaactacaaaattctataggtcttttattgtcaaagattggtctgaatgcaatccagtattagacaaatttgggaatttcatggttttgaatgttgatgataacgggcatttagtccctaagatgtatacgtgcagggcagcatgtgatattagattgaataaggataatgcggagataatattgtcatcaacaaagcttaaccatttcgaaattgtcgggactacttcaacgtcaggttggtttaaaaacacaataacaaataatctagaacacacatgcgaacatgtgactgttaattgtggtcagaaatcagtaaaattccatgcatgctttcgacagcataggggttgtataagattcttcaaagggacatatatgccgtactcaatgattgaagcaatgtgcgtcaatatagaattaataatcctaacattgtatatctttgctgcaattatatttgcattaatcataacaaagagctatatagcatacttactcttaccattgttttatccggtaacctggctttacggaaaagtttacaagaggattaattcatgtcctaattgtctacttgcatcacatccctttactagctgcccaaaaatctgtatatgtggttctagatttagctgcacagaagccctcaaagtacacaggatgggtaaagactgcctaggttataaatccctaagcaaagctagacaaatgtgtaagtctaaaagctggtcattcacagcagctatactgactggcttaatattgatggaatttgtttcaccaattgcaggcgaaaggatgtacaaacttgaagaattggctgacgattacatagaactgacagagcaggtgaatatattaggaaaagaaatcaaaattttaaaacaatctataattgtcatgcttgcaattattttgatactactgctttccgaaaacataatcttcaattacctcttcagcaccctttatcgctcttgttctatgtgtggattgatacactatagaccgggactcaaggttgattcgaccaagactaacaaatgcgggagttgcatttgcgggttcgatgagcaacaatcatctgggtttgaatacgaagtatttttaaaagacatgcatgttcaaagggaatcttgcaaatttggacctagagtaaatcattttagaaacactaagattttgttatttacagttgctatttgcacttctttttatacagtttatgcagatgaagactgcttgtctaagaatattaggataacatatcaagaattacacaattgtataggaccgcacataatgggtgacacctgtatgtcaaaaagtgaattgtattctgatctgctctcaaagaatttaatcacagaatatgacaaaaaatattttgaacctgacactgtgaatgaccaatttaacaaaatcgaattcgctcaagatgcacacagaatgatattgttggaaagaatactttataagaccgaatgcgagatgctgagcttaaagaaaaatagtggaccttacaatgttgcttggcgcacatatttgaaaaatcataacatagatctatgcagcaggcataattacaaaatgatatgtcagtgtatcaacacgcattccatgtgtaaaaatacagatatagacttcaataaagaaattgaaacatattataaggccaatgctgcagcttataggtctgacttcaacacaataatagatacactgaaaacagcatttagaggacttacaaaagtactgattgaaaattacatagaaaaagatgattctgatgccctgaaggctttgtttagcaatattactgattccgttcaggacaactatcagatggttggtgtgctaaaatttgctagcaagttactaaatattagtttaggtaggactacccgctcagctcaacattcaataatgactaacgaaattcctaagtcaaacccttttaccgattatagttattctagtgtcaacattaaagaatgtatgtcaccggagagcttaaaatgttttaagaaaagagacagtgcaccgcatatgaaccatttgctttgtaagatggacaacaaatataaagcatttgactggccagaaatagagacagttcagaaagggcaaaagttgtgtcttggtgatagccactgcaacttagaatttactgctataactgcagacaagattatgtcattaactaattgttacaaagagtctttcactgcacaacctgccgacatgcaaactggtattaaaaaatgttcagctgatgagatcggagaatgtataacccttgaggataaatcatggccaattgttttctgcggagataaatactattactctgatggtaaagaacatgcaaaagacggatctattaacaattattgtcttgcaaataagtgctccgaacagcggtttccaatacataaaaattggttcaaaaagtgcaactgggacaaaactcataaggaattcaccactatgaggcaaataaattacaatgacataacttcatacaggaaggcaattgaatcggaaataggaacagacctaatgacgcatcattataagcccacaaagaatctcccacatgttgtgccacgatatcacagtatagatgttcaaggtacagaatcaacagaaggtattattaatgggttcatacaaaatacaatacctgctatcagcggcttaggcgtcggctaccacttaggtttcaaaggaaatcaactatttgacatagttatttttgttaaaaaggctgtatataaagcacaatatcagaaagtgtacacaactgggcctagtatatctataaatatcgaacataatgaaaagtgtacaggccactgccccgaaaaaatccctgcaaaagaaggctggttgacattttctaaggaacatacaagctcttgggggtgtgaggagtatggttgccttgccatagacactggctgcctatatggttcttgccaagacgttatacgcccagaattagatatttataaaaagattggtagtgaagcatcacttatagaaatatgtataactttgcctcatgagacatattgcaatgatatggatatattagaacctattattggagacaaattgagtgcatcttttcaaaatacacaaacaaaccagctgccaaacctcatggcttataaaaagggaaaagtctatactggacagataaatgatgtaggaaacacagcattacaatgcggttcaatacaagtagtcaatggttcaactattgggtctggcaatcctaaatttgattatatatgccatgctatgagacggaaagacgtcattgtgagaaaatgcttcaatgacaattatcagtcttgcactagactgaatccaagaaatgatttaattccttacaggaagggtgatattattgagatatcgaagacagggtcaaatatgggtcaaatgacatttaaaatagagttgggtgatattaattataaaatatttactaaatcagtggatctccagatgtctggtatttgtgctggatgcattgattgtgctgaaggcatatcatgttctataaatgctgatgtgtcagctgaaactgtctgccactgtaaaacaaactgtgaagactttataagcaatattgtaatctcaccccaaatcaaaacttataatataaaagtacactgtaagtcaaaagttaaaaagataacagcaaatatctgtgggagaaatattgatttacaactgacagttaagccgtacaatcaaaaaatagatctgtcacagctggatgaatcgaattatataaaagaagaggacctccaatgcggaacatggctgtgcaaagtccaaaaagaaggaattgatattgtattcaaaggactattttcaggattagggaaatattgggctattctaatttactcaattatagggataattgtagtcatattgttgatatatgtcttactgccaataggacgcctcctaaaggcattcctaatcaaaaatgaaatagaatacaccatggagcaaaaaattaaatag

SEQ ID NO: 4307 - RNA, 4263 nt, synthetic construct
  misc_feature 1..4263: note = derived and/or modified CDS sequence (wt) from OROV(TVP-19249/GML-444672)__KP795076.1__GP
  source 1..4263: mol_type = other RNA
atggcgaatctaataattttttcaataatcctaggcattgcctatgggcatccgctctcaacaagtcagattggtgaccgctgttttgctggtggtagcctttttaaagaaatgaacctgagtgtgggacttggcgaaatatgcgtcaaagacgacatatctattgttaagagtacaactgcctttagtaagaatacactagcactcgaagcaactacaaaattctataggtcttttatcgtcaaagactggtctgaatgcaatccagtattagataagcttgggaatttcatggttctgaatgttgatgataacgggcatttagtccctaggatgtatacatgcagagcagcatgtgatattagattgaataaagacaatgcagaaataatattgtcatcgacaaagcttaaccactttgaaattgttgggacaacttcaacatcaggttggtttaagaatacaataacaaataatctagaacatacatgcgaacatgtgactgttaattgcggtcagaaatcagtaaaattccatgcatgctttcggcagcataggggttgtataagattctttaaagggacatacatgccgtattcaatgattgaagcaatgtgcattaatatagaattaataatcctaacattgtatatctttgctgcaattatatttgcactaatcataacgaagagctatatagcatacttactcctaccattgttctatccggtaacctggctttacggaaaagtttacaaaaggattaattcatgctctaattgcctacttgcatcacatccctttactagctgcccgaagatctgcatatgtggctctagatttagctgcacagaagccctcaaagtacacaggatgggtaaagactgtctaggttataaatccctaagcaaagctagacagatgtgcaaatctaaaagctggtcattcacagcagctatactaactggcttaatattgatggaatttgtttcaccaattgcaggtgaaaggatgtacaaacttgaagagctggccgacgattacatagaaatggcagagcgggtgggtatgttagaaaaagaaataaaagttttaaaacagttcacgattgtcatgcttgtaattattctgatactgctgctttttgaaaacacaatcttcaattacctctttaacaccctttatcgttcttgttctatgtgtgggttgatacactatagaccagggctcaaggttgatttgaccaagactaacaaatgcgggagttgcatttgcggatttgacgagcaacaatcatctgggtttgaatacgaagtattcttaaaggacatgcatattcaaagggaatcttgcaaatttggacctagagtaaaccactttaggaacaccaagattttgttgtttacaattgctatttgcacttctttttatacagtttatgcagatgaagactgcttgtccaagaatattaagataacatatcaagaattacacaattgtataggaccatacataatgggcgacacctgtgtgtcaaaaagtgaattatattctgatctgctttcaaagaatttaatcacagaatatgacaaaaaatattttgaaccagacactgtaaatgaccaattcaacaaaattgaattcgctcaggatgcacacagaatgatactgttggaaagaatactttataagaccgaatgcgagatgctgagcttaaagaagaatagtggaccttacaatgttgcttggcgcacatacttgaaaaatcataacatagatttgtgcagcaggcataattacaaaatgatatgccagtgtatcaatatgcattctatgtgtaaaaatacagatatagacttcaacaatgaaattgaaacatattataaggccaatgccgcagcttataggtctgacttctacacaataatagatacactgaaaacagcatttagaggacttacgaaagtactgatcgaaaattacatagaaaaagatgattctgatgctctaaaggctttgtttagcaatattactaattctgttcaggacaactatcagatggttggcgtactaaaatttgctagcaagttactaaatattagtttaggtaggtctacccgctcggctcaacattcaataatgactaatgaaatccctaagtcaaacccttttactgattatagttattctagcgtcaacattaaagaatgtatgtcgccagagagcttaaaatgttttaagaaaagagacagtgtaccgcatacgaaccatttgctctgtaagatggataacaagtataaagcatttgactggccagaaatagagacagttcaaaaagggcaaaagttgtgtcttggtgatagccactgtaacttagaatttacagctataactgcagacaagattatgtcattaactaattgttacaaagagtctttcactgcacagcctgctgacatgcaaactggtatcaaaaaatgttcagctgacgagatcggagaatgtataacccttgaggataaagcgtggccaattgttgtctgcggagacaaatactattactctgatggtaaagaacatgcaaaagatgggtctattaacaattattgtcttgcaaataaatgctctgaacagcgatttccaatacataaaaattggttcaaaaaatgcaactgggacaaaactcacaaagagttcaccactatgaggcaaataaattacaatgacataacttcatacagaaaggcaattgaatcagaaataggaacagacctaatgacacatcattacaaacccacaaagaatctcccacatgttgttccacgatatcacagtatagatgttcaaggtacagaatcaacagaaggcattattaatgggttcatacaaaatacaatacctgctatcagcggcttaggtgttggctatcacttaggtttcagaggaaatcaactatttgatatagttatttttgttaaaaaggctgtatataaagcacaatatcagaaagtgtacacaactggacccagtatatctataaatattgaacacaatgaaaagtgtacaggccactgtcccgaaaaaatacctgcaaaagaaggttggttgacattttctaaggaacatacaagctcttgggggtgtgaggagtatggttgccttgccatagacactggttgtctatatggttcttgccaagatgttatacgtccagaattagatatttataagaagattggcagcgaagcatcacttatagaaatatgtataactttgcctcatgagacttattgcaatgatatggatatattagaacctattattggagataaattaagtgcatcctttcaaaatacacaaacaaaccaactgccagtcctcatggcttataagaaggggaaagtctatactggacagataaatgatgttgggaacacagcgttacaatgtggttcaatacaagtagtcaatggttcaactattgggtctggcaatcctaaatttgactatatatgccatgctatgaggcgaaaagacgtcattgtgagaaaatgcttcaatgataattatcagtcttgcactagactggatgcgagaaatgatttaattccttataggaaaggcgatattattgagatatcaaaaacagggtcaaatatgggtcaaatgacatttaaaatagagttaggcgatattaattataaaatatttactaagtcggtggatctccaaatgtctggtatttgtgccggatgcattgattgtgccgaaggcatatcatgttctataaatgccgatgtatcagctgaaactgtctgccattgtaaaacaaactgcgaagactttataagcaatattgtaatctcacctcaaatcaaaacttataatataaaagtacattgcaagtcaaaagttgaaaagataacagcaaatatctgtgggagaaatattgacttacaattgacagttaagccgtacaaccaaaagatagatctatcacagctggatgaatcgaattatataaaagaagaagacctccaatgtggaacatggctgtgtaaagtccagaaagaagggattgatattgtatttaaaggactattttcaggattagggaaatattggaccattctaatttactcaattatagggataattgtaattgtattattgatatatgtcttactgccaataggacgtctcttaaaagcattcctaatcaaaaatgaaatagaatacaccatggaacaaaaaattaaatag

SEQ ID NO: 4308 - RNA, 4263 nt, synthetic construct
  misc_feature 1..4263: note = derived and/or modified CDS sequence (wt) from OROV(TVP-19254/GML-480914)__KP795082.1__GP
  source 1..4263: mol_type = other RNA
atggcgaatttaataattatttcaatggttctgagcgttgcttatgggcatccgctttcaacaagtcaaattggtgaccgctgtttcgctggtggtaacctcttcaaggagatgaacttgagtgtaggacttggcgaaatatgtgttaaagatgacatatctattgtcaaaagtaccactgcttttagtaagaataaaccagctcttgaagcaactacaaaattttataggtcttttattgtgaaagattggtctgagtgcaatccagtgctagacaaatttggaaattttatggtcttaagtgttgatgacaatggccatataatacctaaaatgtatacatgtagagcagcatgtgatattagattaaacaaagataatgctgaaataatattatcgtcaacaaaactcaaccactttgaaattgtcgggacaacttcgacatcaggctggttcaagaacacaataacaaacaatttagaacacacatgcgagcatgtgaccgtaaattgtggtcagaaatcagtaaaattccatgcatgctttagacaacataggggttgtataagattctttaaaggaacatatatgccatactcaatgattgaagcaatgtgcgttaacatagagctaataattctgacattatatatctttgctgcaattatatttgcattaattataacaaagagttacgtggcatacttgctcctgccgttattttatccagtgacgtggttttacgggaaggtttataaaaagattaattcctgcccaaattgtctacttgcatcccaccctttcaccagctgccctaaaatctgtatatgcggttctagatttagttgcacagaagctcttaaggtacatagaatgggtaaggactgcttaggttataaatctctaagcaaagctagacagatgtgtaagtcgaaaagctggtcctttacggcagctatattaactggattaatattgatggaatttatctcaccaattgcaggagagagaatgtataagcttgaagagttggctgatgaatttataaagctaacagagcaggtaaatattttagaaagagaaatggaagtcttgaagcagtcagtaattgttatgcttgcaatcattttagtattgttgctttttgaaaatatgatattcaaccggcttttccgcattttttatcgttcttgctccatgtgcggtttgatacattatagaccaggactcaagatcgatttaaccaaaactaatagatgcggtagttgcatctgtggattcgatgaacagcaatcatctggttttgaatatgaaatatttctaaaggatatgcatatccagaaagaatcatgcaagtttagcccaagagtaaaccactttaggaatattaaagctttattatttgcacttgtaatctgtgctactatatatacagtttatgcagatgaagattgcttatctaaaaatattaaaataacatatcaagagttgcataattgcataggtccaaaaataatgggcgatacttgtgtatcaaagagtgaattgtattctgatttattctcaaaaaatctagtcacagagtatgataaaaaatattttgaacctgatactataaatgatcaattcaacaagatagagtttgcccaagatgcacatagaatgatactattagaaagaatactttacaagacagaatgtgaaatgctaagcttaaaaaagaacagtggaccttataatgttgcctggcgcacatatttaaaaaatcataatatagacctatgcagtaggcacaactataaaatgatatgtcagtgtattaatacacactctatgtgtaagaatacagatatagattataacaaagagatcgaaacatattataaaagcaacgctgcagcctatagagctgacctgaacactataatagacacattaaagacagcattcagagggcttacaaaggtcctaattgaaaattatatagaaaaagatgattctgatgctcttaaggccttatttagtaatattactgattctgtccaggacaattatcagatgattggaatattgaaatttgccagtaagctattagatattaacctcggtagatccacccgctcagctcatcattctataatgacaaacgaaattcccaaatctaatccttttactgattacagttattccaatgtgaatataaaggagtgcatgtcaccagaaagcttgaaatgttttaagaagagagacagtacaccgcatacaaaccacctgctttgtaagatagacaacaaatataaagcattcgactggccagagatagaaacaattcaaaaaggtcaaaaattgtgtcttggtgacagtcattgcaacttggaatttacagccataactgcagacaagattatgtcattaactaactgttataaagaatctttcactgcgcaaccagcagatatgcaggctggaattaaaaaatgctcagctgatgaaattggagaatgcacaacacttgaagacaagacatggccaattgtattctgtggtggcaaatattactactctgatagcaaggagcatgccaaggacggttctatcaacaattattgtctaaccaacaaatgctctgaacaacgtttcccaatacatgaaaattggttcaaaaaatgtaattgggacaagacccataaagaatttagtactatgaaacagataaactataatgatataacttcttatagaaaggcaatagaatctgagataggaacagatttaatgacacaccattataagcccacaaagaaccttccgcatgttgtaccaaggtatcatagtatagatgtgcaaggtacagaatcaacagagggtcttatcaatggtttcatacaaaatacaatacctgctattagtggtctaggtgtcggttatcatctgaatttcaaaggcaatcaattatttgacatagttatttttgtaaaaaaagctgtgtataaagcacagtaccagaaagcatacaccacaggccccagcatatccataaatattgaacacaatgaaagatgcacaggccactgccccgaaaagattcctgcaaaagaaggttggctaacattttctaaagaacatactagttcttggggatgtgaagaatatggctgtcttgctatagatacaggctgtctatatggctcttgtcaagatgtcatacgcccagaattagatgtttataagaagattggcagtgaggtatcactgatagaaatatgcataactttgcctcacgaaacttattgcaatgatatggacatattagaaccgattataggagataaattaagtgcatcctttcagaatacgcagactaatcaacttccgacccttatagcttataaaaaggggaaaatatacacaggtcaaatcaatgatattggaaacacagcattacagtgcggctcaatccaagtaattaatggatcaactatcggaactggcagccccaaatttgattatatatgccatgctatgagaaggaaagatgttattgtaaggaagtgtttcaatgacaattatcagtcatgcactaggttagaaaaacggaacgacttgatcccttatagaaaaggcgatgtcattgaagtatcaaaaacaggatcgaacatgggccaaatgacatttaaaatagaactaggtgatatcaactataaaatattcactaaatcaatagaccttcaaatgtctggcatttgtgctgggtgcattgactgtgctgaaggtatttcatgctctataaatgctgaagtatcagccgaaacagtctgccattgcaaaacaaactgtgaagattttataaacaatatagtgttttcaccacaaatcaaaaattacaatataaaagtccactgtaaatctaaagttgaaaagataatagcacatatctgtgggaaagacattgatttacagttaacagttaagccatacaatcagaagatagacttatcgcagttagatgaatcaaattacataagagaagaggacctccagtgtggaacatggttatgtaaagtgcaaaaagaggggattgatattatattcaaaggattattttcaggcttagggagatattggaccatattaatttattcaattataggtgtggtaataattgtgatattggtttatatcctgttgcccataggtcggcttttaaaagcattcctaatcagacatgaaatagaatatgccatggagcagaaaatcaagtag

SEQ ID NO: 4309 - RNA, 4263 nt, synthetic construct
  misc_feature 1..4263: note = derived and/or modified CDS sequence (wt) from OROV(TVP-19256/IQE-7894)__KP795085.1__GP
  source 1..4263: mol_type = other RNA
atggcgaatctaataattatttcaatgatcctgggcattgcctatgggcatccactctcaacaagtcagattggtgaccgctgttttgctggtggtagcctttttaaagaaatgaatctgagtgtgggacttggcgaaatatgtgttaaagacgatatatctattgttaagagtacaactgcctttagtaagaatgcactagcacttgaagcaactacaaaattctataggtcttttattgtcaaagattggtctgaatgcaacccagtattagataaatttgggaatttcatggttctgaatgttgatgataacgggcatttagttcctaagatgtatacgtgcagggcagcatgtgatattagattgaataaggataatgcggaagtaatattgtcatcaacaaagcttaaccatttcgaaattgtcgggactacttcaacatcgggttggtttaaaaatacaataacaaataatctagaacacacatgcgaacatgtgactgttaattgcggtcagaaatcagtaaaattccatgcatgctttcgacagcataggggttgtataaggttcttcaaaggggcatatatgccgtactcaatgattgaagcaatgtgtgtcaatatagaattaataatcctaacattgtatatttttgctgcaattatatttgcattaatcataacaaagagctatatagcatacttactcctaccattgttttatccggtaacctggctttacggaaaagtttacaaaaggattaattcatgtcctaattgtctacttgcatcacacccctttactagctgcccaaaaatctgtatatgcggttctagatttagctgcacagaagccctcaaagtgcacaggatggggaaagactgtctaggttataaatccctaagcaaagctagacaaatgtgtaagtctaaaagctggtcattcacagctgctatactaactggcttaatattgatggaatttgtttcaccaattgcaggcgaaaggatgtacaaacttgaagagctggctgacgattacatagaactggcagagcaggtgaatatattaggaaaagaaatcaaaattttaaaacaatctataattgtcatgcttgcaattattttgatactactgctttccgagaatataatcttcaattacctcttcaaaaccctttatcgctcttgttctatgtgcgggttgatacactatagaccaggactcaaggttgatttgaccaagactaacaaatgcgggagttgcatttgcgggttcgatgagcaacaatcatctgggtttgaatacgaggtatttttaaaagacatgcatgttcaaagggaatcttgcaaattcggacctagagtaaaccattttagaaacactaagattttgttatttacaattgctatttgcacttctttttatacagtttatgcagatgaagactgcttgtccaagaatattaggataacatatcaagaattacacaattgcataggaccacacataatgggtgacacctgcatgtcaaagagtgaattgtattctgatctgctttcaaagaatttaatcacagaatatgacaaaaaatatttcgaacctgacactgtaaatgaccaattcaacaaaatcgaattcgctcaagatgcacacagaatgatattattggaaagaatactttataagaccgaatgcgagatgctgagcttaaagaaaaatagtggaccttacaatgttgcttggcgcacatatttgaaaaatcataacatagatttgtgcagcaggcataattacaaaatgatatgtcagtgtatcaacacgcattccatgtgtaaaaatacagatatagacttcaataaagaaattgaaacatattataaggccaatgctgcagcttataggtctgacttcaacacaataatagatacattaaaaacagcatttagaggacttacaaaagtactgattgaaaattacatagaaaaagatgattctgatgccctgaaggctttgtttagcaatattactgattctgttcaggacaactatcagatggttggtgtgctaaaatttgctagcaagttgctaaatatcagtttaggtaggactacccgttcagctcaacattcaataatgactaacgaaattcctaagtcaaacccctttactgattatagttattctagtgttaatattaaagaatgtatgtcaccagagagcttaaaatgttttaagaaaagagacagtgtaccacatacgaaccatttgctttgcaagatggataacaaatataaagtatttgactggccagaaatagagacagttcagaaagggcaaaagttgtgtcttggtgatagccactgcaacttagaatttactgctataactgcagacaagattatgtcattaactaattgttataaagagtctttcactgcacaacctgccgacatgcaaactggtattaaaaaatgttcagctgatgagattggagaatgtataacccttgaggataaatcgtggccaattgttttctgcggagataaatactattactctgagggtaaagaacatgcaaaagatggatccattaataattattgtcttgcaaataaatgctccgaacagcggttcccaatacataaaaattggctcaaaaagtgcaactgggacaaaactcataaggagttcaccactatgaggcgaataaattacaatgacataacttcatacagaaaggcaattgagtccgaaataggaacagatctaatgacacaccattataagcccacaaagaatcttccacatgttgttccacgctatcacagtatagatgttcaaggtacagaatcaacagaaggtattatcaatgggttcatacaaaacacgatacctgctatcagcggcttaggcgtcggctaccacttaggttttaaaggaaatcaactatttgacatagttatttttgttaaaaaggctgtatataaagcgcaatatcagaaagtgtacacaactggacctagtatatctataaatatcgaacataatgaaaagtgtacaggccactgtcccgaaaaaatacctgctaaagaaggttggttgacattttctaaggaacatacaagctcttgggggtgtgaggagtatggctgccttgccatagacactggctgtctatatggttcttgccaagatgttatacgcccagaattagatatttataaaaagattggtagtgaagcatcacttatagaaatatgtataactttgcctcatgagacatattgcaatgatatggatatattagaacctattattggggataaattgagtgcatcttttcaaaatacacaaacaaatcagctgccaaacctcatggcttataaaaagggaaaagtctatactggacagataaatgatgtaggaaacacagcattacaatgcggttcaatacaagtagtcaatggttcgactattgggtctggcaatcctaaatttgattatatatgccatgctatgagacgaaaagatgtcattgtgagaaaatgcttcaatgacaattaccagtcttgcactagactagatccaagaaatgatttaattccttacaggaagggcgatattgttgagatatcgaagacagggtcaaatatgggtcaaatgacatttaaaatagagttgggtgatattaattataaaatatttactaaatcagtagatctccagatgtctggtatttgtgctggatgcattgattgtgctgaaggcatatcatgttctataaatgccgatgcgtcagctgaaactgtctgccactgtaaaacaaattgtgaagactttataagcaatattgtaatctcaccccaaatcaaaacttataatataaaagtacattgcaagtcaaaagtcgaaaagataacagcaaatatctgtgggagaaatattgacttacaattaacagttaagccgtacaatcaaaaaatagatctgtcacagctggatgaatcgaattacataaaagaagaagacctccaatgcggaacatggctgtgtaaagtccaaaaagaaggaattgatattgtatttaaaggactattttcaggattagggaaatattgggccattctaatttactcaattataggggtaattgtagtcatattattgatatatgtcctactgccaataggacgccttctaaaggcattcctaatcaaaaatgaaatagagtataccatggagcaaaaaattaaatag

SEQ ID NO: 4310 - RNA, 4263 nt, synthetic construct
  misc_feature 1..4263: note = derived and/or modified CDS sequence (wt) from OROV(TVP-19257/IQT-1690)__KP795088.1__GP
  source 1..4263: mol_type = other RNA
atggcgaatctaataattattccaatgatcctgggcattgcctatggacatccgctctcaacaagtcagattggtgaccgctgttttgctggtggtagcctttttaaagaaatgaatctgagtgtgggacttggcgaaatatgtgttaaagacgatatatctattgttaagagtacaactgcctttagtaagaatgcactagcacttgaagcaactacaaaattctataggtcttttattgtcaaagattggtctgaatgcaatccagtattagacaaatttgggaatttcatggttttgaatgttgatgataacgggcatttagtccctaagatgtatacgtgcagggcagcgtgtgatattaggttgaataaggataatgcggaaataatattgtcgtcaacaaagcttaaccatttcgaaattgtcgggaccacttcaacgtcaggttggtttaaaaacacaataacaaataatctagaacacacatgtgaacatgtgactgttaattgtggtcaaagatcagtaaaattccatgcatgctttcgacagcataggggttgtataaggttcttcaaagggacatatatgccgtactcaatgattgaagcaatgtgcgtcaatatagaattaataatcctaacattgtatatctttgctgcaattatatttgcattaatcataacaaagagctatatagcatacttactcctaccattgttttatccggtaacctggctttacggaaaagtttacaagaggattaattcatgtcctaattgcctacttgcatcacacccctttactagctgcccaaaaatctgtatatgtggttctagatttagctgcacagaagccctcaaagtacacaggatgggtaaagactgcctaggttataaatccctaagcaaagctagacaaatgtgtaagtctaaaagctggtcattcacagcagctatactgactggcttaatattgatggaatttgtttcaccaattgcaggtgaaaggatgtacaaacttgaagaattggctgacgattacatagaactggcagagcaggtgaatatattaggaaaagaaatcaaaattttaaaacaatctataattgtcatgcttgcaattattttgatactactgctttccgaaaacataatcttcaattacctcttcaacaccctttatcgctcttgttctatgtgtggattgatacactatagaccggggctcaaggttgatttgaccaagactaacaaatgcgggagttgcatttgcgggttcgatgaacaacaatcatctgggtttgaatacgaggtatttttaaaagacatgcatgttcaaagggaatcttgcaaatttggacctagagtaaaccattttaggaacactaagattttgttatttataattgctatttgcacttctttttatacagtttatgcagatgaagactgcttgtctaagaatattaggataacatatcaagaattacacaattgtataggaccacacataatgggtgacacctgtatgtcaaaaagtgaattgtattctgatctgctttcaaagaatttaatcacagaatatgacaaaaaatattttgaacctgacactgtgaatgaccaatttaacaaaatcgaattcgcccaagatgcacacagaatgatattgttggaaagaatactttataagaccgaatgcgagatgctgagcttaaagaaaaatagtggaccttacaatgttgcttggcgcacatatttgaaaaatcataacatagatctatgcagcaggcataattacaaaatgatatgtcagtgtatcaacacgcattccatgtgtaaaaatacagatatagacttcaataaagaaattgaaacatattataaggccaatgctgcagcttataggtctgacttcaacacaataatagatacattaaaaacagcatttagaggacttacaaaagtactgattgaaaattacatagaaaaagatgattctgatgccctgaaggctttgtttagcaatattactgattccgttcaggacaactatcagatggttggtgtgctaaaatttgctagcaagttactaaatattagtttaggtaggactacccgctcagctcaacattcaataatgactaacgaaattcctaagtcaaacccttttaccgattatagttattctagtgtcaacattaaagaatgtatgtcaccggagagcttaaaatgttttaagaaaagagacagtgcaccgcatacgaaccatttgctttgtaagatggacaacaaatataaagcatttgactggccagaaatagagacagttcagaaagggcaaaagttgtgtcttggtgatagccactgcaacttagaatttactgctataactgcagacaagattatgtcattaactaattgttacaaagagtctttcactgcacaacctgctgacatgcaaactggtgttaaaaaatgttcagctgatgagatcggagaatgtataacccttgaggataaatcgtggccaattgttttctgcggagataaatactattactctgatggtaaagaacatgcaaaagacggatctattaacaattattgtcttgcaaataaatgctccgaacagcggtttccaatacataaaaactggttcaaaaagtgcaactgggacaaaactcataaggaattcaccactatgaggcaaataaattacaatgacataacttcatacaggaaggcaattgaatcggaaataggaacagacctaatgacgcatcattataagcccacaaagaatcttccacatgttgtgccacgatatcacagtatagatgttcaaggtacagaatcaacagaaggtattattaatgggttcatacaaaatacaatacctgctatcagcggcttaggtgtcggctaccacttaggtttcaaaggaaatcaactatttgacatagttatttttgttaaaaaggctgtatataaagcacaatatcagaaagtgtacacaactgggcctagtatatctataaatatcgaacataatgaaaagtgtacaggccactgccccgaaaaaatccctgcaaaagaaggctggttgacattttctaaggaacatacaagctcttgggggtgtgaggagtatggttgccttgccatagacactggctgcctatatggttcttgccaagacgttatacgcccagaattagatatttataaaaagattggtagtgaagcatcacttctagaaatatgtataactttgcctcatgagacatattgcaatgatatggatatattagaacctattattggagacaaattgagtgcatcttttcaaaatacacaaacaaaccagctgccaaacctcatggcttataaaaaggggaaagtctatactggacagataaatgacgtaggaaacacagcattacaatgcggttcaatacaagtagtcaatggttcaactattgggtctggcaatcctaaatttgattatatatgccatgctatgagacggaaagacgtcattgtgagaaaatgcttcaatgacaattatcagtcttgcactagactggatccaagaaatgatttaattccttacaggaagggtgatattattgagatatcgaagacagggtcaaatatgggtcaaatgacatttaaaatagagttgggcgatattaattataaaatatttactaaatcagtggatctccagatgtctggtatttgtgctggctgcattgattgtgctgaaggcatatcatgttctataaatgctgatgtgtcagctgaaactgtctgccactgtaaaacaaactgtgaagactttataagcaatattgtaatctcacctcaaatcaaaacttataatataaaagtacactgtaagtcaaaagttgaaaagataacagcaaatatctgtgggagaaatattgatttacaactgacagttaagccgtacaatcaaaaaatagatctgtcacagctggatgaatcaaattatataaaagaagaggacctccaatgcggaacatggctgtgcaaagtccaaaaagaaggaattgatattgtattcaaaggactattttcaggattagggaaatattgggctattctaatttactcaattatagggataattgtagtcatattgttgatatatgtcttactgccaataggacgcctcctaaaggcattcctaatcaaaaatgaaatagaatacaccatggagcaaaaaattaaataa

SEQ ID NO: 4311 - RNA, 4263 nt, synthetic construct
  misc_feature 1..4263: note = derived and/or modified CDS sequence (wt) from OROV(TVP-19258/IQT-4083)__KP795091.1__GP
  source 1..4263: mol_type = other RNA
atggcgaatctaataattatttcaatgatcctgggcattgcctatggacatccgctctcaacaagtcagattggtgaccgctgttttgctggtggtagcctttttaaagaaatgaatctgagtgtaggacttggcgaaatatgtgttaaagacgatatatccattgttaagagtacaactgcctttagtaagaatgcactggcacttgaagcaactacaaaattctataggtcttttattgtcaaagattggtctgaatgcaatccagtattagacaaatttggaaacttcatggttttgaatgttgataataacgggcatttagtccctaagatgtatacgtgcagggcagcatgtgatattagattgaataaggataatgcggagataatattgtcatcaacaaagcttaaccatttcgaaattgtcgggactacttcaacgtcaggttggtttaaaaacacaataacaaataatctagaacacacatgcgaacatgtgactgttaattgtggtcagaaatcagtaaaattccatgcatgctttcgacagcatagggcttgtataagattcttcaaagggacatatatgccgtactcaatgatcgaagcaatgtgcgtcaatatagaattaataatcctaacattgtatatctttgctgcaattatatttgcattaatcataacaaagagctatatagcatacttactcttaccattgttttacccggcaacctggctttacggaaaagtttacaagaggattaattcgtgtcctaattgtctgcttgcatcacatccctttactagctgccccaaaatctgtatatgtggttctagatttagctgcacagaagccctcaaagtacacaggatgggtaaagactgcctaggttataaatccctaagcaaagctagacaaatgtgtaagtctaaaagctggtcattcacagcagctatactgactggcttaatactgatggaatttgtttcaccaattgcaggcgaaaggatgtacaaacttgaagaattggctgacgattacatagaactgacagagcaggtgaatatattaggaaaagaaatcaaaattttaaaacaatctataattgtcatgcttgcaattattttgatactactgctttccgaaaacataatcttcaattacctcttcaacaccctttatcgctcttgttctatgtgtggattgatacactatagaccgggactcaaggttgatttgaccaagactaacaaatgcgggagttgcatttgcggattcgatgagcaacaatcatctgggtttgaatacgaagtatttttaaaagacatgcatgttcaaagggaatcttgcaaatttggacctagagtaaaccattttagaaacactaagattttgttatttacaattgctatttgcacttctttttatacagtttatgcagatgaagactgcttgtctaagaatattaggataacatatcaagaattacacaattgtatagggccacacataatgggtgacacatgtatgccaaaaagtgaattgtattctgatctgctttcaaagaatttaatcacagaatatgacaaaaaatattttgaacctgacactgtgaatgaccaatttaacaaaatcgaattcgctcaagatgcacacagaatgatattgttggaaagaatactttataagaccgaatgcgagatgctgagcttaaagaaaaatagtggaccttacaatgttgcttggcgcacatatttgaaaaatcataacatagatctgtgcagcaggcataattacaaaatgatatgtcagtgtatcaacacgcattctatgtgtaaaaatacagatatagacttcaataaagaaattgaaacatattataaggccaatgctgcagcttataggtctgacttcaacacaataatagatacactaaaaacagcatttagaggacttacaaaagtactgattgaaaattacatagaaaaagatgattctgatgccctgaaggctttgtttagcaatattactgattccgttcaggacaactatcagatggttggtgtgctaaaatttgctagcaagttactaaatattagcttaggtaggactacccgctcagctcaacattcaataatgactaacgaaattcctaagtcaaacccttttaccgattatagttattctagtatcaacattaaagaatgtatgtcaccagagagcttaaaatgttttaagaaaagagacagtgcaccgcatacgaaccatttgctttgtaagatagacaacaaatataaagcatttgactggccagaaatagagacagttcagaaagggcaaaagttgtgtcttggtgatagccactgcaacttagaatttactgctataactgcagataagattatgtcattaactaattgttacaaagagtctttcactgcacaacctgccgacatgcaaactggtattaaaaaatgttcagctgatgaaatcggagaatgtataacccttgaggataaatcgtggccaattattttctgcggagataaatactattactctgatggtaaagaacatgcaaaagacggatctattaacaattattgtcttgcaaataaatgctccgaacagcggtttccaatacataaaaattggttcaaaaagtgcaactgggacaaaactcataaggaattcaccactatgaggcagataaattacaatgacataacttcatacaggaaggcaattgaatcggaaataggaacagacctaatgacgcatcattataagcccacaaagaatcttccacatgttgtgccacgatatcacagtatagatgttcaaggtacagaatcaacagaaggtattattaatgggttcatacaaaatacaatacctgctatcagcggcttaggtgtcggctaccacttaggtttcaaaggaaatcaactatttgacatagttatttttgttaaaaaggctgtgtataaagcacaatatcagaaagtgtacacaaccgggcctagtatatctataaatatcgaacataatgaaaagtgtacaggccactgccccgaaaaaatccctgcaaaagaaggctggttgacattttctaaggaacatacaagctcttgggggtgtgaggagtatggttgccttgccatagacactggctgcctatatggttcttgccaagacgtcatacgcccagaattagatatttacaaaaagattggtagtgaagcatcacttatagaaatatgtataactttgcctcatgagacatattgcaatgatatggatatattagaacctattattggagacaaattgagtgcatcttttcaaaatacacaaacaaaccagctgccaaacctcatggcttataaaaaggggaaagtctatactggacagataaatgatgtaggaaacacagcattacaatgcggttcaatacaagtagtcaatggttcaactattgggtctggcaatcctaaatttgattatatatgccatgctatgagacggaaagacgtcattgtgagaaaatgcttcaatgacaattatcagtcttgcactagactggatccaagaaatgatttgattccttacaggaagggtgatattattgagatatcgaagacagggtcaaatatgggtcaaatgacattcaaaatagagttgggcgatattaattataaaatatttactaaatcagtggatctccagatgtctggtatatgtgctggatgcattgattgtgctgaaggcatatcatgttctataaatgctgatgtgtcagctgaaactgtctgtcactgtaaaacaaactgtgaagactttataagcaatattgtaatctcaccccaaatcaaaacttataatataaaagtacactgtaagtcaaaagttgaaaagataacagcaaatatctgtgagagaaatattgatttacaactgacagtcaagccgtacaatcaaaaaatagatctgtcacagctggatgagtcgaattatataaaagaagaggacctccaatgcggaacatggctgtgcaaagtccaaaaagaaggaattgatattgtattcaaaggactattttcaggattagggaaatattgggctattctaatttactcaattatagggataattgtagtcatattgttgatatatgtcttactgccaataggacgcctcctaagagcattcctaatcaaaaatgaaatagaatacaccatggagcaaaaaattaaatag

SEQ ID NO: 4312 - RNA, 4263 nt, synthetic construct
  misc_feature 1..4263: note = derived and/or modified CDS sequence (wt) from OROV(TVP-19259/IQT-7085)__KP795094.1__GP
  source 1..4263: mol_type = other RNA
atggcgaatctaataattatttcaatgatcctgggcattgcctatgggcatccactctcaataagtcagattggtgaccgctgttttgctggtggtagcctttttaaagaaatgaatctgagtgtgggacttggcgaaatatgtgttaaagacgatatatctattgttaagagtacaactgcctttagtaagaatgcactagcacttgaagcaactacaaaattctataggtcttttattgtcaaagattggtctgaatgcaatccagtattagataaatttgggaatttcatggttttgaatgttgatgataacgggcatttagtccctaagatgtatacgtgcagggcagcatgtgatattagattgaataaggataatgcggaaataatattgtcatcaacaaagcttaaccatttcgaaattgtcgggactacttcaacatcaggttggtttaaaaatacaataacaaataatctagaacacacatgcgaacatgtgactgttaattgcggtcagaaatcagtaaaattccatgcatgctttcgacagcataggggttgtataaggttcttcaaagggacatatatgccgtactcaatgattgaagcaatgtgtgtcaatatagaattaataatcctaacattgtatatctttgctgcaattatatttgcattaatcataacaaagagctatatagcatacttactcctaccattgttttatccggtaacctggctttacggaaaagtttacaaaaggattaattcatgtcctaattgtctacttgcatcgcatccctttactagctgcccaaaaatctgtatatgtggttctagatttagctgcacagaagccctcaaagtacacaggatggggaaagactgtctaggttacaaatccctaagcaaagctagacaaatgtgtaagtctaaaagctggtcattcacagcagctatactgactggcttgatattgatggaatttgtttcaccaattgcaggcgaaaggatgtacaaacttgaagaactggctgacgattacatagaactggcagagcaggtgaatatattaggaaaagaaatcaaaattttaaaacaatctatagttgtcatgcttgcaattattttgatactactgctttccgaaaatataatcttcaattacctcttcaacaccctttatcgctcttgttctatgtgtgggttgatacactatagaccaggactcaaggttgatttgaccaagactaacaaatgcgggagttgcatttgcgggttcgatgagcaacaatcatctgggtttgaatacgaggtatttttaaaagacatgcatgttcaaagggaatcttgcaaatttggacctagagtaaaccattttagaaacactaagattttgttatttacaattgctatttgcacttctttttatacagtttatgcagatgaagactgcttgtccaagaatattaggataacatatcaagagttacacaattgtataggaccacacataatgggtgacacctgcatgtcaaaaagtgaattgtattctgatctgctttcaaagaatttaatcacagaatatgacaaaaaatatttcgaacctgacactgtaaatgaccaattcaacaaaatcgaattcgctcaagatgcacacagaatgatattgttggaaagaatactttataagaccgaatgcgagatgctgagcttaaagaaaaatagtggaccttacaatgttgcttggcgcacatatttgaaaaatcataacatagatttgtgcagcaggcataattacaaaatgatatgtcagtgtatcaacacgcattccatgtgtaaaaatacagatatagacttcaataaagaaattgaaacatattataaggccaatgctgcagcttataggtctgactttaacacaataatagatacactaaaaacagcatttagaggacttacaaaagtactgattgaaaattacatagaaaaagatgattctgatgccttgaaggctttgtttagcaatattactgattccgttcaggataactatcagatggttggtgtgctaaaatttgctagcaagttactaaatattagtttaggtaggactacccgttcagctcaacattcaataatgactaacgaaattcctaagtcaaacccttttactgattatagttattctagtgtcaatattaaagaatgtatgtcaccggagagcttaaaatgttttaagaaaagagacagtgcaccacatacgaaccatttgctttgtaagatggataacaaatataaagcatttgactggccagaaatagagacagttcagaaagggcaaaagttgtgtcttggtgatagccactgcaacttagaatttactgctataactgcagacaagattatgtcattaactaattgttataaagagtctttcactgcacaacctgccgacatgcaaactggtattaaaaaatgttcagctgatgagattggagaatgtataacccttgaggataaatcgtggccaattgttttctgcggagataaatactattactctgatggtaaagaacatgcaaaagatggatctattaataattattgtcttgcaaataaatgctccgaacagcggttcccaatacataaaaattggttcaaaaagtgcaactgggacaaaactcataaggagttcaccactatgaggcaaataaattacaatgacataacttcatacagaaaggcaattgaatcggaaataggaacagacctaatgacacaccattataagcccacaaagaatctcccacatgttgttccacgatatcacagtatagatgttcaaggtacagaatcaacagaaggtattattaatgggttcatacaaaatacgatacctgctatcagcggcttaggcgtcggctaccacttaggtttcaaaggaaatcaactatttgacatagttatttttgttaaaaaggctgtatataaagcacaatatcagaaagtgtacacaactgggcctagtatatctataaatatcgaacataatgaaaagtgtacaggccactgtcccgaaaaaatacctgctaaagaaggttggttgacattttctaaggaacatacaagctcttgggggtgtgaggagtatggttgccttgccatagacactggctgcctatatggttcttgccaagatgttatacgcccagaattagatatttataaaaaaattggtagtgaagcatcacttatagaaatatgtataactttgcctcatgagacatattgcaatgatatggatatattagaacctattattggagataaattgagtgcatcttttcaaaatacacaaacaaatcagctgccaaacctcatggcttataaaaagggaaaggtctatactggacagataaatgatgtaggaaacacagcattacaatgcggctcaatacaagtagtcaatggttcaactattgggtctggcaatcctaaatttgattatatatgccatgctatgagacgaaaagacgtcattgtgagaaaatgcttcaatgacaattatcagtcttgcactagactggatccaagaaatgatttaattccttacaggaagggcgatattattgagatatcgaagacagggtcaaatatgggtcaaatgacatttaaaatagagttgggcgatattaattataaaatatttactaaatcagtggatctccagatgtctggtatttgtgctggatgcattgattgtgctgaaggcatatcatgttctataaatgccgatgtgtcagctgaaactgtctgccactgtaaaacaaactgtgaagactttataagcaatattgtaatctcaccccaaatcaaaacttataatataaaagtacattgcaagtcaaaagttgaaaagataacagcaaatatctgtgggagaaatattgacttacaattgacagttaagccgtacaatcaaaaaatagatctgtcacagctggatgaatcgaattacataaaagaagaagacctccaatgcggaacatggctgtgtaaagtccaaaaagaaggaattgatattgtattcaaaggactgttttcaggattagggaaatattgggctattctaatttactcaattataggggtaattgtagtcatattattgatatatgtcctactgccaataggacgccttctaaaggcattcctaatcaaaaatgaaatagagtacaccatggagcaaaaaattaaatag

SEQ ID NO: 4313 - RNA, 4263 nt, synthetic construct
  misc_feature 1..4263: note = derived and/or modified CDS sequence (wt) from OROV(TVP-19262/OBS-9478)__KP795100.1__GP
  source 1..4263: mol_type = other RNA
atggcgaatctaataattatttcaatgatcctgggcattgcctatggacatccgctctcaacaagtcagattggtgaccgctgttttgctggtggtagcctttttaaagaaatgaatctgagtgtaggacttggcgaaatatgtgttaaagacgatatatccattgttaagagtacaactgcctttagtaagaatgcactggcacttgaagcaactacaaaattctataggtcttttattgtcaaagattggtctgaatgcaatccagtattagacaaatttggaaacttcatggttttgaatgttgataataacgggcatttaatccctaagatgtatacgtgcagggcagcatgtgatattagattgaataaggataatgcagagataatattgtcatcaacaaagcttaaccatttcgaaattatcgggactacttcaacgtcaggttggtttaaaaacacaataacaaataatctagaacacacatgcgaacatgtgactgttaattgtggtcagaaatcagtaaaattccatgcatgctttcgacagcataggggttgtataagattcttcaaagggacatatatgccgtactcaatgatcgaagcaatgtgtgtcaatatagaattaataatcctaacattgtatatctttgctgcaattatatttgcattaatcataacaaagagctatatagcatacttactcttaccattgttttacccggcaacctggctttacggaaaagtttacaagaggattaattcgtgtcctaattgtctgcttgcatcacatccctttactagctgccccaaaatctgtatatgtggttctagatttagctgcacagaagccctcaaagtacacaggatgggtaaagactgcctaggttataaatccctaagcaaagctagacaaatgtgtaagtctaaaagctggtcattcacagcagctatactgactggcttaatactgatggaatttgtttcaccaattgcaggcgaaaggatgtacaaacttgaagaattggctgatgattacatagaactgacagagcaggtgaatatattaggaaaagaaatcaaaattttaaaacaatctataattgtcatgcttgcaattattttaatactactgctttccgaaaacataatcttcaattacctcttcaacaccctttatcgctcttgttctatgtgtggactgatacactatagaccgggactcaaggttgatttgaccaagactaacaaatgcgggagttgcatttgcggattcgatgagcaacaatcatctgggtttgaatacgaagtatttttaaaagacatgcatgttcaaagggaatcttgcaaatttggacctagagtaaaccattttagaaacactaagattttgttatttacaattgctatttgcacttctttttatacagtttatgcagatgaagactgcttgtctaagaatattaggataacatatcaagaattacacaattgtatagggccacacataatgggtgacacatgtatgccaaaaagtgaattgtattctgatctgctttcaaagaatttaatcacagaatatgacaaaaaatattttgaacctggcactgtgaacgaccaatttaacaaaatcgaattcgctcaagatgcacacagaatgatattgttggaaagaatactttataagactgaatgcgagatgctgagcttaaagaaaaatagtggaccttacaatgttgcttggcgcacatatttgaaaaatcataacatagatctgtgcagcaggcataattacaaaatgatatgtcagtgtatcaacacgcattctatgtgtaaaaatacagatatagacttcaataaagaaattgaaacatattataaggccaatgctgcagcttataggtctgacttcaacacaataatagatacactaaaaacagcatttagaggacttacaaaagtactgattgaaaattacatagaaaaagatgattctgatgccctgaaggctttgtttagcaatattactgattccgttcaggacaactatcagatggttggtgtgctaaaatttgctagcaagttactaaatattagcttaggtaggactacccgctcagctcaacattcaataatgactaacgaaattcctaagtcaaacccttttaccgattatagttattctagtattaacattaaagaatgtatgtcaccagagagcttaaaatgttttaagaaaagagacagtgcaccgcatacgaaccatttgctttgtaagatagacaacaaatataaagcatttgactggccagaaatagagacagttcagaaagggcaaaagttgtgtcttggtgatagccactgcaacttagaatttactgctataactgcagataagattatgtcattaactaattgttacaaagagtctttcactgcacaacccgccgacatgcaaactggtattaaaaaatgttcagctgatgaaatcggagaatgtataacccttgaggataaatcgtggccaattattttctgcggagataaatactattactctgatggtaaagaacatgcaaaagacggatctattaacaattattgtcttgcaaataaatgctccgaacagcggtttccaatacataaaaattggttcaaaaagtgcaactgggacaaaactcataaggaattcaccattatgaggcagataaattacaatgacataacttcatacaggaaggcaattgaatcggaaataggaacagacctaatgacgcatcattataagcccacaaagaaccttccacatgttgtgccacgatatcacagtatagatgttcaaggtacagaatcaacagaaggtattattaatgggttcatacaaaatacaatacctgctatcagcggcttaggtgtcggctaccacttaggtttcaaaggaaatcaactatttgacatagttatttttgttaaaaaggctgtgtataaagcacaatatcagagagtgtacacaaccgggcctagtatatctataaatatcgaacataatgaaaagtgtacaggccattgccccgaaaaaatccctgcaaaagaaggctggttgacattttctaaggaacatacaagctcttgggggtgtgaggagtatggttgccttgccatagacactggctgcctatatggttcttgccaagacgtcatacgcccagaattagatatttataaaaagattggtagtgaagcatcacttatagaaatatgtataactttgcctcatgagacatattgcaatgatatggatatattagaacctattattggagacaaattgagtgcatcttttcaaaatacacaaacaaaccagctgccaaacctcatggcttataagaaggggaaagtctatactggacagataaatgatgtaggaaacacagcattacaatgcggttcaatacaagtagtcaatggttcaattattgggtctggcaatcctaaatttgattatatatgccatgctatgagacggaaagacgtcattgtgagaaaatgcttcaatgacaattatcagtcttgcactagactggatccaagaaatgatttgattccttacaggaagggtgatattattgagatatcgaagacagggtcaaatatgggtcaaatgacattcaaaatagagttgggcgatattaattataaaatatttactaaatcagtggatctccagatgtctggtatatgtgctggatgcattgattgtgctgaaggcatatcatgttctataaatgctgatgtgtcagctgaaactgtctgtcactgtaaaacaaactgtgaagactttataagcaatattgtaatctcaccccaaatcaaaacttataatataaaagtacactgtaagtcaaaagttgaaaagataacagcaaatatctgtgagagaaatattgatttacaactgacagtcaagccgtacaatcaaaaaatagatctgtcacagctggatgagtcgaattatataaaagaagaggatctccaatgcggaacatggctgtgcaaagttcaaaaagaaggaattgatattgtattcaaaggactattttcaggattagggaaatattgggctattctaatttactcaattatagggataattgtagtcatattgttgatatatgtcttactgccaataggacgcctcctaagagcattcctaatcaaaaatgaaatagaatacaccatggagcaaaaaattaaatag

SEQ ID NO: 4314 - RNA, 4299 nt, synthetic construct
  misc_feature 1..4299: note = derived and/or modified CDS sequence (wt) from OROV/FPV(Aus Ch 16129)__KF697137.1__GP
  source 1..4299: mol_type = other RNA
atgaaattcgtgagcattttattatttgtctcctggctaggagcaacttatcaaaatcctgtgtctcaccgccaaataggtgagcgatgttttgctggtggcagtttgataaagactgtcaaccaaactagtggagtttctgaggtctgtgtgagagatgacatatcaatgattaagagtattgttcatacaacaaaggccagtgatactgcagtcaacaattatatacgattctatagggtttttatagtgaaagaatggcatgattgcaacccttttcctgatccaaagggcacatttatggtgttggatgtcagttcgactaaccaccttgaaccaataacatacacatgccgaaccccatgtgaaattacactagataaagattctgctgaagtcactctatcatctcaaaagatgaaccattatgaaatttctggttcaacaataaataacggttggtttaagaacagtatttcagtttccttagagcacacatgtgagcatattactgtctcttgtgggcagaaaactgtaaggttccatgcttgcttccgccagcatagatcttgtacaagattctttaaaaatagtatgatgccagctaggatgacagagtctatatgtcaaaatttagaaataattttgctgacttgcttctcgtttgtctgcttcatatttctctgcataatcacaaaaacttatgtagcatatgtactgattccggtcttttatccctttacatatatttatggccgattgtacgataaatatttcaaattatgcgaaaattgtcttttggcagtccatccctttactccatgtgagacagtatgtgtgtgtggctcccagtatgctaatactgaacagcttagaacccataggatgacaaacaactgcaaaggttacaaatcattgagcaaatctagagctatgtgcaaaagcaaaggttgttcctttgttgttgcaatcttctgttctataatatttttctcatttatcacaccaatcaactctcaggaatataaattatcagatctaccagatgagttcaccagattagaagaggaaaatacaatgcttaagatcaggcttttggttatcaagattacaatttcagtcatatctgtcacaataactgttacatctttaactgagaggaaagtatttcaagagttatttaatgctatatacaggcattgtccattttgcggtatgatacacaggagaagagggctgagagtggttaactcaaccacaaacaagtgtggaacttgtatttgtggatataaagaagaaacagaacatggtgtggaatatgaaatatttctaaaaaccatgcaccaggaaaatgtcaattgcatgtttaaaccatctcaaagacacttccgcaatttcaagatattgattgcatttttagcaatgtgcatgattataacctctgtatctgctgatgaaaaacattgccttaagtataaagaaccagttaaactgtcaaatttaacagaatgccatagcctgtggctcaatataacagaatgtcaaataaatcaatcaacattatttgaaactttaaaaggggagcaattagttacagactttgataaaccagattttactataatgggccaaaaatatgatatagctatggaaagaattgagaatgcacaaaatttacatcatatgattttactggaatacctacatgcaaaaagtaattgtttaaaatataaacaattgaagtcaaattctggaccttacaacataccatggagaacatacattcatggacatggtttggatgtttgtggacaatattcatataaattgatatgtaaatgtatctcgacaggtatgcactgtgaaaacacagcattggatatttataatgaaatgagacagttttacacaaacaatcaagaaaattacaatttagatttaaatactgttataaaggcaataggtttggcaatgcgtggaatcgggcagatgattatagaagaattctttggtgagtctcaaatagaagaattatcaaatttcctgaatatgacatcaaagaatcttggtacaaataagcaactaatcggcttgattaattttggcttaatgctccttgacattaatcagactaaaacaccgcaaattgacccaaaacctagaactctccaggcaaggtcctcgattcctaccggaactgaaataacagattggacaaaaggccaatctaagataaaaacctgtgcagaatatagcacattgacctgtcaatcatggaggaagacagtcaatacaaaatcattcttaatgtgtaaagtgtcaagtaaatggcatgtatataactggccagaaataccaacagttgttagaaattcaaaactatgcttaggtgactatcactgcaatatggaattcacacctatagatgcagacgaagcattgaaacagttacggtgttataagacagaatttgtgccttcaccagatggtatggatgaatctattaaaaagtgcactctagaaaagtttggaggatgcactacggccaatggacattcatggacaataatggtgtgtaatggtagatattatcaaacaaatactagagagcacgcaaaagatggattgttaaacagctattgctttgagccaaaatgtcaatcaggaagacacccaatacacaagtcatttttgaacaattgcatatggaaggagagctcaaggcaaattatagaaacaagaactatagaatacaataatatagaagactataagaaaagtgttgaatcagacataaaaagcgatttaaccattcaccattttaagccaacaaaaaatcttcctctagttactccaacatatatatctgttgttgcagatgggactatggtaagtgatggaattcagaatgcatatgttaaaggaacaataccagggatatcaggagttgccactggactacatgttaagactccagatggaatactattaatggatattatagtatatgttcgcaaagctttatataaagcaaattacgaaaaaatatactccactggcccaactatagggattaatgtcaagcataatgaaaagtgtactggcacatgtccagaacatataccaaaagatgaaggctggctgacattctctaaggaacacaccagcaactggggttgtgaagagtatggctgttttgcaattaattcagggtgcctatatggatcatgtcaagacataattagaccagagctagatatttataaacagcagggagaggagcagacacttttagaattgtgtataaccttacctcatgaaacattttgtaatgatttggatgtgttagagccagtaatcactgacaaattacaattagacttccagacaactcaatcagatcatctacctgagctagttgctttgaagaaaggattaatattgactggacaactaaatgacctaggcaatacagcagcaatgtgcggttcagttcaacttgtgaataaaactatatatgggcaaggaaatccaaagtttgattttatttgtcatgcaatgagaagaaaagatgttattgttaggagatgttatgataatcattatagcacatgtgcattattgaaacaaagaaatgatttattgcataaagaagtcaatgatcaaatgagcataactgtaaatgggaaaaatttggggttgattaattttagattaaatttaggggatctaaattacaagctttttgtcaatgaacctaattttgaactaactggtcaatgtgctggctgtatatcttgtgccgacgaaatctcctgtcaactaaatatcattgcagatcatgagtttacctgcaaggtgtccagctcttgtaatttgtatatatcaaatatgatgattacaccagcaaatcatatttataatttaaaggtttcttgcagagaacatgttagcaatattgaccttgctgtttgtggcagatcttttagtctgcatgctacactaaagcaacatagtcagaaattagatctgtcagcattagacgagactaattttgtaaaagaagaagatttgagatgtggaacctggttgtgtaaagtcaaggatgaaggattatcatttttaactagatcaatatttggatctttagggacatattggtcatactttatttatggtctaatatttatgattcttttattcatagcaatttattttctctatccgctatgcaagagacttaagggattgttagaagagaatgagagagaatacttgattgaatcaaagatgaaataa

SEQ ID NO: 4315 - RNA, 4257 nt, synthetic construct
  misc_feature 1..4257: note = derived and/or modified CDS sequence (wt) from OROV/IQTV(IQT9924)__KF697143.1__GP
  source 1..4257: mol_type = other RNA
atggattgcataatattttacctgtcattttttgctgtagttacagcacatcctgtgtctcaccaccaagttggtgataggtgttttgccggaggcaacttgataaaagatttgaataagacagtaaatattggtgaagtatgtgttagagatgatatatcaataatcaaaagtacgacagctattcaaaagtcactagaccacttatccactcggacaaagttttaccgtgtttacatagttaaggaatgggctgagtgcaacccaattattgattatgctgggaattttattgttatgaacattgatgataacggccacctagtacctagaatgcatacctgcagagcttcatgcgatataaggttaaacaaaaatgacgctgaaatcattttatcatcgcagaaaaccaatcattatgaaataattggaaccaccactgtcagtggttggttcaaaaatactataaatctgcccttagagcacacatgtgaacatataactgtgaattgcggacaaaaatcattgagattccatgcctgctttaggatgcatagaggatgcactagattctttaaaaacacatatatgccatcaacaatgattgaacatatgtgtgtaaacctagagttaataattttcacattatatatcttcaccgcattggtgtttgcatatattattacaaaaagttatatagcatatatccttctgccattattttatccattaacttatgtatttggtataatatactcaaaattgaagcagtgcaagacatgtatgcttgctgcccatccgtttactaattgccccaagagatgtgtctgtggatctagattcaattgcacagaagctctccgtgtacatagattgggcagagattgccaaggatataaatcattgagtaaagccagacagatgtgtaaatcaaaatcctggtctttcatcattgcaatcttcactggacttatacttatggaatttataacacctatccacggtgaaaggacttacaaactcagtgaactggctgatgagtttattgctatgaagactgaagtaacagtgatgcaaagatcaatatataatcagaaaatattaaatatagcattgctaactttagtggtattaataattcttttagaaacatatatttttaaaatcctttttagtcttttatatagatcatgctccatgtgtggtttgatacattataaagtgggcctaaaaataaatttattaaccactaataaatgtggcacctgtatttgcggatttagtgaacaacaatcttctgggtttgaatatgaagttttcttaaaggatatgcataaacagcgagaatcctgtaaatatttcccgatgttgaaccatttccgcaatctaaaaatattaacaactatattgctactgattctgctagcaactagtgtttcaagtgaatgccttcagaaaccattaaaaataaagctggaagatttgcatgaatgcattggggttaatttccttgataagcaatgctataataggaagaacttatatgagtcattaagatcgaagaatctcatttctgaagttgataaaaaatattttgagaacgctgatttagaagggcaatttaagaggatagaatatgctcaggatgcacatcggatgatacttttagaaagaatactctattccacagagtgtgagatgcatactatcctaacaaatggtggagcatataacatcccatggagaacatatttaaagaatcacaacttgaatttatgcggcaagcatgtacataaaatggtatgccaatgtgtgaatacacacacacaatgcctgtctactggtatagattaccaagacgaaattactaaattctaccaagctgatggagattcatacagatctgatctatctataattcttgaaacaatatcaactgcatttagagggttaactaaagttttgattgaaacttatatcgaacaagataatagtgagtctatgataaaattgctcaacacaattcaaggaaaggttccaaataattatcaaatgttaggtatacttaaatttgccattaagatcatgaacattaatcaaactcgaggtgtacgatctgccagacatacaattgtatcaaatgatatacctatgtctgaaccgttttccaacttcgaggtatcaaatataaacattaagcagtgtttagaaccattaactctaaaatgcttcacaaaaagaggtgactcacctcattctaatcacctgctatgtaaagaacaaagtaaatataaagtatttgaatggcctgaagtagaaacggttacaaagaataacaaactttgcttaggagatactcattgcaacctcaaatttactgcaacaacatctgacgaaatcatcaaactattgaattgtttcagtgatacatacaaaccaaaccctggagaaatggaaatagggctcaaaaagtgcaatgctgaaaaaataggtgagtgtgtcacattagaaaatagcccgtggcctatagtatattgtgaaaacaaatactattattcagaagcaaaagagcatgcaaaggatggtagtgttaatagttactgtttaacaaataagtgcaccgaagataggttgcctatcaacccagcctggttcaaatcatgtaattgggaaaaaaatattaaggaaacagcaacaataaaggaatttgtatacaatgacatcaagtcataccgcaagtcactagaatcagaaatcaatacagacctaatgatacaccattataggccaacgaaaaatttgccgcatattaagcctatttataaatccctcagtatacaaggaagcgagacagtggatggcctacagaatagctttatagagggagaaatgccagctatcagtgggttagccaacggttatcacttgatgtataaaggcacacagctatttgatatagtaatatttataagaaaagcagtatacaaagccaattattacaaaatatacactactgggcctagtattgctataaatatggagcataatgaacaatgtacaggacattgtccaagcaaaataccttctaaggaaaactggttgacattctcaagagaacatactagttcatggggttgcgaagaatatggctgccttgctattgatacaggctgtctatacgggtcgtgccaagatgtcattaggcctgagatagatgtctacaaaaaatctggaactgagcaaagcttgatagagctctgcataacatcagcacatgaaactttttgtaatgatttggacatactagagcccataattggagaaaagatatcagcatcattccagtctacacagtctaaccaattacccaatataatagccttcaggaaaggacagatacttacaggtgctatcaatgatctaggaaatacaggcagccagtgtgggtcaatacaattagtaaacaacacattattaggggaagggaatgtcaaatttgactatatatgccatgctatgagaaggaaggatgttatcatcagaaggtgttataatgaccactttacaagttgcaacctgttgcagaagcgctctgacttgattggtaatattaatgggaaagaattgcaaatcagtatgtcaggacgatcaatgggctcaatgaagttcaaaattgaactcggggatataaattacaagttgtatactgaaaatgcagatataactataagaggtgagtgcggaggttgcattggctgtgcagaagctgtctcatgttctttagaagtggaatccgctagcgaaatattatgtaaagttgaatgtaattgtcaaccatacatagagaacattttgataaaaccgcaaacaaaaacctattcatttaaggctacatgcttggaaaagtctaacaccttagacatcaaaatatgtgggaaacaaattatagcacccttgactataaaatcatataatcaaaaaattgacctatccaaactagacgaatcaaattatgtaaaagaagaagatttagcatgcaacacatggctatgtaaggttcaaacagaaggtttcaattttgtcttctctggcttgtttgctgggttcggtagatattggactatcgcaatttatatattgattgctgtggtaattatattaatactgatatatatattgatgcctatctttagattgatacggaccttcttaataaaaaatgagatagaatatactactgagcaaaaaatgagatag

SEQ ID NO: 4316 - RNA, 4257 nt, synthetic construct
  misc_feature 1..4257: note = derived and/or modified CDS sequence (wt) from OROV/IQTV(MIS-0397)__KJ866387.1__GP
  source 1..4257: mol_type = other RNA
atggattgcataatattttacctgtcattttttgctgtagttacagcacatcctgtgtctcatcaccaagttggtgataggtgttttgccgggggcaacttgataaaagacttgaataagacagtaaatattggtgaagtatgtgttagagacgatatatcaataatcaaaagtacgacagctattcaaaaatcactagatcatttatccacgcggacaaagttttaccgtgtttacatagttaaggagtgggctgagtgcaacccaattattgattatgctgggaattttattgttatgaacattgatgataatggccacctagtacctagaatgcatacctgcagagcttcatgcgatataaggttaaataaaaatgacgctgaaatcattttatcatcgcagaaaaccaatcattatgaaataattggaaccaccactgtcagtggttggttcaaaaatactataaatctgcccttagagcacacatgtgaacatataactgtgaattgcggacaaaaatcattgagattccatgcctgctttaggatgcatagaggatgcactagattctttaaaaacacatatatgccatcaacaatgattgaacatatgtgtgcaaacctagagttaataattttcacattatatatctttaccgcattggtgtttgcatatattattacaaaaagttatatagcatatatcctcctgccattattttacccattaacttatgtatttggtataatatactcaaaattgaagcagtgcaagacatgtatgcttgctgcccatccgtttactaattgccccaagagatgtgtctgtggatctagattcaattgtacagaagctctccgtgtacatagattgggcagagactgccaaggatataaatcattaagtaaagccagacagatgtgtaaatcaaaatcctggtctttcatcattgcaatcttcactggacttatacttatggaatttataacacctatccacggtgaaaggacttacaaactcagcgaactggctgatgagtttattgctatgaagactgaagtaacagtgatgcaaagatcaatatataatcagaaaatattaaatatagcattgctaacgttagtggtattaataattcttttagaaacatatatttttaaaatcctttttagtcttttatatagatcatgctccatgtgtggtttgatacattataaattgggcctaaaaataaatttattaaccactaataaatgtggcacctgtatttgcggatttagtgaacaacaatcttctgggtttgaatatgaagttttcttaaaggatatgcataaacagcgagaatcctgtaaatatttcccgatgttgaaccatttccgcaatctaaaaatattaacaactatattgctactgattctgctggcaactagtgtttcaagtgaatgtcttcagaaaccattaaaaataaagctggaagatttgcatgaatgcattggggttaatttccttgataggcaatgctataatagaaaggacttatatgagtcattaaggtcgaagaacctcatttctgaagttgataaaaaatattttgagagcgctgatttaggagggcaatttaagaggatagaatatgctcaggatgcacatcggatgatacttttagaaagaatactctattccacagagtgtgagatgcatactatcctaacaaatggtggagcatataacattccatggagaacatatctaaagaatcacaacttgaatttatgcggcaagcatgtacataaaatggtgtgccaatgtgtgaatacacacacacaatgcctgtctactggtatagattaccaagacgaaattactaaattctaccaagctgatggagattcatacagatctgatctatctataattcttgaaacaatatcaactgcatttagagggttaaccaaagttttaatcgaaacttatatcgaacaagataatagtgagtctatgataaaattgctcaacacaattcaaggaaaggttccaaataattatcaaatgttaggtatacttaaatttgccatcaagatcatgaacattaatcaaactcgaggtgtacgatctgccaggcatacaattgtatcaaatgatatacccatgtctgaaccgttttccaacttcgaggcgtcaaatataaacattaagcagtgttcagagccattaactctaaaatgcttcacaaaaagaggtgactcacctcattctaatcacctgctatgtaaagaacaaagtaaatataaagtattcgaatggcctgaaatagaaacagttacaaagaataacaaactttgcttaggagatactcattgcaacctcaaatttactgcaacaacatccgacgaaatcatcaaactattgaattgttttagtgatacatacaaaccaaaccctggagaaatggaaatagggctcaaaaagtgcaatgctgaaaaaataggtgagtgtgtcacattagaaaatagcccgtggcctatagtatattgtgaaaacaaatactattattcagaagcaaaagaacatgcaaaggatggtagtgttaatagttactgtttaacaaataagtgtaccgaagatagattgcctatcaatccagcctggttcaaatcatgcaattgggaaaaaaatattaaggaaacagcaacaataaaggaatttgtatacaacgacatcaagtcataccgcaagtcactagaatcagaaatcaatacagacctaatgatacaccattataggcctacgaaaaatttgccacatattaagcctatttacaaatccctcagtatacaaggaagcgagacagtggatggcctacagaatagctttatagagggagaaatgccagctatcagtgggttagccaacggttaccacttgacgtataaaggcacacagctatttgatatagtaatatttataagaaaagcagtatacaaagccaattattacaaaatatacactactgggcctagtattgctataaatatggagcataatgaacaatgtacaggacattgtccaagcaaaataccttctaaagaaaactggttgacattctcaagagaacatactagttcatggggttgcgaagaatacggatgccttgctattgatacaggttgtttgtacgggtcgtgccaagatgtcattaggcctgagatagatgtttacaaaaaatctggaaatgagcaaagcttgatagagctctgcataacatcagcacatgaaactttttgtaatgatttggacatattagagcccataattggagaaaagatatcagcatcattccagtctacacagtctaaccaattacccaatataatagccttcaggaaaggacagatacttacaggtgctatcaatgacctaggaaatacaggcagccagtgtgggtcgatacaattagtaaacaacacattattaggggaaggaaatgtcaaatttgactatatatgccatgctatgagaaggaaagatgttatcatcagaaggtgttataatgaccactttacaagttgcaacctgttgcagaagcgctctgacttgattggtaatattaatgggaaagaattgcaaatcagtatgtcaggacgatcaatgggctcaatgaagttcaaaattgaactcggggatataaattacaagttgtatactgaaaatgcagatataactataagaggtgagtgcggaggttgtattggctgtgcagaagctgtctcatgttctttagaagtggaatcctctagtgaaatattatgtaaagttgaatgtaattgtcaaccatacatagagaacattttgataaaaccgcaaacaaaaacctattcatttaaggctacatgcttggaaaggtctaacaccttagacatcaaaatatgtgggaaacaaattatagcacccttgactataaaatcatacaatcaaaaaattgatctatccaaactagacgaatcaaattatgtaaaagaagaagatttagcatgcaatacatggctatgtaaggttcaaacagaaggtttcaattttgtcttctctggcttgtttgctgggtttggtagatattggactatcgcaatttatatattaattgctgtggtaattatattaatactgatatatatattgatgcctatctttagattgatacggaccttcttaataaaaaatgagatagaatatactactgagcaaaaaatgagatag

SEQ ID NO: 4317 - RNA, 4257 nt, synthetic construct
  misc_feature 1..4257: note = derived and/or modified CDS sequence (wt) from OROV/MDDV(FMD 1303)__KF697145.1__GP
  source 1..4257: mol_type = other RNA
atggcgttcttactaatctacgtagttttggctgctgcagtggcatcacatccattatccaatcaccagattggtgataggtgctttgccggagggaacttgataagagagttaaataaaactgtaaatattggcgaattgtgtgttagagacgatatatcaatgataaaaagcaccactgctatccagaaatctgtaggccatttatctacaaggacaaaattttatagagtatacatagttaaagaatgggcagaatgcaatccaattatagattttgctgggaatttcataattatgaatattgatgagaacggtcacttagtccctaaaatgcatacctgcagagcttcatgtgatatacgtctaaataaggatgatgcagaaattattttgtcatcgcaaaaaacaaatcattatgaaataatagggacaacaagtattagtggctggtttaaaaatactattaatctaccattggagcatacatgtgagcatattactgttaattgtggccagaaatcattgagattccatgcatgttttagaatgcataggggatgtactagatttttcaaaaacacctatatgccatccactatgattgagaccatgtgcgttaaccttgaattgattatattcacattatatatctttagtgcagcagtatttgcatatgtaattacaaaaagttacatagcatatattcttctgccggttttttatccgataacatatattttaggttctatatactccagatttaaacagtgtaaaacttgcatgttagctgctcacccattcacaagctgccctaaaaaatgtgtttgcggatctagattcaactgcactgaggctttacgtgtccacagattgggaaaagattgccaaggttataaatcactgagtaaggctagacaaatgtgtaaatctaagtcttggtccttcattattgcagtttttactggccttattcttatggagtttataacaccaataagcggcgaaaggatgtataagcttagcgaactggctgaggaattcattgaaatgaaggaagaggcatcagcattgaagaaagctattaacaacttaaaactgttgaatgtattactatcagcaattgccacattagtagtcgttatggaaacatacatattcaagtctttattcaatttgttatatagatcatgttctatgtgcggtctaatacattataaaataggcttaagggtgaatttgttaactacaaacagatgcggtacatgcatatgtggatttaatgagcagcagtcatcaggttttgaatatgaaatcttcctaaaggacatgcataaacaaagagaatcatgcaaatacttcccgatgctcaatcattttagaaatgtcaaaatattgacagtattcttgctattgactatgctaacagctagtgcgtccagtgaatgcctacagaaaccattaaagataaaactagaagatttacatgaatgtattggcgttaacttccttaataggcaatgctacaatagtcaggaattataccaatcattaaagtctaaaaacctggtctcagaagttgacaaaaaatattttgataataagaatttagaagatctatttaagagaatagagtatgcacaagatgcccatagaatgatacttttggaaagaatactttactccacagagtgcgagatgcatactatactaacaaatggcggtgcatataatattccctggcgaacatacttgaaaaaccacaatttaaacctatgcggtaaacatgttcataaaatggtttgtcaatgcataaatacgcatacacaatgcttgtccactggcattgattaccaagatgaaattaccaaattttaccaagcagatggcgattcttatagagctgatttatctgtaatcttgcaaactatagcaactgcctttagaggtatgactaaagttctgatagaaacatatatagaacaggacaacagcgaatctatgataaaattgcttaatacgatcaaagagaaagtgccaaataattatcaaatgctaggtattctaaattttgctattaaaatcatgagtgtgaaccagactcgaggcgtgcgctctgctagacatactatcatatccaatgatatacctatgtctgaaactttttccaacttcgaagtatcaaatatagatgttaagcaatgcacagatccattaactctgaaatgcttcaccaaaaggggggacgcgccacattccaaccacttattgtgtaaagagcaaaacaaatacaaagtctttgaatggccggagatcgaaacagttatgaaaaacaataaattatgtctgggagatactcattgcaatcttaaatttgctgcaatagcatctgatgaagttataaaattgctaaattgtttcagtgatacatataagccaaatccaggagaaatggaggtcggtgcaaaaaaatgcaatgctgataaaataggtgaatgcattacattagagaataatccttggcctatagtctattgtgaaacaaaatattattattcggatgcaaaggaacatgcaaaagatggaaatgtgaacagttattgtttaacaaataagtgcaatgaggacagatttcctataaatccaacttggttcaagtcatgtagctgggataggaatgttaaagaaactacaacaataaaggaatttgtgcacaatgatattagtgcataccgtaaatcacttgaatctgaaataagtactgatttattaatacatcattataggccgacaaaaaatttgccccatataatgccagcatacaaatcactcactattcaaggtagtgaaacggtagatggtttacaaaacagctttattgaaggggagatgcctgccattagtggtctagcaaatgggtaccacctaaaatataagggcattgagttgtttgatattgtgatttttataagaaaggctgtatacaaagctaattattataagatatatacaactgggccaagtgttgcaataaatatggagcataatgagcaatgcactggaagctgtccaaaaaagatacctgctaaggaaaattggttgaccttttcaaaagagcatactagctcatggggttgcgaagagtatggctgccttgcaattgacacgggatgcctctatggatcatgtcaagatgttattagaccagaggtagatgtgtataagaaggctagtgcggagcagagtttaatagaattatgcattacatctgctcatgaaaccttttgtaatgacttggatatactggaacccataatcggagataagatatctgcagcatttcaatcaacacaagtcaatcaattacccaacataatagcatttaagaagggccagatattcactggtgcaattaatgacctgggaaacacaggcagtcaatgtggctcgatacaattgattaataatactctgctgggagaaggtaatgtaaagtttgattatatatgccatgctatgaaacggaaagatgttattgtgcgaagatgctacaatgaccattttgctagctgcaacttattacagaaacgctctgatctagttggcacccttaatggaaaagaactccaggttagtatgtctgggcgatctatgggatcaatgaagttcaaagttgaactaggagatattagctataagctttataccgaaaacgcagatatatcaataagtggagaatgtggaggatgcatcaactgtgcagaggcaatatcatgtgctttagaaatagattcttcaaccgaagtgttatgcaagttagagtgtagctgtcagccatacattcaaaacatcctcattaagcctcaggtcaagaaatactcattcaaggccacatgctttgagaagcggaactcattagaggtcacagtatgtaaaaaacagcatactataccccttactataaaatcttacaatcaaaaaattgatttgtccagacttgacgagtcaaactatgtaagagaagaggatttgacgtgtaatacatggctatgcaaagttgaaaaagaaggaataggtgttatgttctctggtttattcgctggctttggcaaatactggagtattgcaatttatgctttgattgcattagtaattttcctcatactgatctatattctggtaccaatcttcaggttgatcaggaccttcttgatcaaaaatgaagtggagtataccacagagcaaaagatgagataa

SEQ ID NO: 4318 - RNA, 4257 nt, synthetic construct
  misc_feature 1..4257: note = derived and/or modified CDS sequence (wt) from OROV/MDDV(INHRR 17a-10)__KJ866390.1__GP
  source 1..4257: mol_type = other RNA
atggcgttcttactaatctacgtagttttggctgctacagtggcatcacatccattatccaatcaccagattggtgataggtgctttgccggagggaacttgataagagagctaaataaaactgtaaatattggtgaattatgtgttagagacgatatatcaatgataaaaagcaccactgctatccagaaatctgtaggccatttgtctacaaggacaaaattttatagagtatacatagttaaagaatgggcagaatgcaatccaattatagattttgctggaaatttcataattatgaatattgatgagaatggacacttagtccctaaaatgcatacctgcagagcttcatgtgatatacgtctaaataaggatgatgcagaaattattttgtcatcgcaaaaaacaaatcattatgaaataatagggacaacaagtattagtggctggtttaaaaatactattaatctaccattggagcatacatgtgagcatattactgttaattgtggccagaaatcattgagattccatgcatgttttagaatgcataggggatgtactagatttttcaaaaacacctatatgccatccactatgattgagaccatgtgtgttaaccttgaattgattatattcacattatatatctttagtgcagcagtatttgcatatgtaattacaaaaagttacatagcatatattcttctgccggttttttatccgataacatatattttaggttctatatactccagatttaaacagtgtaaaacttgcatgttagctgctcatccattcacaagctgccctaaaaaatgtgtttgcgggtctagattcaactgcactgaggctttacgtgtccacagattgggaaaagattgccaaggttataagtcactgagtaaggctagacaaatgtgtaaatctaagtcttggtccttcattattgcagtttttactggccttattcttatggagtttataacaccaataagcggcgaaaggatgtataagcttagcgaactggctgaggaatttattgaaatgaaggaagaggcatcagcattgaagaaagctattaacaacttaaaactgttgaatgtattactatcagcaattgccacattagtagtcgttatggaaacatgcatattcaagtcattattcaatttgttatatagatcatgttctatgtgcggtctaatacattataaaataggcttaagggtgaatttgttaactacaaacagatgcggtacatgcatatgtggatttagtgagcagcagtcatcaggttttgaatatgaaatcttcctaaaggacatgcacaaacaaagagaatcatgcaaatacttcccgatgctcaatcatttcagaaatgtcaaaatattgacagtattcttactattgactatgctaacagctagtgcgtccagtgaatgcctacagaaaccattgaagataaaactagaagatttacatgaatgtattggcgttaacttccttaataggcaatgctacaatagtcaggaattataccaatcattaaagtctaaaaacctggtctcagaagttgacaaaaaatattttgataataagaatttagaagatctatttaagaggatagagtatgcacaagatgcccatagaatgatacttttggaaagaatactttattccacagaatgcgagatgcatactatactaacaaatggcggtgcatataatattccctggcgaacatacttgaaaaatcataatttaaacctatgcggcaaacatgttcataaaatggtctgtcaatgcataaatacgcatacacaatgcttgtccactggcattgattaccaagatgaaattaccaaattttaccaagcagatggcgattcttatagagctgatttatctataatcttggaaactatagcaactgcctttagaggtatgactaaagttctgatagaaacatatatagaacaggacaacagcgaatctatgataaaattgcttaatacgatcaaagagaaagtgccaaataattatcaaatgctaggtattctaaattttgctattaaaatcatgagtgtgaaccaaactcgaggcgtgcgctccgctagacatactatcatatccaatgatatacctatgtctgaaacttttaccaacttcgaagtatcaaatatagatgttaagcaatgcacagatccattaactctaaaatgcttcaccaaaagaggggacgcaccacattccaaccacttattgtgtaaagagcaaaacaaatacaaagtctttgaatggccggagatcgaaacagttatgaaaaacaataaattatgtctgggagatactcattgcaatcttaaatttgctgcaatagcatctgatgaagttataaaattgctaaattgtttcagtgatacatataagccaaatccaggagaaatggaggtcggtacaaaaaaatgcaatgctgataaaataggtgaatgcattacattagagaataatccttggcctatagtctattgtgaaacaaaatattattattcggatgcaaaggaacatgcaaaagatggaaatgtgaacagttattgtttaacaaataagtgtaatgaggacagatttcctataaatccaacttggttcaagtcatgtagctgggataggaatgttaaagaaactacaacaataaaggaatttgtgcataatgatattagtgcataccgtaaatcacttgaatctgaaataagtactgatttattaatacatcattataggccgacaaaaaatttgccccatataatgccagcatacaaatcactcactattcaaggtagtgaaacagtagatggtttacaaaacagctttattgaaggggatatgcctgccattagtggtctagcaaatgggtaccacctaaaatataagggcattgagttatttgatattgtgatttttataaaaaaggctgtatacaaagctaattattataaaatatatacaactgggccaagtgttgcaataaatatggagcataatgagcaatgcactggaagctgtccaaaaaagatacctgctaaggaaaattggctgaccttttcaaaagagcatactagctcatggggttgcgaagagtatggctgccttgcaattgacacgggatgcctctatggatcatgtcaggatgttattagaccagagatagatgtgtataagaaggctagtgcggagcagagtttaatagagttatgcattacatctgctcatgaaaccttttgtaatgacttggatatactggaacccataattggagataagatatctgcagcatttcaatcaacacaagtcaatcaattacccaacataatagcatttaagaaggggcagatattcactggtgcaattaatgacctgggaaacacaggcagtcaatgtggctcgatacaattgattaataatactctgctgggagaaggtaatgtaaagtttgattatatatgccatgctatgaaacggaaagatgttattgtgcgaagatgctacaatgaccattttgctagctgcaacttattacagaaacgctctgatctagttggcacccttaatggaaaagagctccaagttagtatgtctgggcgatctatgggatcaatgaagttcaaagttgaactaggagatattagctataagctttataccgaaaacgcagatatatcaataagtggagaatgtggaggatgcatcaactgtgcagaggcaatatcatgtgctttagaaatagattcttcaaccgaagtgctatgcaagttagagtgtagctgtcagccatacattcaaaacatcctcattaagccgcaggtcaagaaatactcattcaaggccacatgctttgagaagcggaactcattagaggtcacagtatgtaaaaaacagcatactatacctcttactataaaatcttacaatcaaaaaattgatttgtccaggcttgacgagtcaaactatgtaagggaagaggatttgacgtgtaatacatggctatgcaaagttgaaaaagaaggaataggtgttatgttctctggtttatttgctggctttggcaaatactggagtattgcaatttatgctttgattgcattagtaattttcctcatactgatctatattctggtaccaatcttcaggttgatcaggaccttcttgattaaaaatgaagtggagtataccacagagcaaaaaatgagataa

SEQ ID NO: 4319 - RNA, 4257 nt, synthetic construct
  misc_feature 1..4257: note = derived and/or modified CDS sequence (wt) from OROV/Perdoes virus(BeAn789726)__KP691625.1__GP
  source 1..4257: mol_type = other RNA
atgtttattcaattcaatttagcgttcttttgtctctcaatagtctgtggccatccattgaccaaagaccatattggtgacaggtgctttgcaggaggtaatctgttcaaagagattacccaaactacaggcttaagtgagatatgtattaaggatgatatttcaataattaaaagtcaagtagaaattaaaaagcaatcttctgaagtgacttatgctgtaaaattctatagagtctatttggtaaaagaatggagcgagtgcaacccaatacaggatcaacatggttctataatgatattagatgtaacaaacacaggtctaatcgtccctaaaatgtacacttgtagagcagcttgcgatataacattggataaagacaatgcagaggttgtcttcatttcccaaaaaaataacaactatgagttagctggtactacagtcatgcacggttggttcaaaaatgttgtttctataaaactagaacacacatgtgagcatttgactgccacatgtggtcaaaaaacagtaaagttccatgcctgcttcagacaacatagagcctgcgccaggttcctaaaaacaacctatatgcctattgttatggtggaatcactatgctcaaacctggaattagtcatcttcatcacatatatttttgtgtgcctagcatttgcattcataataacgaggacttacgtagcttacctactaatacctgtattctaccctttcacatatgcatatggtaaaatgtatttgaaatgtgtaaaaacttgccctaattgcctattagcaatgcacccgtttacaaattgcactaatctatgcatttgtggcagtcggttcagcaacactgaatctttaaaggtgcatcgactaggtaattgttatggatataaagcattaagtggtgcaagaagtatgtgcaagtcaaaggtttcatcatttacaactgctatgttttttggtataataatcttatcgtttattgcaccactaaatggtgagagactatataaattatctgaactaccagacgaatatatagagatggagtcaacaatagaaggaagcaaacaaaaagagacaatagtagatataatcaattatactgcgttggtgctaatattaataaccatactcttgcagggtattttagagaattatatatttaggttaaaatttagattttgctccttctgtgatatgatacatatgaagaagaatttgaaaatattctctaacatgacaaataaatgcggcacatgtatttgtggttttaaccaagagatcagatcagggtttgattatgaggtgtttataaaggatatgcatgtttcgagagaatcctgtaaatataactaccataaaaattatagcttctacataaaaatgttgttggtagtactactagtgcctttgataggcacaactgcagctgaggatactaaatgtttaaaatatgatttgaataaaaatatagaggatttgaaggactgctatggtttaaagttaaatatagataaacacgatacagtggaaaatgcttacaaaaatttagttgatcaaaaacttgtgtcagaattagaccgattagatctcaatataatgctaggttccaaagaatcaatatttgaagctatcgagacctccatgaatatacatcaaatggtatttttagaatatcttgcatataagacagacccaaaattgagcgagattaaacaaaatacagggccatacaatattgcatggcgaacctttatacatggcaatagccttgaagtgtgtggtaattatccttacaaattaatttgctattgtataaatcaaaaaactcattgtgagaattcaactgtagattatgggattcaaatacaaccattttacaaccagcatcctaatagttataaatctgatatggaagcactgattaaaacagtccagatagcatttcgggggattataaaagttcttatacagtattatgttgagaataacaaaaccagtgaactctcaaatctccttactgagctcaggaatgtaatgggaaataatattcaaatgaaaggaattttaaaatatctggaaacttacttaaagaagcccctattgatggcaagaacgattcggatagcagcaaaagtcgacacttcaggtgatccatataataacttttcaacatctaaagaaaatataacaaaatgcattaaaatacaaaaattgagatgcattacgaaattgacaagaattgaacataactatattctttgcggtgattctgagaaaaagttataccagtggccagcaaaaccaactattgtagatgacaatgatgcctgtttgggagacaaacactgtcacctgccatttattccaataggcaatgatgaggcaataaaaacagttaactgttatgtagaagtctatgagcaaaaccctggggacatgaattcttatcaaaagaaatgtgatgctatgaatgtcgggacatgcttaaccataaaaaatgagaattggcctatagtacaatgcaagacagggaaatattattatgctgacggccgtatacatgctaaagatggtacaataaatacttactgcttttctgaaaaatgtaatgcagacaggtatccaatacatcaggattatataaattcatgtaattggcaagagacaataaaagacttccaacatgtgagagaatttgtccacctagatatagaatcctataaaaaggcaatagagtcagatattaagacagatttagttgtacataaattcaggccggtgaaaaatcttccgcatgttatcccaatatacaagagtatcacagttcaaggaacagagacatctgatggtatacagaatgcttttatccaaggctcaatgcctgcaattagtggtcttgctaacggctaccatttattcacaccagactccaaacaattatttgatgtcgtactattcctcagaaaggcatcatataaagccgaatatcggaaaatatactcaacagggcctacaattggaataaatgttgaacataatgagaaatgcactggctcttgtccaaagactattgacaaaaaggataattggttgacattctccaaagagcataccagtcaatggggttgtgaagagtacggatgcctagctattaacactggatgtgtctttggttcttgccaggatataatccgacctgagatagatgtgtataaaatgcatggtgcagagagaagtgtggtagaattatgtataacattaccacatgaaacttattgcaatgatttagatgtccttgagccaattattggtgacaaaatacaagcagcatttcaaactgtgcaatcaaaccatatgcctagactaatggctatcaaaaataataaggccttcactggtcaaattaatgatttgggtagcacagctagttactgtgggtcagttcagaagtttaatgagactattatagggcaaggagaccctaaatttgattatgtatgtcatttattgaagcggaaagacattatagttcgaagatgttatagcaacaattatgagtcttgtaagctgctcacacccagagcagatataatagtggacaagaaaggggagtcgcttcaagcaagcatagtcggattaaatctaggccagatgaacttcaaaattatgctgggagatataaactataagcaatacactgagtccaataacttagaagcaacaggacagtgtgtgggatgcgttgattgtagtgaagacatagtctgtaacctcaaaatagaatcgcaatcagagtctgtgtgcaacattaaatcagactgtaatctatatttatcaagtatgctaatccagcccactgtcggtgaatataacctcaaaatgtcatgtaatgcaaaattagacaaggtaaatatagaaatatgtaagcagaaatttgtactacctttaaccataaagtcgcataaccagaagattgacttatctaagctagatgagtctaattatataagagaagaagacctaaagtgtgatactatgatatgcaaggttaaagacgaaggactttcatttataacaaacagcttgtttgggggaatatcatacttttggaaaatactaatttcaagcctaattgtaatatttttaataatactcttctattatgtagggctacccatccttagactcattaaagattatcttaaggaaaatgaattagaatatctggcagaaggaaaatga

SEQ ID NO: 4320 - RNA, 4257 nt, synthetic construct
  misc_feature 1..4257: note = derived and/or modified CDS sequence (wt) from OROV/Perdoes virus(BeAn790177)__KP691628.1__GP
  source 1..4257: mol_type = other RNA
atgtttattcaattcaatttagcgttcttttgtctctcaatagtctgtggccatccattgaccaaagaccatattggtgacaggtgctttgcaggaggtaatctgttcaaagagattacccaaactacaggcttaagtgagatatgtattaaggatgatatttcaataattaaaagtcaagtagaaattaaaaagcaatcttctgaagtgacttatgctgtaaaattctatagagtctatttggtaaaagaatggagcgagtgcaacccaatacaggatcaacatggttctataatgatattagatgtaacaaacacaggtctaatcgtccctaaaatgtacacttgtagagcagcttgcgatataacattggataaagacaatgcagaggttgtcttcatttcccaaaaaaataacaactatgagttagctggtactacagtcatgcacggttggttcaaaaatgttgtttctataaaactagaacacacatgtgagcatttgactgccacatgtggtcaaaaaacagtaaagttccatgcctgcttcagacaacatagagcctgcgccaggttcctaaaaacaacctatatgcctattgttatggtggaatcactatgctcaaacctggaattagtcatcttcatcacatatatttttgtgtgcctagcatttgcattcataataacgaggacttacgtagcttacctactaatacctgtattctaccctttcacatatgcatatggtaaaatgtatttgaaatgtgtaaaaacttgccctaattgcctattagcaatgcacccgtttacaaattgcactaatctatgcatttgtggcagtcggttcagcaacactgaatctttaaaggtgcatcgactaggtaattgttatggatataaagcattaagtggtgcaagaagtatgtgcaagtcaaaggtttcatcatttacaactgctatgttttttggtataataatcttatcgtttattgcaccactaaatggtgagagactatataaattatctgaactaccagacgaatatatagagatggagtcaacaatagaaggaagcaaacaaaaagagacaatagtagatataatcaattatactgcgttggtgctaatattaataaccatactcttgcagggtattttagagaattatatatttaggttaaaatttagattttgctccttctgtgatatgatacatatgaagaagaatttgaaaatattctctaacatgacaaataaatgcggcacatgtatttgtggttttaaccaagagatcagatcagggtttgattatgaggtgtttataaaggatatgcatgtttcgagagaatcctgtaaatataactaccataaaaattatagcttctacataaaaatgttgttggtagtactactagtgcctttgataggcacaactgcagctgaggatactaaatgtttaaaatatgatttgaataaaaatatagaggatttgaaggactgctatggtttaaagttaaatatagataaacacgatacagtggaaaatgcttacaaaaatttagttgatcaaaaacttgtgtcagaattagaccgattagatctcaatataatgctaggttccaaagaatcaatatttgaagctatcgagacttccatgaatatacatcaaatggtatttttagaatatcttgcatataagacagacccaaaattgagcgagattaaacaaaatacagggccatacaatattgcatggcgaacctttatacatggcaatagccttgaagtgtgtggtaattatccttacaaattaatttgctattgtataaagcaaaaaactcattgtgagaattcaactgtagattatgggattcaaatacaaccattttacaaccagcatcctaatagttataaatctgatatggaagcactgattaaaacagtccagatagcatttcgggggattataaaagttcttatacagtattatgttgagaataacaaaaccagtgaactctcaaatctccttactgagctcaggaatgtaatgggaaataatattcaaatgaaaggaattttaaaatatctggaaacttacttaaagaagcccctattgatggcaagaacgattcggatagcagcaaaagtcgacacttcaggtgatccatataataacttttcaacatctaaagaaaatataacaaaatgcattaaaatacaaaaattgagatgcattacgaaattgacaagaattgaacataactatattctttgcggtgattctgagaaaaagttataccagtggccagcaaaaccaactattgtagatgacaatgatgcctgtttgggagacaaacactgtcacctgccatttattccaataggcaatgatgaggcaataaaaacagttaactgttatgtagaagtctatgagcaaaaccctggggacatgaattcttatcaaaagaaatgtgatgctatgaatgtcgggacatgcttaaccataaaaaatgagaattggcctatagtacaatgcaagacagggaaatattattatgctgacggccgtatacatgctaaagatggtacaataaatacttactgcttttctgaaaaatgtaatgcagacaggtatccaatacatcaggattatataaattcatgtaattggcaagagacaataaaagacttccaacatgtgagagaatttgtccacctagatatagaatcctataaaaaggcaatagagtcagatattaagacagatttagttgtacataaattcaggccggtgaaaaatcttccgcatgttatcccaatatacaagagtatcacagttcaaggaacagagacatctgatggtatacagaatgcttttatccaaggctcaatgcctgcaattagtggtcttgctaacggctaccatttattcacaccagactccaaacaattatttgatgtcgtactattcctcagaaaggcatcatataaagccgaatatcggaaaatatactcaacagggcctacaattggaataaatgttgaacataatgagaaatgcactggctcttgtccaaagactattgacaaaaaggataattggttgacattctccaaagagcataccagtcaatggggttgtgaagagtacggatgcctagctattaacactggatgtgtctttggttcttgccaggatataatccgacctgagatagatgtgtataaaatgcatggtgcagagagaagtgtggtagaattatgtataacattaccacatgaaacttattgcaatgatttagatgtccttgagccaattattggtgacaaaatacaagcagcatttcaaactgtgcaatcaaaccatatgcctagactaatggctatcaaaaataataaggccttcactggtcaaattaatgatttgggtagcacagctagttactgtgggtcagttcagaagtttaatgagactattatagggcaaggagaccctaaatttgattatgtatgtcatttattgaagcggaaagacattatagttcgaagatgttatagcaacaattatgagtcttgtaagctgctcacacccagagcagatataatagtggacaagaaaggggagtcgcttcaagcaagcatagtcggattaaatctaggccagatgaacttcaaaattatgctgggagatataaactataagcaatacactgagtccaataacttagaagcaacaggacagtgtgtgggatgcgttgattgtagtgaagacatagtctgtaacctcaaaatagaatcgcaatcagagtctgtgtgcaacattaaatcagactgtaatctatatttatcaagtatgctaatccagcccactgtcggtgaatataacctcaaaatgtcatgtaatgcaaaattagacaaggtaaatatagaaatatgtaagcagaaatttgtactacctttaaccataaagtcgcataaccagaagattgacttatctaagctagatgagtctaattatataagagaagaagacctaaagtgtgatactatgatatgcaaggttaaagacgaaggactttcatttataacaaacagcttgtttgggggaatatcatacttttggaaaatactaatttcaagcctaattgtaatatttttaataatactcttctattatgtagggctacccatccttagactcattaaagattatcttaaggaaaatgaattagaatatctggcagaaggaaaatga

SEQ ID NO: 4321 - RNA, 4284 nt, synthetic construct
  misc_feature 1..4284: note = derived and/or modified CDS sequence (wt) from OROV/UTIV(BeAn84785)__KF697155.1__GP
  source 1..4284: mol_type = other RNA
atgtttctaatttttattctcatccaaattgctgcgtcgacgccattgtctccgcaacaagttggtgacagatgctttattggtggctctcttattaaagagataaaccaatctactggactaggagaagtatgtataaaagatgatatatccatcatcaaaagtattaacatccaaaagaaaatttcaaatgatcaggttcaaaatactgtcaaattttacaagacttatattgctagagaatggcatgattgcaacccgatatttgatgaacatggctcatttatggtatttgacatctccaatactggctctataatacctaaaatgcatacatgcagagcccaatgtgaaataacattaaataaagataatgctgaggttatattcacttctgccaaaactaatcattatgaagtttctggaacaacaactgtaaatggttggtttaaacaaactataagcgtttcgttagaacatacttgcgagcatataattgcaagctgcggacaaaaatcattaaaattccatgcatgttttagacagcatcgttcatgcgttagattctttagaaatagttatttaccatataaaatgatagaaagtttatgtataaatatagaattaattattatattatgttacgctttattatgctttatttttgcttacattattacaaagacatatatagcttacttattaattcctttgttctatcctataacatacatatatggaaaaatatataataaatattttaagaggtgtaaatcctgtttgctagctgttcacccattaactaactgcaataaaacatgcgtgtgtggatgccgattcaattcaacagaagcactcaaagtacatagattaggtaaagattgtaatggtttcaaagcattaagtaaagctagattcttatgcaaatctacagggccttcttttactatctgctttttaacaggaatgcttattttaagctttattacgccaattaattctgaaaagttatataaattagaagaacttccagatgattatattaatttagaaaatcaattatctgaatgcaacaataataagcaaataactagagctttagctgttgcttgcatattagggaatattctattcgtattatttttcaaatttatttacaataaactaatcaacaatatatataggacatgcaatctatgtaatatggtccatcatagaaagaatttaaaaatctatagtgaatttactaataaatgcggtacatgtgtatgtggatttaatgaagaaataagaagtgggtttgattatgaagtatttataaaagatatgcatatttttagagataattgcttattcaaattttactcaaaatattcaataatatatatatgcattataatcctagtaattaatcttcaattaggaatgacgttagcggaggagacagagactaattgtttaaatctgccaatttctgctcaaacactggatatagtcaaatgttatggtcttaatttaaatataactgaaaataaacaaaaatctgatttaattagtgagttgaaaagtcaaaaaactataactgatcatgacatacctgattttaatataattgatatgaaaacagagtctgcattcgaaaagatcgaaacagcagaaaatatacacagaatggcatttttagaatatatattatataaaatggaatctaaattaaatactattaagactaattcaggaccatataatgtagcatggcgaacatatattaaataccacaacttagatgcatgtggaaaatacccacataagactatatgcacatgtataaatgctcatttgtcttgtagtcagccaacagttgattctaacagcgaaattaagacattttattctaatcatcagtcagcttttaaaaatgatataaatgtgctaattgaaacaatctcaattgcttttagaggaattattaaggtttctataaatttactattaaagaataacaaaatagatgagctcaaggaattgttgaccaacatatcaaaaaaattagacacaaatattcaaatgaaagggattttattgtttacagcagagcagttgaagacacaagagacaactgttaaatctatgcagcaaacaagaatggccataatagtcaaacctttagaatctatgacaggagataaatttgacaattttagtacaaccaatagaaacataacaaaatgcaaagaagctaaatcattaagctgttatatgaccaggaaaaattctataaataaatatctactttgtaacttagatggttataaaatattttcttggccagaaaaacctacactcagtataaacaataatatttgtattggtgactcgcattgtaatttatattttaaaccaatcttaaatgatgaagctataaaaactattaactgctataaaggtgatttcactcctaatccaatggatatgggatctgcaatcaaaaaatgtgaggccaaggagattggcgattgtttagtaggtgataataacatgtggcctattatacaatgcagtaatgaaaagtattattacgctgatgggaagaatcatgccaaagagggagatataaattcatattgtttatcagaaaaatgcaatactgataggtttccaattcataatgaatggtttaaaagttgcaaatggataagtactattaaagagtccatttctgttaaagaatttgttcatttagatatagaatcatataaaaagggcattgagtcagatattagaacagatttaattatacataaattcagacctgtaaaaaacttaccacatatagctccaaagtataaatccataactataagtggtatattagttgcagatggaatacaaaatgcttttgtatctggcgaaatgcctgcaataagtggattgggaataggttataatttgtattcacctgatgggacaaaattgttcgatatagtattgtttttgagaaaggcaatatacaaatcatcatataaattaatttataaaacaggtccaacaataggaattaatgtagaacataatgagcagtgcactggctcatgcccatcaacaattcctaaacaagaaggttggttgaccttttcaaaagaacacacaagccaatggggctgtgaagaatttggatgtttagctatagatactggatgtttatatggttcatgtcaagacattataagaccagaaatgtctatctataaaatgttaggtgaagaaatgacatcaatagaaatatgcttaactactcctaaagaaacatactgtaatgacttagacttgcttgaaccattaattggtgacaaaattgaagttagtttccaaactgtacaatccagtcatatgccaaaaattattgcagttaaaaataataaggtttatactggacaaatcaatgatatagggaatacagcaaatatttgtggatctgtacaaataataaataaaactgttattggtcaaggaaatcctaaatttgactacttatgtcacgcaatgaaaaggaaggatgttatagttaggaaatgttatgataaccattttgagacttgcaaattgttggaagaaagaagtgaaatattgataaatcaacaatcagacacaatagcagcaagtatgagtggaaaaaatttgggaattatgaactttaaatttgcactaggtgatattgattataaaacatttacggaagatgcaagttttgatattaaaggccagtgtgttgggtgtataaattgcatagaagaaattgtatgtgaattaaatattgtaagcacatcatctatattatgtacaattaaaacaccatgtgaaaactaccataattcattagaaattaacccagcaactactaaatatcatattaaaatgtcttgccctcataatatcgacaagatgaaaatcacaatttgttctaaagacttagaaatgccattgacattaaaacagcatgatcaaaaaatagatctatctaaattagatgaatctaattatataaaggaagaagatttaaggtgcagtacatggctttgcaaagttaaagaagaagggataggattcatattttctggtatttttggaaattttggaaaatactggacaatcttcttgattgttttagtaattctggcaactgggctattgggtatatttgtaatttatccatgctgtaaaagattaagaggattcttagaaattaatgatatagcttatttggctgaacaaaaaatgaaataa

SEQ ID NO: 4322 - RNA, 3231 nt, synthetic construct
  misc_feature 1..3231: note = derived and/or modified CDS sequence (wt) from HRTV(TN)__KJ740147.1__GP
  source 1..3231: mol_type = other RNA
atgattgtcccgattgtcctgtttctcacgctctgtccgtccgaactcagtgcctggggctctccaggagaccctattgtttgtggtgtgaggactgaaacaaacaaatccattcagattgaatggaaggagggaagatcagagaagctatgccagattgacaggcttggacatgtcacaagctggttaagaaaccactcatcttttcaggggcttgttggtcaggtgaagggaagaccaagtgtttcctacttcccggaaggggcttcttacccaaggtggagcggtctattaagcccatgtgatgctgaatggctgggaatgatagcagtgagcaaggctggagacacagacatgattgtcccagggccaacttacaaaggcaaaatctttgttgagagaccaacatacaacggatacaaaggctgggggtgtgcagatgggaagtcactaagccactcaggcacatattgtgaaactgacagctcagtgagttctggtttaattcagggagatagggttctctgggttggggaagtggtctgtcagagagggacccctgtgccagaagatgtatttagtgaactggttagcttgagtcaaagtgagttcccagatgtgtgcaagattgatggtgttgcactgaaccagtgtgagcaggagagcatcccccagccactggacgttgcatggattgatgttggaaggtctcataaggtactgatgagagaacacaaaactaaatgggtccaagagagctcagcaaaggactttgtgtgcttcaaggtgggtcaggggccatgttcaaaacaagaggaagatgactgcatgagtaagggcaactgccatggggatgaggtcttctgcaggatggcaggatgctctgcccgtatgcaagataatcaagaaggctgtaggtgcgaactgcttcagaaacctggagaaatcattgtgaattatggaggcgtctctgtgagaccaacctgttatggattctccagaatgatggcaacattggaagttcacaaacctgatagagaattaacagggtgcacgggttgtcacctagagtgcatagagggaggagttaaaattgtaacgcttacaagcgagctgagaagtgcaacagtctgtgcttcacatttttgtgcatctgcaaaggggggctcaaagacaactgacatactcttccacactggtgctctcgttggacccaattccatcagaataactggtcagttgttagatgggagcaagttctccttcgatgggcactgcatattcccagatgggtgcatggcacttgactgcaccttctgtaaggagttcttaagaaacccacaatgttacccagtaaagaaatggctcttcctggtggtagttataatgtgctgctattgcgccctgatgctgcttactaacatactgagagctataggtgtttgggggacatgggtttttgctccaataaagttggctctagcattagggttgaggcttgccaaactgtcaaagaaggggttggttgctgtggttacaaggggccaaatgatcgtgaatgatgagctgcaccagattcgagtggagagaggtgagcaaaatgagggaagacaaggttatggcccaagaggccccatccgtcactggctatactcacctgccctcatcctcattctcaccacttcaatttgctctggatgtgatgagcttgttcatgctgagagtaaatctatcacatgcaagtctgcatctgggaatgagaaggagtgctcagtgacaggcagagctttgctcccagctgtcaatccagggcaggaagcctgcttgcacttcagcatgccaggaagcccagactctaagtgcctcaagatcaaagtgaaatcaataaatctcagatgtaagcaagcctcttcatattatgttcctgaagcaaaggcaaggtgtacatctgtcagaaggtgcaggtgggcaggtgactgtcaatctgggtgtccaacatatttcagctcaaactcattctcagatgattgggcaaacaggatggacagggctgggctcgggatgagtgggtgctcagatgggtgtggtggagctgcatgtgggtgtttcaatgcagcgccatcctgcatcttttggagaaagtgggtggagaacccatccaatcgtgtctggaaggtgtcaccttgtgcatcatgggtgctagctgcaaccattgagttgactttgccatcaggagaggttaagactctagagcctgtcacagggcaagcaactcagatgttcaagggtgttgcaatcacatatctgggatcatccattgagattgttggcatgaccaggctatgtgagatgaaagagatgggaactgggataatggcactagccccctgcaatgatccagggcacgccataatgggaaatgtgggtgagatccaatgcagtagtatagaaagcgcaaagcacatcagatctgatgggtgcatttggaatgctgacctagttgggatagaattgagggttgatgatgctgtgtgtttctcgaaactcactagtgttgaggcagttgcgaatttttcaaaaatcccggcaacaatttctggggttcgctttgatcaagggaatcatggagaatcacgtatctatggtagcccattagatatcacgagggttagtggggaattctcagtgtcattcagagggatgaggctcaaactatctgagatatcagcaagctgcacaggtgagataacaaacgtctccggttgttactcctgcatgactggggcctcagtcagcataaaattacatagcagtaagaacacaacaggtcatcttaagtgtgattcagatgagactgcattcagtgtcatggaggggacacacacatataggcctcacatgagctttgataaagcagtaatagatgaggagtgtgtgctaaactgtggtggccactcatcaaaactgttgcttaaagggagccttgttttcatggacgtgccaaggtttgttgatgggagttatgtccaaacatatcacagcaaggtgcctgctgggggaagggtcccaaatccagtagactggctcaatgcactgtttggagatggcataacacgatggattcttgggattataggggttctgctggcatgtgtcatgctatttgtggtggtggttgccatcactaggcgattgatcaagggactgactcaaagggcgaaggtggcatga

SEQ ID NO: 4323 - RNA, 3231 nt, synthetic construct
  misc_feature 1..3231: note = derived and/or modified CDS sequence (wt) from HRTV(Patient2)__JX005844.1__GP
  source 1..3231: mol_type = other RNA
atgattgtcccgattgtcctgtttctcacgctctgtccgtccgaactcagtgcctggggctccccaggagaccctattgtttgtggtgtgaggactgaaacaaacaaatccattcagattgagtggaaggagggaagatcagagaagctatgccagattgacaggcttgggcatgtcacaagctggttaagaaaccactcatctttccaggggcttattggtcaggtgaaggggagaccaagtgtttcctacttcccggaaggggcttcttacccaaggtggagcggcctattaagcccatgtgatgctgaatggctgggactgatagcagtgagcaaggctggagacacagacatgattgtcccaggcccaacttacaaagggaaaatctttgttgagagaccaacatacaacggttacaaaggctggggttgtgcagatggaaagtcactaagccactcaggcacatattgtgaaactgacagctcagtgagttctggtttaattcagggagatagggttctctgggttggggaagtagtctgtcagagagggacccctgtgccagaagatgtatttagtgaactggttagcttgagtcaaagtgagttcccagatgtgtgcaagattgatggtgttgcactgaaccagtgtgagcaggagagcatcccccagccactggacgttgcatggattgatgttggaaggtctcataaggtactgatgagagaacacaaaactaaatgggtccaagagagctcagcaaaggactttgtgtgtttcaaggtgggtcaggggccatgttcgaaacaagaggaagatgactgcatgagtaagggcaactgccatggggatgaggttttctgcaggatggcaggatgctctgcccgtatgcaagataatcaagaaggctgcaggtgcgaactgcttcaaaaacctggagaaatcattgtgaattatggaggcgtctctgtgagaccaacctgttatggattctccagaatgatggcaacattggaagttcacaaacctgatagagaattaacagggtgcacgggttgtcacctagagtgcatagagggaggagttaaaattgtaacgcttacaagcgagctgagaagtgcaacagtttgtgcttcacatttttgtgcatctgcaaaggggggctcaaagacaactgacatactcttccacactggtgctctcgttggacccaattccattagaataactggtcagttgttagatgggagcaagttctcctttgatgggcactgcatattcccagatgggtgcatggctcttgactgcaccttctgtaaagagttcctgagaaacccgcaatgttaccctgtaaagaaatggctcttcctggtggtagttataatgtgctgctattgtgccctgatgctgcttactaacatactgagagctataggtgtttgggggacatgggtttttgctccaataaagttggctctagcattagggttgaggcttgccaaactgtcaaagaaggggctggttgctgtggttacaaggggccaaatgatcgtgaatgatgagctgcaccaggttcgagtggagagaggtgagcaaaatgagggaagacaaggttatggcccaagaggccccatccgtcactggctatactcacctgccctcattctcattctcaccacttcaatttgctctggatgtgatgagcttgttcatgctgagagtaaatccatcacatgcaagtctgcatctgggaatgagaaggagtgctcagtgacaggcagagctttgctcccagctgtcaatccagggcaggaggcctgcttgcactttagcgtgccaggaagcccagactccaagtgccttaagatcaaagtgaaatcaataaatctcagatgtaagcaagcctcttcatattatgttcctgaagcaaaggcaagatgtacatctgtcagaaggtgcaggtgggcaggtgactgtcaatctgggtgtccaacatatttcagctcaaactcattctcagatgattgggcaaacaggatggacagggctgggctcgggatgagtgggtgctcagatgggtgtggtggagctgcatgtgggtgttttaatgcagcgccatcctgcatcttttggagaaagtgggtggagaacccatccaatcgtgtctggaaggtgtcaccttgtgcatcatgggtgctagctgcaaccattgagttgactttgccatcaggagaggttaagactctagagcctgtcacagggcaagcaactcagatgttcaagggtgttgcaatcacatatctgggatcatccattgagattgttggcatgaccaggctatgtgagatgaaagagatggggactgggataatggcactggccccctgcaatgatccagggcacgccataatgggaaatgtgggtgagatccaatgcagtagtatagaaagcgcaaagcacatcaggtctgatgggtgcatttggaatgctgacctagttggaatagaattgagggttgatgatgctgtgtgtttctcgaaactcactagtgttgaggcagttgcaaatttttcaaaaatcccggcaacaatttctggggttcgctttgatcaagggaatcatggagaatcacgtatctatggtagcccattagatatcacgagggttagtggggaattctcagtgtcattcagagggatgaggctcaaactatctgagatatcagcaagctgcacaggtgagataacaaacgtctctggttgttactcctgcatgactggggcctcagtcagcataaaattacatagcagtaagaacacaacaggtcatcttaagtgtgattcagatgagactgcattcagtgtcatggagggaacacacacatataggcctcacatgagctttgataaagcagtaatagatgaggagtgtgtgctaaactgtggtggccactcatcaaaactgttgcttaaagggagccttgtttttatggacgtgccaaggtttgttgatggaagttatgtccaaacatatcacagcaaggtgcccgctgggggaagggtcccaaatccggtagactggctcaacgcactgtttggagatggcataacacgatggattcttgggattataggggttctgctggcatgtgtcatgctatttgtggtggtggttgccatcactaggcgattgatcaagggactgactcaaagggcgaaggtggcatga

SEQ ID NO: 4324 - RNA, 3231 nt, synthetic construct
  misc_feature 1..3231: note = derived and/or modified CDS sequence (wt) from HRTV(Patient1)__JX005845.1__GP
  source 1..3231: mol_type = other RNA
atgattgccccagttgtcctgtttttcactctctgtccgtcccaactcagcgcctggggctctccaggagaccccattgtttgtggtgtgaggaccgaaacaaacaaatccattcagattgagtggaaggaggggagatcagagaaattatgccagattgacagacttggacatgtcacaagctggttaagaaatcactcatctttccaggggcttattggtcaggtgaaggggaggccaagtgtttcctacttcccggaaggagcttcttaccctaggtggagcgggctattaagcccatgtgatgctgaatggctgggactaatagcagtgagcaaggctggggatacagacatgattgtcccaggcccaacttacaaaggcaaaatctttgttgagagaccaacgtacaatggttataaaggctgggggtgtgcagatgggaagtcactaagccactctggcacatattgtgaaactgacagctcagtaagttctgggttaattcagggtgatagggttctctgggttggggaagtagtctgtcagagagggacacctgtgccagaagatgtatttagtgaactgattagcttgagtcaaagtgagttcccagatgtgtgcaaggttgatggggttgcactgaaccaatgtgagcaggagagcatcccccagccactggacgttgcatggattgatgttggaaggtctcataaagtgctgatgagagaacacaaaactaaatgggtccaagagagctcagcaaaggactttgtgtgcttcaaggtgggtcaggggccatgttcaaaacaagaggaagatgactgcatgagtaagggcaactgccatggggatgaggttttctgcaggatggcaggatgctctgcccgtatgcaagataatcaagaaggctgtaggtgcgaactgctccaaaaacctggagaaatcattgtgaattatggaggcgtctctgtaagaccaacttgttatggattctctagaatgatggcaacattggaagttcacaagcctgatagagaattaacagggtgcacgggttgtcacctagagtgcatagagggaggggtcaaaattgtaacacttacaagcgagctgagaagtgcaacagtttgtgcttcacatttttgtgcatccgcaaaagggggctcaaagacaactgacatactcttccacactggtgctctcgttggacccaaatccattagaattacgggccagttgttagatgggagcaagttctcctttgatgggcactgcatattcccagatgggtgcatggcacttgactgcaccttctgtaaggagttcctgagaaacccacaatgttacccagtaaagaaatggctcttcttggtggtagttgtgatgtgctgctattgcgcactgatgctgcttactaacatactgagagctataggtgtttggggaacatgggtttttgctccaataaagttagttctagcattaggattgaggcttgccaaactatcaaagaaggggttggttgctgtggttacaaggggccaaatgatcgtgaatgatgagctgcaccagattcgagtggagagaggtgagcaaaatgagggaagactaggtcatggcccaagaggtcccgtccgtcactggctatactcacctgccctcattctcattctgaccacttcaatttgctctggatgtgatgagctcgttcatgctgagagtaaatctatcacatgcaagtctgcatctgggaatgagaaggagtgctcagtgacaggcagagctttactcccagctgttaatccaggacaggaggcctgcttgcacttcagtatgccagggagcccagactctaagtgcctcaagatcaaagtgaaatcaataaatctcagatgcaagcaagcctcttcatattatgttcctgaagcaaaggcaagatgtacatctgtaagaaggtgcaggtgggcaggtgactgtcaatctgggtgtccaacatatttcagctcaaactcattctcagatgactgggcaaacaggatggacagggctgggctcgggatgagtgggtgctcagatgggtgtggtggggctgcatgtgggtgtttcaatgcagcgccatcctgcatcttttggagaaagtgggtggagaacccatccaatcgtgtctggaaggtgtcaccttgtgcatcatgggtgctagctgcaatcattgagttgactttgccatcaggagaggttaagactctagagcctgtcacagggcaagcaactcaaatgtttaagggtgttgcaatcacgtatctgggttcatccattgagattgttggcatgaccaggctatgcgagatgaaagagatgggaactgggattatggcactagccccctgcaatgaccctgggcacgccataatgggaaatgtgggtgagatccaatgcagtagtatagaaagcgcaaagcacatcagatctgatgggtgcatttggaatgctgacctagttgggatagaattaagggttgatgatgctgtgtgtttctcaaaactcaccagtgttgaggcagtcgcaaatttctcaaaaatcccggcaataatttctggggtccgttttgatcaagggaatcatggagaatcgcgaatctatggtagcccattagacatcacgaaggttagtggggaattctcagtgtcattcagggggatgaggcttaaactgtctgagatatcagcaagctgcacaggtgagataacaaacgtctctggttgctactcctgcatgactggggcctctgtcagcataaagctacatagcagtaagaacacaacaggtcatcttaaatgtgattcagatgagactgcattcagtgtcatggagggaacacacacttataggcctcacatgagctttgataaagcagtggtagatgaggagtgtgtgctaaactgtggtggccattcatcaaagctgttgcttaaggggagccttgtcttcatggacgtgccaaggtttgttgatgggagttatgttcaaacataccatagcaaggtgcctgctgggggaagggtcccaaatccagtagattggctcaacgcgctgtttggagatggcataacacgatggattcttgggattataggagttctgttggcatgtgtcttgctatttgtggtggtggtggccatcactaggcgattgatcaaggggctgactcaaagggcgaaggtggcatga

SEQ ID NO: 4325 - RNA, 3942 nt, synthetic construct
  misc_feature 1..3942: note = derived and/or modified CDS sequence (wt) from PTV(PAN472868)__NC_027201.1__GP
  source 1..3942: mol_type = other RNA
atgatttttacaattttaaatgttttaacaagagccatgctcgtaatgagcatgtattctttaactacgtgggatagcaccagcagaaatgacatgtgcttttctaatgactcacctctagaaggcctagtttactactgggagacacactcaaaaaaacatgactataagaagcaagagtctcagagatgcagagttggagattcagataaaaaaatgataactaatgtcacaataatctctctgatttctgaaatacaaaaaagtatctctgagttgtcactatcatgtggtaatgatgacaattctactggacaagtcttaacattcaatggattggaagacacaatacaaggtgattatattgtagactgcgtgactggcttgtatcagtcagatatcggagtcggtgtggggttagggaagactcaccatgatcatcagcaagtgaaaaacaaagcagttgtgatagatgaaaaagaaagaatgatatcattcctagagactcaacaaagcgagaacgacataaagatgcaagtactaatgtctgaaattgaacaactgaagaatcaactgtcaaagaagcggaatgagagaggccaggagaaaagagatgctgagaaggtgatgtcagacttgatggccaggaattctgatttacggaagcataatgatattctcactgctgagatatctcagatggaaaataataacacaatccaaagaaacaaaaatgtaatgagtactactgtagtcccagcaatactttcagtggccttactgtcatcatcaattgctcccattatggctgcatctccagattcaccgatgattaatccatggcctcatgcaaaaaacagggttggcacaggaatgtacaaatatgatgaaaatgatgactcaggctgcagaccaatcagatatggggtttcatgcataggatttgactttatgcttaaaatggacaaatatcctttctttaatgcatttataggccataaaactcccttagaatcctttgctgataaaataattgagaaagaggaagaaacatgtgagataggaacaaacaaagagtttaaatgtttcgaagagagagcttacataaaggggacatgcccaactaacatcaatgcagttcactacattgacaataaaggtaaattgcgatatgtaaaatgcaaggaaaatctggaaatgactgaggattgtgctttctgtaggaaaatcaagaagaaagctggtcagtctattcaggtgcagaaaacttcagtcccacttcaagatgcaatttgtcaagaaaattctgatacttattctggaccaaaaataccctttaaaggggtttgtaagattggtctaattaaatataaagagtgcaagtttaaaacatcttcttatgaaactgtctcattcatcacactcaaagagaaggggaaaatttacattgagcacctgatgttgaaaaatatagaggtggttacaaatgtctcttttgtttgctacgaacatgcaggtcaggatgagcaagaggtagaacacagggctctgaagagagtatcagttaatgattgtaagattgtggacaactctaaacagaaaatttgcacaggagatcacattttctgtgaaaagtatgattgttctacatcttatccagatgttacttgtatccatgcgccaggatcaggaccattgtacataaatctcatgggctcatggataaaaccccaatgtgtgggctacgagagagtcttagtagatagagaagtcaagcagccattgctggcaccagaacagaactgtgacacctgtgtttcagagtgtctagatgagggggtccatataaagtccaccggttttgagataacatcagcagtagcctgctctcatggatcttgcatctcagctcatcaagaagcgtccacatcagtaattgtcccatatccaggattgttggccagtgtgggcggaagaattgggattcacctctcgcacacttctgattctgctagtgtgcacatggtagtggtttgccctcccagagacagttgtgcagctcataattgcctgctatgctatcatggtatcctgaattatcagtgccattcaacattaagtgctatcctgacttcctttctattaattctcttcatatacactgttttttctgtcacgacaaatatgttatatgtgctcagactaatacctaaacagctaaagagtccagttggatggctcagactcttcattaactggctattaactgctttaagaatcaaaactaggaatgttatggggaggataaaccagaggataggatgggttgaccatcatgatgtagagaggccaaggcacagagaacctatgaggagattcaaaacaactctattgttgactctgataatgatgactggaggaaatgcttgctctaatacagtagtagccaattcaaagcaaaccagatgtgtgcaggaaggatcaagcacaaagtgttcaatcactgcaacgataactttaagggcaggtgtgattggtgcagagtcatgttttatcataaaaggccctatggaaaatcagcagaaaacaatatcaatcaaaaccatctctagtgaaacagtatgcagggagggatcaagcttctggactagtttatatatcccatcctgtcttagttctaggaggtgccatcttgttggtgattgtgtaggcaataaatgccagtcgtggagagatgatcaactatctagggaattttcaggagtaaaggataaccatattatgaacgaaaataaatgctttgaacagtgtggcgcaattggttgtggttgctttaacattaatccttcctgcttgtatgttcatgcttacctcaagagtgctagaaatgaagcagttagggttttctcatgttctgattgggtacacagagtttcttttgaggtaaaaggtcctgatggtgaaacagagctggtcacattgggaagcctaggcactaagtttttaaactggggtaccctgtctttatccctggatgcagaaggcatcagcggaaccaacagcatcagctttctggaaagtagtaaaggaggatttgccttatatgatgaaggctacagtgagataccaagagagggatttcttggtgagataaggtgtagttctgaatccgcagctatatcagctcacaagtcttgtattagagctcctggtttaatcaagtacaagcccatgacagatcaaatagaatgtactgcatctttagtggatccattcgcaattttccttaagggatctcttcctcagactagaaatgggcaaacattcaccagcacaaaagacaagaagacagtccaggctttcactaatggagcgataaaagcactattgtctattaatttagatgatcatgaaattgtctttattaacaaagtgagaagctgtgatgcaacatttctaaatgttagtggttgctactcctgtgattatggagctcatgtctgtgtgaaagtcaaatcttcagagtcagctgatttctttgcagaatcagaagacaagacaacagttttatctttcccaatacagtctggcacccatgattactgtcaggttttacattttcaaaaaccattagtagatgaaagactatcatattcttgtggatctgagcctaagctgatagtgatcaagggaacactggtctacatgggtgtctatgatttcagaaacaaaacaggtggttcttcaacagtagtaaatccttcagaaggtgcctggagcatttcaaattggttttctggccttctagactggttaggtgggcctatgaaggccatactaaagattctgggctttattgccattgggattgtctgctttattttattcatgattctgatcagaattgcagtcaactcgataaacatcaagaagaaaaactag

SEQ ID NO: 4326 - RNA, 3942 nt, synthetic construct
  misc_feature 1..3942: note = derived and/or modified CDS sequence (wt) from PTV(Adames)__KR912209.1__GP
  source 1..3942: mol_type = other RNA
atgatttttacaattttaaatgttttaacaagagccatgctcgttatgagcatgtactctttaacaacgtgggacagctccagtaggaatgacatatgtttttctaacgactcacctctagagggccttgtctactactgggagacacactcaaaaaaacatgactataagaaacaaggttctcagaagtgtagagttggagattctgataaaaagatgatttctaatgttacaataatctctctaatttctgaaatacaaaaaagcatctctgagctatcactgtcatgtggtaataatgacaattctactggacaagtcttgacattcaatggattagaagatacaatacgaggcgactacattgtggactgtgtgactggattataccagtcagacattggagtcggtgtagggctggggagaatcaaccatgatcatcagcaagtaaaaaataaagcagttgttatagatgagaaagaaaaaatgatatcacttctagagactcaacaaagtgagaatgacataaagacacaagtactgatgtctgaaattgaacaactgaagaatcaactatcaaaaagacgaaatgagaggggacaggagaagagagatgctgaaaagctgatgtcagacctgatggctagaaattctgacttacggaatcacaatgttattctaactgacgaaatatctcaaataaaaaataatatcacaattcacagaaacagaaacatgatgagtactactgtggtcccagcaatactttcggtggctctgctatcatcatcagttggtcccattacggctgcacctccagattcaactatgatcaatccatggcctcatgcaaaaaatagagttggcacaggaatgtacaaatatgatgaaaatgatgagtcagggtgtagaccaatcagatatggtgtttcctgcataggatttgatttcatgcttaagatggataagtatcctttctttaatgcatttataggtcataaaactcctttagaatccttcgcagataaaataattgagaaagaagaagagacatgtgaaataggaacaaacaaagagtttaaatgttttgaggagagagcttacataaaggggacatgtccgaccaacatcaatgcagttcattacattgacaataaaggcaagttgcgatatgtaaaatgcaaagagaatctggaaatgactgaagactgtgctttctgcaggaaaatcaagaagaaagctggtcagtctgttcaggtgcagaaaacttcagtaccgttacaagatgcaatttgtcaagagaactcagacatttactccggaccaaagatacctttcaagggagtttgtaagatcggtctaataaagtataaagagtgtaagtttaaaacatcatcttatgagaccatttcattcatcacactcaaagggaaaggaaaaatttacattgagcacttgatgttaaaaaacatagaggtggtcacaaatgtttcttttgtttgctatgaacatgcaggtcaagatgaacaagaggtagaacacagggccctgaagagagtatcagtcaatgattgtaagattgtggacaactctaagcagaagatttgcacaggagaccacattttctgtgagaagtatgactgttctacatcttatccagatgtgacttgtatccacacaccaggatcagggccattatacataaatctcatgggctcatggataaaaccccaatgtgttggctacgagagagtcttagtagatagggaggttaagcagccattgcttgtaccagagcagaactgtgacacctgtgtttcagagtgtctagatgaaggagtacacataaaatccactggttttgaaataacatcagcagtggcctgctcacatggatcctgtatctcagctcatcaggaagcatccacatcagtaattattccatatccaggcttgttggctagtgtgggcgggagaattgggatacacctctcacatacttctgattctgctagtgtacacatggtagtggtttgccctcccagagatagttgtgcagctcataattgcttactatgctatcatggcattctgaactatcagtgccattcaacactgagtgctatcctgacttcctttctactaattcttttcatatacactgctttttctgtgacaacaaatgttttgtatgtgctcagactaataccgaaacagctgaaaagtccagtgggatggctcaaactctttgtcaactggctactaactgctctaagaatcaaaactaggcgagtaatggggaggataaatcagagaatagggtgggttgatcatcatgatgtagagagaccaaggcacagagaacctatgaggagattcaagacaactctattgctaactctgataatggtgacaggaggaaatgcctgctccaatacagtagtggccaattcgaagcaaaccagatgtgtccaagaaggatcaaacacaaagtgttctattactgcaactataactttaagggcaggtgtgattggtgctgagtcatgtttcataataaaaggccccatggaaaaccagcagaaaacaatatcaattaaaaccatctctagtgagacagtatgcagagaaggttcgagtttctggaccagtttgtacatcccatcttgtcttagttctaggagatgtcatcttgttggtgattgtgtgggtaacaaatgccagtcatggcgagatgatcagctatccagggagttttcaggagtaaaggataaccatattatgaatgaaaataaatgctttgaacaatgtggtgcaattggctgtggttgtttcaacatcaatccttcctgcttgtatgtccatgcttatctcaagagtgctagaaatgaagcagtcagggtattctcatgttctgactgggtgcacagagtttcctttgaggtcaaaggccctgatggcgagatggagttggtcacactagggagcctgggcactaagtttttaaactggggcactttgtcattatccttggatgcagaaggtatcagcggaaccaacagtatcagttttttggaaagtagtaaaggagggtttgctctgtacgatgaaggatatagtgaaataccaagagaaggatttcttggagagataaggtgcagttctgaatccgcagccatatcagctcataagtcatgcattagagctcctggtttgatcaagtacaagcccatgacagatcaaatagaatgtactgcatctttagtagatccatttgcaattttcctcaaaggatctcttcctcagactaggaatggacagacattcaccagtacaaaagacaaaaaaacagtacaggccttcaccaatggagcaataaaagcattattgtcgattaatttagatgatcatgaaatcatctttattaataaagtgaaaagctgtgatgccacatttttaaatgttagtggatgctactcttgtgattatggagcacatgtctgtgtgaaagtaaagtcttcggagtcagccgacttctttgcagaatcggaggacaaaacaacagtcctgtcttttccaatacaatctggcacacgtgactactgtcaggttttacattttcaaaagccattagtagatgaaagactttcatattcttgtggatctgagcctaagctgatagtgattaagggaacattagtttacatgggtgtctatgattttagggataaaacaggtggttcttcaacagtgataaatccttcagaaggaacctggagcatctccaattggttttctgggcttctggactggctaggtgggcctatgaaggccatactgaagatactgggcttcattgctattgggattgtttgcttcattttgttcatgattctgattagaattgcagtcaactcaataaatatcaagaagaaaaactaa

SEQ ID NO: 4327 - RNA, 3942 nt, synthetic construct
  misc_feature 1..3942: note = derived and/or modified CDS sequence (wt) from PTV(Balliet)__KR912213.1__GP
  source 1..3942: mol_type = other RNA
atgatttttacaattttaaatgttttaacaagagccatgctcgtaatgagcatgtattctttaactacgtgggacagcaccagcagaaatgacatgtgcttttctaatgactcacctctagaaggcctagtttactactgggagacacactcaaaaaagcatgactataagaagcaagagtctcagagatgcagagttggagattcagacaaaaaaatgataactaatgtcacaataatctctctgatttctgaaatacaaaaaagcatctctgagttgtcactatcatgtggcaatgatgacaattctactggacaagtcttaacattcaatggattagaagacacaatacgaggtgattacattgtagactgcgtgactggcttgtatcagtcagatattggagtcggtgtggggctagggaggactcaccatggtcatcagcaaatgaaaaacaaagcagttgtaatagatgagaaagaaaggatgatatcactcctagagactcaacaaagtgagaatgacataaagatgcaagtactaatgtctgaaattgaacaactgaagaatcaactgtcaaagaagcgaaatgagagaggccaggagaaaagagatgctgagaaggtgatgtcagacttgatggccaggaattctgacttacggaagcataatgacattctcactgctgaaatatctcagatgaaaaataaaaacacaatccaaagaaataaaaatacagtgagtactactgtagtcccagcaatactatcagtggccttactgtcatcatcagttgctcccattatagctgcacctccagattcaccgatgattaatccatggcctcatgcaaaaaatagagttggcacaggaatgtacaaatatgatgaaaatgatgactcaggctgtagaccaataagatatggagtttcatgcataggatttgactttatgctcaagatggacaaataccctttctttaatgcattcataggtcacaaaactcccttagaatcttttgctgataaaataattgagaaagaagaagaaacatgtgagataggaacaaacaaagagtttaaatgtttcgaggagagagcttatataaaggggacatgtccgaccaacatcaatgcagtccattacattgacaataaaggcaaattgcgatatgtaaaatgtaaggaaaatctggaaatgactgaggattgtgctttctgtaggaaaatcaagaagaaagctggtcagtctgttcaggtgcagaaaacttcagttccactccaggatgcaatttgtcaagaaaattcagacacttattctggaccaaagataccctttaaaggggtttgcaaaattggtctaatcaaatataaagaatgcaagtttaaaacatcttcttatgagactgtctcattcataacactcaaggagaaggggaagatttacattgagcacctaatgttgaaaaatatagaggtggttacgaatgtctcttttgtttgctacgaacatgtagggcaggatgagcaagaggtggaacatagggctctgaagagagtatcagttaatgattgtaagattgtggacaactcaaagcagaaaatttgcacaggagatcacgttttctgtgaaaagtatgattgttccacatcctatccagatgttacttgtatccatgcgccaggatcaggaccactgtacataaatctcatgggctcatggataaaaccccaatgtgtgggctatgagagagtcttagtagacagggaagtcaagcagccattgcttgcaccagaacagaactgtgacacctgtgtttcagagtgtctagatgagggggtccatataaagtccactggttttgagataacatcagcagtagcctgctcacatgggtcttgcatctcagctcatcaagagccatccacatcagtaattgtcccatacccaggattgttggccagtgtgggcggaagaattgggattcacctctcacatacttctgattctgctagtgtgcacatggtagtggtttgccctcctagagacagttgtgcagctcataattgcttgctatgctatcatggcatcctaaattatcagtgccattcaacattaagtgccatcctgacttcctttctattaattctcttcatatacactgtcttttctgtgacgacaaatatattatatgtgctcagactaataccaaaacagctaaagagtccagtgggatggctcaagctcttcatcaactggctgctaactgctctaagaatcaaaactagaaatgttatgaggaggataaaccagagaataggatgggttgaccatcatgatgtagagagaccaaggcacagagaacctatgagaagattcaaaacaactctattgttgactctgataatgatgactggaggaaatgcttgctccaatacagtagtggctaactcaaagcaaaccagatgtgtacaggaaggatcaaacacaaagtgctcaatcactgcaactataactttaagggcaggtgtgattggtgcagagtcgtgctttataataaaaggccctatggagaatcagcagaaaacaatatcaatcaaaactatctccagtgagacagtatgcagagagggatcaagcttctggactagtttatatatcccatcatgtcttagctctaggaggtgtcatcttgttggtgattgtgtaggcaataaatgccagtcgtggagagatgatcagctatctagggaattttcaggagtaaaggataaccatatcatgaacgaaaataaatgctttgaacaatgtggcgcaattggttgtggttgttttaacattaatccttcctgcttgtacgttcatgcttacctcaaaagtgctagaaatgaagcagttagggttttctcatgttctgattgggtgcacagagtttcttttgaggtaaaaggtcctgatggtgaaacagagctggtcacattgggaagtctaggcaccaagtttttaaactggggcaccctgtcattatccctggatgcagaaggcatcagcggaaccaacagcatcagctttctggaaagtagtaaaggaggatttgccttatacgatgaaggctacaatgagataccaagagagggatttctaggtgagataaggtgtagttctgaatccgcagctatatcagctcataagtcttgtattagagctcctggtttaatcaagtacaagcctatgacagatcaaatagaatgtactgcatctttagtggatccattcgcaattttccttaaaggatctcttcctcagactagaaatggacaaacattcaccagcacaaaagacaagaagacagttcaggctttcactaatggagcgataaaagcgctattgtctattaatttagatgatcatgaaattgtctttattaacaaagtgaaaaactgtgatgcaacatttctaaatgttagtggttgctactcctgtgattatggagctcatgtctgtgtgaaagttaaatcttcagagtcagctgatttctttgcagaatcagaagacaagacaacagttttatctttcccaatacagtctggcacccatgattactgtcaggttttacattttcaaaaaccattagtagatgaaagactatcatattcttgtggatcagagcctaagctgatagtgatcaagggaacattggtttacatgggtgtctatgatttcagaaacaaaacaggtggctcttcaacagtagtaaacccttcagaaggtgcctggagcatttcaaattggttttctggccttctagactggttaggtgggcctatgaaggccatactaaagattttgggctttattgccattgggattgtctgctttgttttattcatgattctgatcagaattgcagtcaactcaataaatatcaagaagaaaaactag

SEQ ID NO: 4328 - RNA, 3942 nt, synthetic construct
  misc_feature 1..3942: note = derived and/or modified CDS sequence (wt) from PTV(PaAR2381)__KP272005.1__GP
  source 1..3942: mol_type = other RNA
atgatttttacaattttgaatattttaacaagagccatgctcgtgatgagcatgtattctttaacaacatgggatagcaccagcagaaatgacatgtgcttctctaatgactcacctctagaaggcctagtttactactgggagacacactcaaaaaaacatgactataagaagcaagagtctcagaaatgcagagttggagactcagataaaaaaatgatatctaatgtcacaataatctctctgatttctgaaatacaaaagagcatctctgagttgtcactatcatgtggtaatgatgacaattctactgggcaagtcttaacattcaatggattagaagatacaatacgaggcgattacattgtagactgtgtgactggcttgtatcagtcagatattggagtcggtgtggggctggggaggactcaccatgatcatcatcaagtgaaaaacaaggcagtcgtgatagatgagaaagaaagaatgatatcactcctagagactcaacaaagtgagaatgatataaagatgcaagtactaatgtctgaaattgaacaactgaagaatcaactgtcaaggaagcgaaatgagagaggacaggagaaaagagatgctgaaaaggtgatgtcagacttgatggccaggaattctgatttacggaagcataatgatattctcactgctgagatatctcagatgaaatataataacacaatccaaagaagcaaaaatgtaatgagtactactgtagtcccagcaatactttcagtggccttactgtcatcatcagttgctcccattatggctgcgcctccagattcaccgatgattaatccatggcctcatgcaaaaaatagagttggaacagggatgtacaaatatgatgataatgatgactcaggctgtagaccaatcagatatggagtttcatgcataggatttgactttatgctcaagatggacaaataccctttctttaatgcattcataggccataaaactcccttagaatcatttgctgataaaataatcgagaaagaagaagaaacatgtgagatagggacaaacaaagagtttaaatgtttcgaggagagagcttacataaaggggacatgtccgactaacatcaatgcagtccattacattgacaataaaggcaaattgcgatatgtgaaatgtaaggaaaatctggagatgactgaggattgtgctttctgtaggaaaatcaagaagaaagctggtcagtctgttcaggtgcaaaaaacttcagtccctcttcaagatgcaatttgtcaggaaaattcagacaattattctggaccaaagataccctttaaaggggtttgcaggattggtctaatcaaatataaagagtgcaagtttaaaacgtcttcttatgagactgtctcattcataacactcaaggagaaagggaagatttatattgagcacctaatgttgaaaaatatagaggtagttacgaatgtctcttttgtttgctacgaacatgcaggtcaggatgagcaagaggtagaacacagggctttgaagagggtatcagttaatgattgtaagattgtggacaactccaagcagaaaatttgcacaggagatcacgttttctgtgaaaagtatgattgttcgacatcttatccagatgttacttgtatccatgcgccaggatcaggaccattgtacataaatctcatgggctcatggataaaaccccaatgtgtgggctatgagagagtcttagttgacagggaagtcaagcagccactgcttgcaccagaacagaactgtgacacctgtgtttcagagtgtctagacgagggggttcatataaagtccactggctttgagataacatcagcagtagcctgctcacatgggtcttgcatttcagctcatcaagaggcgtccacatcagtaattgtcccatacccaggattattggccagtgtgggcggaagaattgggattcacctctcacatacttctgattctgctagtgtgcacatggtagtggtttgccctcctagagacagttgtgaagctcacaattgcttactatgctatcatggtatcctaaattatcagtgccattcaacattaagtgctatcctgacttcctttctattaattctcttcatatatactgttttttctgtgacgacaaatatgttatatgtgctcagactaataccaaaacagctaaagagtccagtgggatggctcaaactcttcatcaactggctgctaactgctctaagaatcaaaactagaaatgttatggggaggataaaccagagaataggatgggttgaccatcatgatgtagagagaccaaggcacagagaacctatgagaagattcaaaacaactctattgttaactctgataatgatgactggagggaatgcttgctccaatacagtagtagctaattcaaagcaaaccagatgtgtacaggaaggatcaaacacaaagtgctcaatcactgcaactataactttaagggcaggcgtgattggtgcagagtcatgttttataataaaaggccctatggagaatcagcagaagacaatatcaatcaagaccatctccagtgagacagtatgcagggagggatcaagcttctggactagtttatatatcccatcatgtcttagctctaggaggtgccatcttgttggtgattgtgtaggcaataaatgccagtcgtggagagatgatcaactatctagggaattttcaggagtaaaggataaccatattatgaacgaaaataaatgctttgaacagtgtggcgcaattggttgtggttgctttaacattaatccttcctgcttgtatgttcatgcttacctcaagagtgctagaaatgaagcagttagggttttctcatgttctgattgggttcacagagtttcttttgaggtaaagggccctgatggtgagacagagctggtcacattgggaagcctaggcaccaagtttttaaactggggcaccctgtctttatccttggatgcagaaggcatcagcggaaccaacagcatcagttttctggaaagtagtaaaggaggatttgccttatacgatgaaggctatagtgagataccaagagagggatttcttggcgagataaggtgtagttctgaatccgcagctatatcagctcacaagtcttgtattagagctcctggtttaatcaagtacaagcctatgacagatcaaatagaatgtactgcatctttagtggatccattcgcaattttccttaaaggatctcttcctcagactagaaatggacaaacattcactagcacaaaagacaagaagacagtacaggctttcactaatggagcgataaaagcgctattgtctattaatttagatgatcatgaaattgtctttattaacaaagtgaaaagctgtgatgcaacatttctaaatgttagtggttgctactcctgtgattatggagcacatgtctgtgtgaaagtcaaatcctcagaatcagctgatttctttgcagaatcagaagacaagacaacagttttatctttcccaatacagtctggcacccatgattactgtcaggttttacattttcaaaaaccattagtagatgaaagactttcatattcttgtggatctgagcctaagcttatagtgattaagggaacattagtttacatgggtgtatatgatttcagaaacaaaacaggtggttcttcaacagtggtaaatccttcagaaggcgcctggagcatctcaaattggttttcaggccttctagactggttaggcgggcctatgaaggctatactgaagattctgggcttcattgctattgggattgtttgctttattttattcatgattatgatcagaattgcagtcaactcaataaatatcaagaagaaaaactag

SEQ ID NO: 4329 - RNA, 3942 nt, synthetic construct
  misc_feature 1..3942: note = derived and/or modified CDS sequence (wt) from PTV(PAN483391)__KP272008.1__GP
  source 1..3942: mol_type = other RNA
atgatttttacaattttaaatattttaacaagagccatgctcgtaatgagcatgtattctttaactacgtgggatagcactagcagaaatgacatgtgcttttctaatgactcacctctagaaggcctagtttactactgggagacacactcaaaaaaacatgactataagaagcaagagtctcagagatgcagggttggagattcagataaaaaaatgataactaatgtcacaataatctctctgatttctgaaatacagaaaagtatctctgagttgtcactatcatgtggtaatgatgacaattctactggacaagtcttaacattcaatggattagaagacacaatacgaggcgattacattgtagactgcgtgactggcttgtatcagtcagatattggagtcggcgtggggttagggaggactcaccatgatcatcagcaagtgaaaaacaaagcagttgtgatagatgaaaaagaaagaatgatatcactcctagagactcaacaaagtgagaatgatataaagatgcaagtactaatgtctgaaattgaacaactgaagaatcaactgtcaaagaagcgaaatgagagaggccaggagaaaagagatgctgagaaggtgatgtcagacttgatggccaggaattctgacttacggaagcataatgatattctcactgctgaaatatctcagatgaaatatgataacacaatccaaagaaacaaaaatgtaatgagtactactgtagtcccagcaatactttcagtggccttactgtcatcatcaattgctcccattatggccgcatctccagattcaccgatgattaatccatggcctcatgcaaaaaacagggttggcacaggaatgtacaaatatgatgaaaatgatgactcaggctgcagaccaatcagatatggggtttcatgcataggatttgactttatgctcaagatggacaaatatcctttctttaatgcatttataggccataaaactcccttagaatcctttgctgataaaataattgagaaagaggaagaaacatgtgagataggaacaaacaaagagtttaaatgtttcgaggagagagcttacataaaggggacatgcccaactaacatcaatgcagttcattacattgacaataaaggtaaattgcgatatgtaaaatgcaaggaaaatctggaaatgactgaggattgtgctttctgtaggaaaatcaagaagaaagctggtcagtctgttcaggtgcagaaaacttcagttccacttcaagatgcaatttgtcaagaaaattcagatacttattctggaccaaagataccctttaaaggggtttgtaagattggtctaattaaatataaagagtgcaagtttaaaacatcttcttatgagactgtctcattcatcacactcaaggagaaggggaaaatttacattgagcacctgatgttgaaaaatatagaggtggttacaaatgtctcttttgtttgctacgagcatgcaggtcaggatgagcaagaggtagaacacagggctctgaagagagtatcagttaatgattgtaagattgtggacaactctaaacagaaaatttgcacaggagatcatgttttttgtgaaaagtatgattgttctacatcttatccagatgttacttgtatccatgcaccaggatcaggaccattgtatataaatctcatgggctcatggataaaaccccaatgtgtgggctacgagaaagtcttagtagatagagaagtcaagcagccgttgcttgcaccagaacagaattgtgacacctgtgtttcagagtgtctagatgagggggtccatataaagtccaccggttttgagataacatcagcagtagcctgctcacatggatcttgcatctcagctcatcaagaagcgtctacatcagtaattgtcccatatccaggattgttggccagtgtgggcgggaaaattgggattcacctctcgcacacttctgattctgctagtgtgcacatggtagtggtttgccctcccagagacagttgtgcagctcataattgtctgctgtgctatcatggtatcctgaattatcagtgccattcaacattaagtgctatcctgacttcctttctattaattctcttcatatacactgttttttctgtcacgacaaatatgttatatgtgctcagactaataccaaaacagctaaagagtccagttggatggctcagactcttcattaactggctgttaactgctttaagaatcaaaactaggaatgttatggggaggataaaccagaggataggatgggttgaccatcatgatgtagagagaccaaggcacagagaacctatgaggagattcaaaacaactctattgttgactctgataatgatgactggaggaaatgcttgctccaacacagtagtagctaattcaaagcaaaccagatgtgtacaggaaggatcaaacacaaagtgctcaatcactgcaactataactttaaaggcaggtgtgattggtgcagagtcatgttttataataaaaggccctatggagaatcagcagaaaacaatatcaatcaaaaccatctccagtgagacagtatgcagggagggatcaagcttttggactagtttatatattccatcatgtcttagctctaggaggtgccatcttgttggtgattgtgtaggcaataaatgccagtcgtggagagatgatcaactatctagggaattttcaggagtaaaggataaccatattatgaacgaaaataagtgctttgaacagtgtggcgcaattggttgtggttgttttaacattaatccttcctgcttgtacgttcatgcttacctcaagagtgctagaaatgaagcagttagggttttctcatgttctgattgggtacacagagtttcttttgaggtaaaaggtcctgatggtgaaacagagctggttacattgggaagcctaggcactaagtttttaaactggggcaccctgtctttatccctggatgcagaaggcatcagcggaaccaacagcatcagctttctggaaagtagcaaaggagggtttgccttatatgatgaaggctacagtgagataccaagagagggatttcttggtgagataaggtgtagttctgaatccgcagctatatcagctcataagtcttgtattagagctcctggtttaatcaagtacaagcccatgacagatcaaatagaatgcactgcatctttagtggatccattcgcaattttccttaaaggatctcttcctcaaactagaaatgggcaaacattcaccagcacaaaagacaagaagacagttcaggctttcactaatggggcgataaaagcactattgtctattaacttagatgatcatgaaattgtctttattaacaaagtgagaagctgtgatgcaacatttctaaatgttagtggctgctactcctgtgattatggagctcatgtctgtgtgaaagtcaaatcttcagagtcagctgatttctttgcagaatcagaagacaagacaacagttttatctttcccaatacagtctggcacccatgattactgtcaggttttacattttcaaaaaccattagtagatgaaagactatcatactcttgtggatctgagcctaagctgatagtgatcaagggaacattggtttacatgggtgtctatgatttcagaaacaaaacaggtggttcttcaacagtagtaaatccttcagaaggtgcctggagcatttcaaattggttttctggccttctagactggttaggtgggcctatgaaggctatactaaagattctgggctttattgccattgggattgtctgctttattttatttatgattctgatcagaattgcagtcaactcaataaacatcaagaagaaaaactag

SEQ ID NO: 4330 - RNA, 3942 nt, synthetic construct
  misc_feature 1..3942: note = derived and/or modified CDS sequence (wt) from PTV(GML902876)__KP272011.1__GP
  source 1..3942: mol_type = other RNA
atgatttttacaattttgaacgttttaacaagagccatgctcgtgatgagcatgtattctttaacaacatgggatagtaccagcagaaatgacatgtgcttctctaatgactcacctctagaaggcctagtttactactgggagacacactcaaaaaaacatgactataagaagcaagagtctcagaaatgcagagttggagactcagataaaaaaatgatatctaatgtcacaataatctctctgatttctgaaatacaaaagagcatctctgagttgtcactatcatgtggtaatgatgacaattctactgggcaagtcttaacattcaatggattagaagatacaatacgaggcgattacattgtagactgtgtgactggcttgtatcagtcagatattggagtcggtgtggggctggggaggactcaccatgatcatcatcaagtgaaaaacaaggcagtcgtgatagatgagaaagaaagaatgatatcactcctagagactcaacaaagtgagaatgatataaagatgcaagtactaatgtctgaaattgaacaactgaagaatcaactgtcaaggaagcgaaatgagagaggacaggagaaaagagatgctgaaaaggtgatgtcagacttgatggccaggaattctgatttacggaagcataatgatattctcactgctgagatatctcagatggaaaataataacacaatccaaagaaataaaaatgtaatgagtactactgtagtcccagcaatactttcagtggccttactgtcatcatcaattgcccccattatggctgcatctccagattcaccgatgattaatccatggcctcatgcaaaaaacagggttggcacaggaatgtacaaatatgatgaaaatgatgactcaggctgcagaccaatcagatatggggtttcatgcataggatttgactttatgcttaaaatggacaaatatcctttctttaatgcatttataggccataaaactcccttagaatcctttgctgataaaataattgagaaagaggaagaaacatgtgagataggaacaaacaaagagtttaaatgtttcgaagagagagcttacataaaggggacatgcccaactaacatcaatgcagttcactacattgacaataaaggtaaattgcgatatgtaaaatgcaaggaaaatctggaaatgactgaggattgtgctttctgtaggaaaatcaagaagaaagctggtcagtctattcaggtgcagaaaacttcagtcccacttcaagatgcaatttgtcaagaaaattctgatacttattctggaccaaaaataccctttaaaggggtttgtaagattggtctaattaaatataaagagtgtaagtttaaaacatcttcttatgaaactgtctcattcatcacactcaaagagaaggggaaaatttacattgagcacctgatgttgaaaaatatagaggtggttacaaatgtctcttttgtttgctacgaacatgcaggtcaggatgagcaagaggtagaacacagggctctgaagagagtatcagttaatgattgtaagattgtggacaactctaaacagaaaatttgcacaggagatcacattttctgtgaaaagtatgattgttctacatcttatccagatgttacttgtatccatgcgccaggatcaggaccattgtacataaatctcatgggctcatggataaaaccccaatgtgtgggctacgagagagtcttagtagatagagaagtcaagcagccattgctggcaccagaacagaactgtgacacctgtgtttcagagtgtctagatgagggggtccatataaagtccaccggttttgagataacatcagcagtagcctgctctcatggatcttgcatctcagctcatcaagaagcgtccacatcagtaattgtcccatatccaggattgttggccagtgtgggcggaagaattgggattcacctctcgcacacctctgactctgctagtgtgcacatggtggtggtttgccctcccagagacagctgtgcagctcataattgcctgctatgctatcatggtatcctgaattatcagtgccattcaacattaagtgctatcctgacttcctttctattaattctcttcatatacactgttttttctgtcacgacaaatatgttatatgtgctcagactaatacctaaacagctaaagagtccagttggatggctcagactcttcattaactggctattaactgctttaagaatcaaaactaggaatgttatggggaggataaaccagaggataggatgggttgaccatcatgatgtagagaggccaaggcacagagaacctatgaggagattcaaaacaactctattgttgactctgataatgatgactggaggaaatgcttgctccaatacagtagtagccaattcaaagcaaaccagatgtgtgcaggaaggatcaagcacaaagtgttcaatcactgcaacgataactttaagggcaggtgtgattggtgcagagtcatgttttatcataaaaggccctatggaaaatcagcagaaaacaatatcaatcaaaaccatctctagtgaaacagtatgcagggagggatcaagcttctggactagtttatatatcccatcctgtcttagttctaggaggtgtcatcttgttggtgattgtgtgggcaataaatgccagtcgtggagagatgatcagctatctagggaattctcaggagtaaaggataatcatatcatgaatgaaaataaatgctttgaacaatgtggcgcaattggttgtggttgttttaacattaatccttcctgcttgtacgttcatgcttacctcaagagtgctagaaatgaagcagttagggttttctcatgttctgattgggttcacagagtttcttttgaggtaaagggccctgatggtgagacagagctggtcgcattgggaagcctaggcaccaagtttttaaactggggcaccctgtctttatccttggatgcagaaggcatcagcggaaccaacagcatcagttttctggaaagtagtaaaggaggatttgccttatacgatgaaggctatagtgagataccaagagagggatttcttggcgagataaggtgtagttctgaatccgcagctatatcagctcacaagtcttgtattagagctcctggtttaatcaagtacaagcctatgacagatcaaatagaatgtactgcatctttagtggatccattcgcaattttccttaaaggatctcttcctcagactagaaatggacaaacattcactagcacaaaagacaagaagacagtacaggctttcactaatggagcgataaaagcgctattgtctattaatttagatgatcatgaaattgtctttattaacaaagtgaaaagctgtgatgcaacatttctgaatgttagtggttgctactcctgtgattatggagcacatgtctgtgtgaaagtcaaatcctcagaatcagctgatttctttgcagaatcagaagacaagacaacagttttatctttcccaatacagtctggcacccatgattactgtcaggttttacattttcaaaaaccattagtagatgaaagactttcatattcttgtggatctgagcctaagcttatagtgattaagggaacattagtttacatgggtgtatatgatttcagaaacaaaacaggtggttcttcaacagtggtaaatccttcagaaggcgcctggagcatctcaaattggttttcaggccttctagactggttaggcgggcctatgaaggctatactgaagattctgggcttcattgctattgggattgtttgctttattttattcatgattatgatcagaattgcagtcaactcaataaatatcaagaagaaaaactag

SEQ ID NO: 4331 - RNA, 3942 nt, synthetic construct
  misc_feature 1..3942: note = derived and/or modified CDS sequence (wt) from PTV(PAN479603)__KP272014.1__GP
  source 1..3942: mol_type = other RNA
atgatttttacaattttaaatattttaacaagagccatgctcgtaatgagcatgtattctttaacaacatgggatagcaccagcagaaatgacatgtgcttctctaatgactcacctctagaaggcttagtttactactgggagacacactcaaaaagacatgattataagaagcaagagtctcagaaatgcagagttggagactcagataaaaaaatgatatctaatgtcacaataatctccctgatttctgaaatacaaaaaagcatctctgaattgtcactatcatgtggcaatgatgacaattctaccgggcaagtcttaacattcaatggactagaagataccatacgaggcgattacattgtagactgtgtgactggcttgtatcagtcagatattggagtcggtgtggggctggggaggactcaccatgatcatcatcaagtgaaaaacaaggcagttgtgatagatgagaaggaaagaatgatatcactcctggagactcaacaaagtgagaatgatataaagatgcaagtactaatgtctgagattgaacaactgaagaatcaactgtcaaggaagcgaaatgagagaggccaggagaaaagagatgctgagaaggtgatgtcagacttgatggccaggaattctgacttacggaagcataatgatattctcactgctgaaatatctcagatgaaatatgataacacaatccaaagaaataaaaatgtcatgagtactactgtagtcccagcaatactttcagtggccttactgtcatcatcagttgctcccattatagctgcgcctccagattcaccgatgattaatccatggcctcatgcaaaaaatagagttggaacagggatgtacaaatatgatgataatgatgactcaggctgtagaccaatcagatatggagtttcatgcataggatttgactttatgctcaagatggacaaataccctttcttcaatgcattcataggccataaaactcccttagaatcatttgctgataaaataattgagaaagaagaagaaacatgtgagatagggacaaacaaagagttcaaatgtttcgaggagagagcttacataaaggggacatgtccgactaacatcaatgcagtccattacattgacaataaaggcaaattgcgatatgtgaaatgtaaggaaaatctggaaatgactgaggattgtgctttctgtaggaaaatcaagaagaaagctggtcagtctgttcaggtgcagaaaacttcagtcccacttcaagatgcaatttgtcaagaaaattcagacacttattctggaccaaagataccctttaaaggggtttgcaagattggcctaatcaaatataaagagtgcaagtttaaaacgtcttcttatgagactgtctcattcataacactcaaggagaaagggaagatttatattgagcacctaatgttgaaaaatatagaggtagttacgaatgtctcttttgtttgctacgaacatgcaggtcaggatgagcaagaggtagaacacagggctctgaagagagtatcagttaatgattgtaagattgtggacaactccaagcagaaaatttgcacaggagatcacgttttctgtgaaaagtatgattgttcgacatcttatccagatgttacttgtattcatgcgccaggatcaggaccattgtacataaatcttatgggctcatggattaaaccccaatgtgtgggctacgagagagtcttggtagacagggaagttaagcagccattgcttgcaccagaacagaactgtgacacctgtgtttcagagtgtctagatgagggggtccatataaagtccactggctttgagataacatcagcagtagcctgctcacatgggtcttgcatctcagctcatcaagaggcgtccacatcagtaattgtcccatacccaggattattggccagtgtgggcggaagaattgggattcacctctcacatacttctgattctgctagtgtgcacatggtagtggtttgccctcctagagacagttgtgcagctcataattgcttgctatgctatcatggtatcctaaattatcagtgccattcaacattaagtgccatcctgacttcctttctattaattctcttcatatacactgttttttctgtgacgacaaatatgttatatgtgctcagactaataccaaaacagctaaagagtccagtgggatggctcaaactcttcatcaactggctgctaactactctaagaatcaaaactagaaatgttatggggaggataaaccagagaataggatgggttgaccattttgatgtagagagaccaaggcacagagagcctatgagaagattcaaaacaactctattgttgactctgataatgatgactggagggaatgcttgctccaatacagtagtagccaattcaaagcaaaccagatgtgtgcaggaaggatcaaacacaaaatgttcaatcactgcaacgataactttaagggcaggtgtgattggtgcagaatcatgttttatcataaaagggcctatggaaaatcagcagaaaacaatatcaatcaaaaccatctctagtgagacagtatgcagggagggatcaagcttctggactagtttatatatcccatcttgtcttagttctaggaggtgtcatcttgttggtgattgtgtgggcaataaatgccagtcgtggagagatgatcagctatctagggaattctcaggagtaaaggataaccatatcatgaatgaaaacaaatgctttgaacaatgtggcgcaattggttgtggttgttttaacattaatccttcctgcttgtacgttcatgcttacctcaagagtgctagaaatgaagcagttagggttttctcatgttctgattgggttcacagagtttcttttgaggtgaagggccctgatggtgagacagagctagtcacattgggaagcttaggcaccaagtttttaaactggggcaccctgtctttatccttggatgcagaaggcatcagtggaaccaacagcatcagttttctggaaagtagtaaaggaggatttgccttatacgatgaaggctatagtgagataccaagagaagggtttcttggcgagataaggtgtagctctgaatccgcagctatatcagctcataagtcctgcattagggctcctggtttaatcaagtacaagcccatgacagatcaaatagaatgtactgcatctttagtggatccattcgcaattttccttaaaggatctcttcctcagactagaaatggacagacattcaccagcacaaaagacaagaagacagtacaggctttcactaatggagcgataaaggcgctattgtctattaatttagatgatcatgaaattgtctttattaacagagtgaaaagctgtgatgcaacatttctaaatgttagtggttgctactcctgtgattatggagcacatgtctgtgtgaaagtcaaatcctcagaatcagctgatttctttgcagaatcagaagacaagacaacagttctatctttcccaatacagtctggcacccatgattactgtcaggttttacattttcaaaaaccattagtagatgagagactttcatattcttgtggatctgagcctaagcttatagtgattaagggaacattagtttacatgggtgtctatgatttcagaaacaaaacaggtggttcttcaacagtggtgaatccttcagaaggcgcctggagcatctcaaattggttctctggccttctagactggttaggtgggcctatgaaggccatactgaagattctgggcttcattgctattgggattgtttgctttattttatttatgattctgatcagaattgcagtcaactcaataaatatcaagaagaaaaactaa

SEQ ID NO: 4332 - RNA, 3942 nt, synthetic construct
  misc_feature 1..3942: note = derived and/or modified CDS sequence (wt) from PTV(PAN478718)__KP272017.1__GP
  source 1..3942: mol_type = other RNA
atgattttcacaattttaaatgttttaacaagagccatgctcgtaatgagcatgtattctttaactacgtgggacagttccagcagaaatgacatgtgtttttctaatgactcacctctagaaggtctagtttactactgggagacacactcaaaaaaacatgactataagaagcaagagtctcagagatgcagagttggagattcagataagaaaatgataactaatgtcacaataatctctctgatttctgaaatacaaaaaagcatctctgagttgtcactatcatgtggtaatgatgacaattctactggacaagtcttaacattcaatggattggaagacacaatacgaggtgattacattgtagactgcgtgactggcttgtatcagtcagatattggagtcggtgtggggttagggaggactcaccatgatcatcagcaagtgaaaaacaaagcagttgtgatagatgaaaaagaaagaatgatatcactcctagagactcaacaaagtgagaacgacataaagatgcaagtactaatgtctgagattgaacaactgaagaatcaactgtcaaagaagcgaaacgagagaggccaggagaaaagagatgctgagaaggtgatgtcagacttgatggccaggaattctgacttacggaagcataatgatattctcaccgctgaaatatctcagatgaaatataataacacaatccaaagaaacaaaaatataatgagtactactgtagtcccagcaatactttcagtggccttactgtcatcatcagttgctcccattatggctgcgcctccagactcaccgatgattaatccatggcctcatgcaaaaaatagagttggaacagggatgtacaaatatgatgataatgatgactcaggctgtagaccaatcagatatggagtttcatgcataggatttgactttatgctcaagatggacaaataccctttctttaatgcattcataggccataaaactcccttagaatcatttgctgataaaataattgagaaagaagaagagacatgtgagatagggacaaacaaagagtttaaatgttttgaggagagagcttacataaaggggacatgtccgactaacatcaatgcagtccattacattgacaataaaggcaaattgcgatatgtgaaatgtaaggaaaatctggagatgactgaggattgtgctttctgtaggaaaatcaagaagaaagctggtcagtctgttcaggtgcagaaaacttcagttccacttcaagatgcaatttgtcaagagaattcagacacttattctggaccaaagataccctttaaaggggtctgcaagattggtttaatcaaatataaagaatgcaagtttaaaacgtcttcttatgagactgtctcattcataacactcaaggagaaagggaagatttatattgagcacctaatgctgaaaaatatagaggtagttacgaatgtctcttttgtttgctacgaacatgcaggtcaggatgagcaagaggtagaacacagggctctgaagagagtgtcagttaatgattgtaagattgtggacagctccaagcagaaaatttgcacaggagatcacgttttctgtgaaaagtatgattgttcgacatcttatccagatgttacttgtatccatgcgccaggatcaggaccattgtacataaatctcatgggctcatggataaaaccccaatgtgtgggctacgagagagtcttagtagacagggaagtcaagcagccattgcttgcaccagaacagaactgtgacacctgtgtttcggagtgtctagatgagggggtccatataaagtccactggctttgagataacatcagcagtagcctgctcacatgggtcttgcatctcagctcatcaagaagcgtccacatcagtaattgtcccatacccaggattattggccagtgtgggcggaagaattgggattcacctctcacatacttctgattctgctagtgtgcacatggtggtggtttgccctcctagagacagttgtgcagctcataattgcttactatgctatcatggtatcctaaattatcagtgccattcaacattaagtgccatcctgacttcctttctattaattctcttcatatatactgttttttctgtgacgacaaatatgttatatgtgctcagactaataccaaaacaactaaagagtccagtgggatggctcaaactcttcattaactggctgctaactgctctaagaatcaaaactagaaatgttatggggaggataaaccagagaataggatgggttgaccatcatgatgtagagagaccaaggcacagagaacctatgagaagattcaaaacaactctattgttgactctgataatgatgactggagggaatgcttgctccaatacagtagtagctaattcaaagcaaaccagatgtgtacaggaaggatcaaacacaaagtgctcaatcactgcaactataactttaagagcaggtgtgattggtgcagagtcatgttttatagtaaaaggccctatggagaatcagcagaagacaatatcaatcaaaaccatctctagtgagacagtttgcagggaggggtcaagcttctggactagtttatatatcccatcatgtcttagctctaggaggtgccatcttgttggtgattgtgtaggcaataaatgccagtcgtggagagatgatcaactatctagggaattttcaggagtaaaggataaccatattatgaacgaaaataaatgctttgaacagtgtggcgcaattggttgtggttgctttaacattaatccttcctgcttgtatgttcatgcttacctcaagagtgctagaaatgaagcagttagggttttctcatgttctgattgggtacacagagtttcttttgaggtaaaaggtcctgatggtgaaacagagctggtcacattgggaagcctaggcactaagtttttaaactggggcaccctgtctttatccctggatgcagaaggcatcagcggaaccaacagcatcagctttctagaaagtagtaaaggaggatttgccttatatgatgaaggctacagcgagataccaagagagggatttcttggtgagataaggtgtagttctgaatccgcagctatatcagctcacaagtcttgtattagagctcctggtttaatcaagtacaagcccatgacagatcaaatagaatgtactgcatctttagtggatccattcgcaattttccttaaagggtctcttcctcagactagaaatgggcaaacattcaccagcacaaaagacaagaagacagtccaggctttcactaatggagcgattaaagcactattgtctattaatttagatgatcatgaaattgtatttattaacaaagtgataagctgtgatgcaacatttctaaatgttagtggttgctactcctgtgattatggagctcatgtctgtgtgaaagtcaaatcttcagagtcagctgatttctttgcagaatcagaagacaagacaacagttttatctttcccaatacagtctggcacccatgattactgtcaggttttacattttcaaaaaccattagtagatgaaagactatcatattcttgtggatctgagcctaagctgatagtgatcaagggaacattggtttacatgggtgtctatgatttcagaaacaaaacaggtggttcttcaacagtagtaaatccttcagaaggtgcctggagcatttcaaattggttttctggccttctagactggttaggtgggcctatgaaggccatactaaagattctgggctttattgccattgggattgtctgcttcattttattcatgattctgatcagaattgcagtcaactcaataaacatcaagaagaaaaactag

SEQ ID NO: 4333 - RNA, 3942 nt, synthetic construct
  misc_feature 1..3942: note = derived and/or modified CDS sequence (wt) from PTV(Balliet)__KP272023.1__GP
  source 1..3942: mol_type = other RNA
atgatttttacaattttaaatgttttaacaagagccatgctcgtaatgagcatgtattctttaactacgtgggacagcaccagcagaaatgacatgtgcttttctaatgactcacctctagaaggcctagtttactactgggagacacactcaaaaaagcatgactataagaagcaaaagtctcagagatgcagagttggagattcagacaaaaaaatgataactaatgtcacaataatctctctgatttctgaaatacaaaaaagcatctctgagttgtcactatcatgtggcaatgatgacaattctactggacaagtcttaacattcaatggattagaagacacaatacgaggtgattacattgtagactgcgtgactggcttgtatcagtcagatattggagtcggtgtggggctagggaggactcaccatggtcatcagcaaatgaaaaacaaagcagttgtaatagatgagaaagaaaggatgatattactcctagagactcaacaaagtgagaatgacataaagatgcaagtactaatgtctgaaattgaacaactgaagaatcaactgtcaaagaagcgaaatgagagaggccaggagaaaagagatgctgagaaggtgatgtcagacttgatggccaggaattctgacttacggaagcataatgacattctcactgctgaaatatctcagatgaaaaataaaaacacaatccaaagaaataaaaatacagtgagtactactgtagtcccagcaatactatcagtggccttactgtcatcatcagttgctcccattatagctgcacctccagattcaccgatgattaatccatggcctcatgcaaaaaatagagttggcacaggaatgtacaaatatgatgaaaatgatgactcaggctgtagaccaataagatatggagtttcatgcataggatttgactttatgctcaagatggacaaataccctttctttaatgcattcataggtcacaaaactcccttagaatcttttgctgataaaataattgagaaagaagaagaaacatgtgagataggaacaaacaaagagtttaaatgtttcgaggagagagcttatataaaggggacatgtccgaccaacatcaatgcagtccattacattgacaataaaggcaaattgcgatatgtaaaatgtaaggaaaatctggaaatgactgaggattgtgctttctgtaggaaaatcaagaagaaagctggtcagtctgttcaggtgcagaaaacttcagttccactccaggatgcaatttgtcaagaaaattcagacacttattctggaccaaagataccctttaaaggggtttgcaaaattggtctaatcaaatataaagaatgcaagtttaaaacatcttcttatgagactgtctcattcataacactcaaggagaaggggaagatttacattgagcacctaatgttgaaaaatatagaggtggttacgaatgtctcttttgtttgctacgaacatgcagggcaggatgagcaagaggtggaacataaggctctgaagagagtatcagttaatgattgtaagattgtggacaactcaaagcagaaaatttgcacaggagatcacgttttctgtgaaaagtatgattgttccacatcctatccagatgttacttgtatccatgcgccaggatcaggaccactgtacataaatctcatgggctcatggataaaaccccaatgtgtgggctatgagagagtcttagtagacagggaagtcaagcagccattgcttgcaccagaacagaactgtgacacctgtgtttcagagtgtctagatgagggggtccatataaagtccactggttttgagataacatcagcagtagcctgctcacatgggtcttgcatctcagctcatcaagagccatccacatcagtaattgtcccatacccaggattgttggccagtgtgggcggaagaattgggattcacctctcacatacttctgattctgctagtgtgcacatggtagtggtttgccctcctagagacagttgtgcagctcataattgcttgctatgctatcatggcatcctaaattatcagtgccattcaacattaagtgccatcctgacttcctttctattaattctcttcatatacactgtcttttctgtgacgacaaatatattatatgtgctcagactaataccaaaacagctaaagagtccagtgggatggctcaagctcttcatcaactggctgctaactgctctaagaatcaaaactagaaatgttatggggaggataaaccagagaataggatgggttgaccatcatgatgtagagagaccaaggcacagagaacctatgagaagattcaaaacaactctattgttgactctgataatgatgactggaggaaatgcttgctccaatacagtagtggctaactcaaagcaaaccagatgtgtacaggaaggatcaaacacaaagtgctcaatcactgcaactataactttaagggcaggtgtgattggtgcagagtcgtgctttataataaaaggccctatggagaatcagcagaaaacaatatcaatcaaaactatctccagtgagacagtatgcagagagggatcaagcttctggactagtttatatatcccatcatgtcttagctctaggaggtgtcatcttgttggtgattgtgtaggcaataaatgccagtcgtggagagatgatcagctatctagggaattttcaggagtaaaggataaccatatcatgaacgaaaataaatgctttgaacaatgtggcgcaattggttgtggttgttttaacattaatccttcctgcttgtacgttcatgcttacctcaaaagtgctagaaatgaagcagttagggttttctcatgttctgattgggtgcacagagtttcttttgaggtaaaaggtcctgatggtgaaacagagctggtcacattgggaagtctaggcaccaagtttttaaactggggcaccctgtcattatccctggatgcagaaggcatcagcggaaccaacagcatcagctttctggaaagtagtaaaggaggatttgccttatacgatgaaggctacaatgagataccaagagagggatttctaggtgagataaggtgtagttctgaatccgcagctatatcagctcataagtcttgtattagagctcctggtttaatcaagtacaagcctatgacagatcaaatagaatgtactgcatctttagtggatccattcgcaattttccttaaaggatctcttcctcagactagaaatggacaaacattcaccagcacaaaagacaagaagacagttcaggctttcactaatggagcgataaaagcgctattgtctattaatttagatgatcatgaaattgtctttattaacaaagtgaaaaactgtgatgcaacatttctaaatgttagtggttgctactcctgtgattatggagctcatgtctgtgtgaaagttaaatcttcagagtcagctgatttctttgcagaatcagaagacaagacaacagttttatctttcccaatacagtctggcacccatgattactgtcaggttttacattttcaaaaaccattagtagatgaaagactatcatattcttgtggatcagagcctaagctgatagtgatcaagggaacattggtttacatgggtgtctatgatttcagaaacaaaacaggtggctcttcaacagtagtaaacccttcagaaggtgcctggagcatttcaaattggttttctggccttctagactggttaggtgggcctatgaaggccatactaaagattttgggctttattgccattgggattgtctgctttgttttattcatgattctgatcagaattgcagtcaactcaataaatatcaagaagaaaaactag

SEQ ID NO: 4334 - RNA, 3942 nt, synthetic construct
  misc_feature 1..3942: note = derived and/or modified CDS sequence (wt) from PTV(Adames)__KP272029.1__GP
  source 1..3942: mol_type = other RNA
atgatttttacaattttaaatgttttaacaagagccatgctcgttatgagcatgtactctttaacaacgtgggacagctccagtaggaatgacatatgtttttctaacgactcacctctagagggccttgtctactactgggagacacactcaaaaaaacatgactataagaaacaaggttctcagaagtgtagagttggagattctgataaaaagatgatttctaatgttacaataatctctctaatttctgaaatacaaaaaagcatctctgagctatcactgtcatgtggtaataatgacaattctactggacaagtcttgacattcaatggattagaagatacaatacgaggcgactacattgtggactgtgtgactggattataccagtcagacattggagtcggtgtagggctggggagaatcaaccatgatcatcagcaagtaaaaaataaagcagttgttatagatgagaaagaaaaaatgatatcacttctagagactcaacaaagtgagaatgacataaagacacaagtactgatgtctgaaattgaacaactgaagaatcaactatcaaaaagacgaaatgagaggggacaggagaagagagatgctgaaaagctgatgtcagacctgatggctagaaattctgacttacggaatcacaatgttattctaactgacgaaatatctcaaataaaaaataatatcacaattcacagaaacagaaacatgatgagtactactgtggtcccagcaatactttcggtggctctgctatcatcatcagttggtcccattacggctgcacctccagattcaactatgatcaatccatggcctcatgcaaaaaatagagttggcacaggaatgtacaaatatgatgaaaatgatgagtcagggtgtagaccaatcagatatggtgtttcctgcataggatttgatttcatgcttaagatggataagtatcctttctttaatgcatttataggtcataaaactcctttagaatccttcgcagataaaataattgagaaagaagaagagacatgtgaaataggaacaaacaaagagtttaaatgttttgaggagagagcttacataaaggggacatgtccgaccaacatcaatgcagttcattacattgacaataaaggcaagttgcgatatgtaaaatgcaaagagaatctggaaatgactgaagactgtgctttctgcaggaaaatcaagaagaaagctggtcagtctgttcaggtgcagaaaacttcagtaccgttacaagatgcaatttgtcaagagaactcagacatttactccggaccaaagatacctttcaagggagtttgtaagatcggtctaataaagtataaagagtgtaagtttaaaacatcatcttatgagaccatttcattcatcacactcaaagggaaaggaaaaatttacattgagcacttgatgttaaaaaacatagaggtggtcacaaatgtttcttttgtttgctatgaacatgcaggtcaagatgaacaagaggtagaacacagggccctgaagagagtatcagtcaatgattgtaagattgtggacaactctaagcagaagatttgcacaggagaccacattttctgtgagaagtatgactgttctacatcttatccagatgtgacttgtatccacacaccaggatcagggccattatacataaatctcatgggctcatggataaaaccccaatgtgttggctacgagagagtcttagtagatagggaggttaagcagccattgcttgtaccagagcagaactgtgacacctgtgtttcagagtgtctagatgaaggagtacacataaaatccactggttttgaaataacatcagcagtggcctgctcacatggatcctgtatctcagctcatcaggaagcatccacatcagtaattattccatatccaggcttgttggctagtgtgggcgggagaattgggatacacctctcacatacttctgattctgctagtgtacacatggtagtggtttgccctcccagagatagttgtgcagctcataattgcttactatgctatcatggcattctgaactatcagtgccattcaacactgagtgctatcctgacttcctttctactaattcttttcatatacactgctttttctgtgacaacaaatgttttgtatgtgctcagactaataccgaaacagctgaaaagtccagtgggatggctcaaactctttgtcaactggctactaactgctctaagaatcaaaactaggcgagtaatggggaggataaatcagagaatagggtgggttgatcatcatgatgtagagagaccaaggcacagagaacctatgaggagattcaagacaactctattgctaactctgataatggtgacaggaggaaatgcctgctccaatacagtagtggccaattcgaagcaaaccagatgtgtccaagaaggatcaaacacaaagtgttctattactgcaactataactttaagggcaggtgtgattggtgctgagtcatgtttcataataaaaggccccatggaaaaccagcagaaaacaatatcaattaaaaccatctctagtgagacagtatgcagagaaggttcgagtttctggaccagtttgtacatcccatcttgtcttagttctaggagatgtcatcttgttggtgattgtgtgggtaacaaatgccagtcatggcgagatgatcagctatccagggagttttcaggagtaaaggataaccatattatgaatgaaaataaatgctttgaacaatgtggtgcaattggctgtggttgtttcaacatcaatccttcctgcttgtatgtccatgcttatctcaagagtgctagaaatgaagcagtcagggtattctcatgttctgactgggtgcacagagtttcctttgaggtcaaaggccctgatggcgagatggagttggtcacactagggagcctgggcactaagtttttaaactggggcactttgtcattatccttggatgcagaaggtatcagcggaaccaacagtatcagttttttggaaagtagtaaaggagggtttgctctgtacgatgaaggatatagtgaaataccaagagaaggatttcttggagagataaggtgcagttctgaatccgcagccatatcagctcataagtcatgcattagagctcctggtttgatcaagtacaagcccatgacagatcaaatagaatgtactgcatctttagtagatccatttgcaattttcctcaaaggatctcttcctcagactaggaatggacagacattcaccagtacaaaagacaaaaaaacagtacaggccttcaccaatggagcaataaaagcattattgtcgattaatttagatgatcatgaaatcatctttattaataaagtgaaaagctgtgatgccacatttttaaatgttagtggatgctactcttgtgattatggagcacatgtctgtgtgaaagtaaagtcttcggagtcagccgacttctttgcagaatcggaggacaaaacaacagtcctgtcttttccaatacaatctggcacacgtgactactgtcaggttttacattttcaaaagccattagtagatgaaagactttcatattcttgtggatctgagcctaagctgatagtgattaagggaacattagtttacatgggtgtctatgattttaggaataaaacaggtggttcttcaacagtgataaatccttcagaaggaacctggagcatctccaattggttttctgggcttctggactggctaggtgggcctatgaaggccatactgaagatactgggcttcattgctattgggattgtttgcttcattttgttcatgattctgattagaattgcagtcaactcaataaatatcaagaagaaaaactaa

SEQ ID NO: 4335 - RNA, 3942 nt, synthetic construct
  misc_feature 1..3942: note = derived and/or modified CDS sequence (wt) from PTV(GML488831)__KP272032.1__GP
  source 1..3942: mol_type = other RNA
atgatttttacaattttaaatgttttaacaagagctatgctcgtaatgagcatgtattctttaactacgtgggatagcaccagcagaaatgacatgtgtttttctaatgactcacctctagaaggcctagtttactactgggagacacactcaaaaaaacatgactataagaagcaagagtctcagagatgcagagttggagattcagataaaaagatgataactaatgtcacaataatctctctgatttctgaaatacagaaaagtatctctgagttgtcactatcatgtggtaatgatgacaattctactggacaagtcttaacattcaatggattggaagacacaatacgaggtgattacattgtagactgcgtgactggcttgtatcagtcagatattggggtcggtgtggggttagggagggctcaccatgatcatcagcaagtgaaaaacaaagcagttgtgatagatgaaaaagaaagaatgatatcactcctagagactcaacaaagtgagaacgatataaaaatgcaagtactaatgtctgaaattgaacaactaaagaatcaactgtcaaagaagcgaaatgagagaggccaggagaagagagatgctgagaaagtgatgtcagacttgatggccaggaattctgacttacggaagcataatgatattctcactgctgaaatatctcagatgaaatataataacacaatccaaagaagcaaaaatgtaatgagtactactgtagtcccagcaatactttcagtggccttactgtcatcatcagttgctcccattatggctgcgcctccagattcaccgatgattaatccatggcctcatgcaaaaaatagagttggaacagggatgtacaaatatgatgataatgatgactcaggctgtagaccaatcagatatggagtttcatgcataggatttgactttatgctcaagatggacaaataccctttctttaatgcatttataggccataaaactcccttagaatcatttgctgataaaataattgagaaagaagaagaaacatgtgagatagggacaaacaaagagtttaaatgtttcgaggagagagcttacataaaggggacatgtccgactaacatcaatgcagtccattacattgacaataaaggcaaactgcgatatgtgaaatgtaaggaaaatctggagatgactgaggattgtgctttctgtaggaaaatcaagaagaaagctggtcagtctgttcaggtgcagaaaacttcagtctcacttcaagatgcaatctgtcaagaaaattcagacaattattctggaccaaagataccctttaaaggggtttgcaagattggtctaatcaaatataaagagtgcaagtttaaaacgtcttcttatgagactgtctcattcataacactcaaggagaaagggaagatttatattgagcacctaatgttgaaaaatatagaggtagttacgaatgtctcttttgtttgctacgaacatgcaggtcaggatgagcaagaggtagaacacagggctctgaagagggtatcagttaatgattgtaagattgtggacaactccaagcagaaaatttgcacaggagatcacgttttctgtgaaaagtatgattgttcgacatcttatccagatgttacttgtatccatgcgccaggatcaggaccattgtacataaatctcatgggctcatggataaaaccccaatgtgtgggctacgagagagtcttagtagacagggaagttaagcagccattgcttgcaccagaacagaactgtgacacctgtgtttcagagtgtctagatgagggggttcatataaagtccactggatttgagataacatcagcagtagcctgctcacatgggtcttgcatttcagctcatcaagaggcgtccacatcagtaattgtcccatacccaggattattggccagtgtaggcggaagaattgggatccacctctcacatacttctgattctgctagtgtgcacatggtagtggtttgccctcctagagacagttgtgcagctcacaattgcttactatgctatcatggtatcctaaattatcagtgccattcaacattaagtgccatcctgacttcctttctattaattctcttcatatatactgttttttctgtgacgacaaatatgttatatgtgctcaggctaataccaaaacagctaaagagtccagtgggatggctcaaactcttcatcaactggctgctaactgctctaagaatcaaaactagaaatgttatggggaggataaaccagagaataggatgggtcgaccatcatgatgtagagagaccaaggcacagagaaccaatgagaagattcaaaacaactctattgttaactctgataatgatgactggagggaatgcttgctccaatacagtagtagctaattcaaagcaaaccagatgtgtacaggaaggatcaaacacaaagtgctcaatcactgcaactataactttaagggcaggtgtgattggtgcagagtcatgttttataataaaaggccctatggagaatcagcagaagacaatatcaatcaaaaccatctccagtgagacagtatgcagggagggatcaagcttctggactagtttatatatcccatcatgtcttagctctaggaggtgccatcttgttggtgattgtgtaggcaataaatgccagtcgtggagagatgatcaattatctagggaattttcaggagtaaaagataaccatattatgaacgaaaataaatgctttgaacagtgtggcgcaattggttgtggttgctttaacattaatccttcctgcttgtacgttcatgcttacctcaagagtgctagaaatgaagcagttagggttttttcatgttctgattgggtacacagagtttcttttgaggtaaaaggtcctgatggtgaaacagagctggtcacattgggaagcctaggcactaagtttttaaactggggcaccctgtctttatccctggatgcagaaggcatcagcggaaccaacagcatcagctttctggaaagtagtaaaggaggatttgccttatatgatgaaggctacagtgagataccaagagagggatttcttggtgagataaggtgtagttctgaatccgcagctatatcagctcacaagtcttgtattagagctcctggtttaatcaagtacaagcccatgacagatcaaatagaatgtactgcatctttagtggatccattcgcaattttccttaaaggatctcttcctcagactagaaatgggcaaacattcaccagcacaaaagacaagaaaacagtccaggctttcactaatggagcgataaaagcactattgtctattaatttagatgatcatgaaattgtctttattaacaaagtgagaagctgtgatgcaacatttctaaatgttagtggttgctactcctgtgattatggagctcatgtctgtgtgaaagtcaaatcttcagagtcagctgatttctttgcagaatcagaagacaagacaacagttttatctttcccaatacagtctggcacccatgattactgtcaggttttacattttcaaaaaccgttagtagatgaaagactatcatattcttgtggatctgagcctaagctgatagtgatcaagggaacattggtttacataggtgtctatgatttcagaaacaaaacaggtggttcttcaacagtagtaaatccttcagaaggtgcctggagcatttcaaattggttttctggccttctagactggttaggtgggcctatgaaggccatactaaagattctgggctttattgccattgggattgtctgctttattttattcatgattctaatcagaattgcagtcaactcaataaacatcaaaaagaaaaactag

SEQ ID NO: 4336 - RNA, 3942 nt, synthetic construct
  misc_feature 1..3942: note = derived and/or modified CDS sequence (wt) from PTV(GML488778)__KP272038.1__GP
  source 1..3942: mol_type = other RNA
atgatttttacaattttaaatgttttaataagagctatgctcgtaatgagcatgtattctttaactacgtgggatagcaccagcaggaatgacatgtgcttttctaatgactcacctctagaaggcctagtttactactgggagacacactcaaaaaaacatgactataagaagcaagagtctcagagatgcagagttggagattcagacaaaaaaatgataactaatgtcacaataatctctctgatttctgaaatacaaaaaagtatctctgagttgtcactatcatgtggtaatgatgacaattctactggacaagtcttaacattcaatggattggaagacacaatacgaggtgattacattgtagactgcgtgactggcttgtatcagtcagatatcggagtcggtgtggggttagggaggactcaccatgatcatcaacaagtgaaaaacaaagcagttgtgatagatgaaaaagaaagaatgatatcactcctagagactcaacaaagcgagaacgacataaagatgcaagtactaatgtctgaaattgaacaactgaagaatcaactgtcaaagaagcgaaatgagagaggccaggagaaaagagatgctgagaaggtgatgtcagacttgatggccaggaattctgacttacggaagcataatggtattctcactgctgaaatatctcagatgaaatataataacacagtccaaagaagcaaaaatgtaatgagtactactgtagtcccagcaatactttcagtggccttactgtcatcatcagttgctcccattatggctgcgcctccagattcaccgatgattaatccatggcctcatgcaaaaaatagagttggaacagggatgtacaaatatgatgataatgatgactcaggctgtagaccaatcagatatggagtttcatgcataggatttgactttatgctcaagatggacaaataccctttctttaatgcattcataggccataaaactcccttagaatcatttgctgataaaataattgagaaagaagaagaaacatgtgagatagggacaaacaaagagtttaaatgtttcgaggagagagcttacataaaggggacatgtccgactaacatcaatgcagtccattacattgacaataaaggcaaattgcgatatgtgaaatgtaaggaaaatctggagatgactgaggattgtgctttctgtaggaaaatcaagaagaaagctggtcagtctgttcaggtgcagaaaacttcagtctcacttcaagatgcaatttgtcaagaaaattcagacaattattctggaccaaagataccctttaaaggggtttgcaagattggtctaatcaaatataaagagtgcaagttcaaaacgtcttcttatgagactgtctcattcataacactcaaggagaaagggaagatttatattgaacacctaatgttgaaaaatatagaggtagttacgaatgtctcttttgtttgctacgaacatgcaggtcaggatgagcaagaggtagaacacagggctttgaagagggtatcagttaatgattgtaagattgtggacagctccaagcagaaaatttgcacaggagatcacgttttctgtgaaaagtttgattgttcgacatcttatccagatgttacttgtatccatgcgccaggatcaggaccattgtacataaatctcatgggctcatggataaaaccccaatgtgtgggctacgagagagtcttagtagacagggaagtcaagcagccattgcttgcaccagaacagaactgtgacacctgtgtttcagagtgtctagatgagggggttcatataaagtccactggctttgagataacatcagcagtagcctgctcacatgggtcttgcatttcagctcatcaagaggcgtccacatcagtaattgtcccatacccaggattattggccagtgtgggcggaagaattgggattcacctctcacatacttctgattctgctagtgtgcacatggtagtggtttgccctcctagagacagttgtgcagctcacaattgcttactatgctatcatggtatcctaaattatcagtgccattcaacattaagtgccatcctgacttcctttctattaattctcttcatatatactgttttttctgtgacaacaaatatgttatatgtgctcagactaataccaaaacagctaaagagtccagtgggatggctcaaactcttcatcaactggctgctaactgctctaagaatcaaaactagaaatgttatggggaggataaaccagagaataggatgggttgaccatcatgatgttgagaggccaaggcacagagaacccatgagaagattcaaaacaactctattgttaactctgataatgatgactggagggaatgcttgctccaatacagtagtagctaattcaaagcaaaccagatgtgtacaggaaggatcaaacacaaagtgctcaatcactgcaactataactttaagggcaggcgtgattggtgcagagtcatgttttataataaaaagccctatggagaatcagcagaagacaatatcaatcaaaaccatctccagtgagacagtatgcagggagggatcaagcttctggactagtttatatatcccatcatgtcttagctctaggaggtgccatcttgttggtgattgtgtaggcaataaatgccagtcgtggagagatgatcaactatctagggaattttcaggagtaaaggataaccatattatgaacgaaaataaatgctttgaacagtgtggcgcaattggttgtggttgctttaacattaatccttcctgcttgtacgttcatgcttacctcaagagtgctagaaatgaagcagttagggttttctcatgttctgattgggtacacagagtttcttttgaagtgaaaggtcctgatggtgaaacagagctggtcacattgggaagcctaggcactaagtttttaaactggggcaccctgtctttatccctggatgcagaaggcatcagcggaaccaacagcatcagctttctggaaagtagtaaaggaggatttgccttatatgatgaaggctacagtgagataccaagagagggatttcttggtgagataaggtgtagttctgaatccgcagctatatcagctcacaagtcttgtattagagctcctggtttaatcaagtacaagcccatgacagatcaaatagaatgtactgcatctttagtggatccattcgcaattttccttaaaggatctcttcctcagactagaaatgggcaaacattcaccagcacaaaagacaagaagacagtccaggctttcactaatggagcgataaaagcactattgtctattaatttggatgatcatgaaattatctttattaacaaagtgagaagctgtgatgcaacatttctaaatgtcagtggttgctactcctgtgattatggagctcatgtctgtgtgaaagtcaaatcttcagagtcagctgatttctttgcagaatcagaagacaagacaacagttttatctttcccaatacagtctggcacccatgattactgtcaggttttacattttcaaaaaccattagtagatgaaagactatcatattcttgtggatctgagcctaagctgatagtgatcaagggaacactggtttacatgggtgtctatgatttcagaaacaaaacaggtggttcttcaacagtagtaaatccttcagaaggtgcttggagcatttcaaattggttttctggccttctagactggttaggtgggcctatgaaggccataataaagattctgggctttattgccattggggttgtctgcttcattttattcatgattctgatcagaattgcagtcaactcaataaacatcaagaagaaaaactag

SEQ ID NO: 4337 - RNA, 3945 nt, synthetic construct
  misc_feature 1..3945: note = derived and/or modified CDS sequence (wt) from PTV(Adames)__DQ363407.1__GP
  source 1..3945: mol_type = other RNA
atgatttttacaattttaaatgttttaacaagagccatgctcgttatgagcatgtactctttaacaacgtgggacagctccagtaggaatgacatatgtttttctaacgactcacctctagagggccttgtctactactgggagacacactcaaaaaaacatgactataagaaacaaggttctcagaagtgtagagttggagattctgataaaaagatgatttctaatgttacaataatctctctaatttctgaaatacaaaaaagcatctctgagctatcactgtcatgtggtaataatgacaattctactggacaagtcttgacattcaatggattagaagatacaatacgaggcgactacattgtggactgtgtgactggattataccagtcagacattggagtcggtgtagggctggggagaatcaaccatgatcatcagcaagtaaaaaataaagcagttgttatagatgagaaagaaaaaatgatatcacttctagagactcaacaaagtgagaatgacataaagacacaagtactgatgtctgaaattgaacaactgaagaatcaactatcaaaaagacgaaatgagaggggacaggagaagagagatgctgaaaagctgatgtcagacctgatggctagaaattctgacttacggaatcacaatgttattctaactgacgaaatatctcaaataaaaaataatatcacaattcacagaaacagaaacatgatgagtactactgtggtcccagcaatactttcggtggctctgctatcatcatcagttggtcccattacggctgcacctccagattcaactatgatcaatccatggcctcatgcaaaaaatagagttggcacaggaatgtacaaatatgatgaaaatgatgagtcagggtgtagaccaatcagatatggtgtttcctgcataggatttgatttcatgcttaagatggataagtatcctttctttaatgcatttataggtcataaaactcctttagaatccttcgcagataaaataattgagaaagaagaagagacatgtgaaataggaacaaacaaagagtttaaatgttttgaggagagagcttacataaaggggacatgtccgaccaacatcaatgcagttcattacattgacaataaaggcaagttgcgatatgtaaaatgcaaagagaatctggaaatgactgaagactgtgctttctgcaggaaaatcaagaagaaagctggtcagtctgttcaggtgcagaaaacttcagtaccgttacaagatgcaatttgtcaagagaactcagacatttactccggaccaaagatacctttcaagggagtttgtaagatcggtctaataaagtataaagagtgtaagtttaaaacatcatcttatgagaccatttcattcatcacactcaaagggaaaggaaaaatttacattgagcacttgatgttaaaaaacatagaggtggtcacaaatgtttcttttgtttgctatgaacatgcaggtcaagatgatgaacaagaggtagaacacagggccctgaagagagtatcagtcaatgattgtaagattgtggacaactctaagcagaagatttgcacaggagaccacattttctgtgagaagtatgactgttctacatcttatccagatgtgacttgtatccacacaccaggatcagggccattatacataaatctcatgggctcatggataaaaccccaatgtgttggctacgagagagtcttagtagatagggaggttaagcagccattgcttgtaccagagcagaactgtgacacctgtgtttcagagtgtctagatgaaggagtacacataaaatccactggttttgaaataacatcagcagtggcctgctcacatggatcctgtatctcagctcatcaggaagcatccacatcagtaattattccatatccaggcttgttggctagtgtgggcgggagaattgggatacacctctcacatacttctgattctgctagtgtacacatggtagtggtttgccctcccagagatagttgtgcagctcataattgcttactatgctatcatggcattctgaactatcagtgccattcaacactgagtgctatcctgacttcctttctactaattcttttcatatacactgctttttctgtgacaacaaatgttttgtatgtgctcagactaataccgaaacagctgaaaagtccagtgggatggctcaaactctttgtcaactggctactaactgctctaagaatcaaaactaggcgagtaatggggaggataaatcagagaatagggtgggttgatcatcatgatgtagagagaccaaggcacagagaacctatgaggagattcaagacaactctattgctaactctgataatggtgacaggaggaaatgcctgctccaatacagtagtggccaattcgaagcaaaccagatgtgtccaagaaggatcaaacacaaagtgttctattactgcaactataactttaagggcaggtgtgattggtgctgagtcatgtttcataataaaaggccccatggaaaaccagcagaaaacaatatcaattaaaaccatctctagtgagacagtatgcagagaaggttcgagtttctggaccagtttgtacatcccatcttgtcttagttctaggagatgtcatcttgttggtgattgtgtgggtaacaaatgccagtcatggcgagatgatcagctatccagggagttttcaggagtaaaggataaccatattatgaatgaaaataaatgctttgaacaatgtggtgcaattggctgtggttgtttcaacatcaatccttcctgcttgtatgtccatgcttatctcaagagtgctagaaatgaagcagtcagggtattctcatgttctgactgggtgcacagagtttcctttgaggtcaaaggccctgatggcgagatggagttggtcacactagggagcctgggcactaagtttttaaactggggcactttgtcattatccttggatgcagaaggtatcagcggaaccaacagtatcagttttttggaaagtagtaaaggagggtttgctctgtacgatgaaggatatagtgaaataccaagagaaggatttcttggagagataaggtgcagttctgaatccgcagccatatcagctcataagtcatgcattagagctcctggtttgatcaagtacaagcccatgacagatcaaatagaatgtactgcatctttagtagatccatttgcaattttcctcaaaggatctcttcctcagactaggaatggacagacattcaccagtacaaaagacaaaaaaacagtacaggccttcaccaatggagcaataaaagcattattgtcgattaatttagatgatcatgaaatcatctttattaataaagtgaaaagctgtgatgccacatttttaaatgttagtggatgctactcttgtgattatggagcacatgtctgtgtgaaagtaaagtcttcggagtcagccgacttctttgcagaatcggaggacaaaacaacagtcctgtcttttccaatacaatctggcacacgtgactactgtcaggttttacattttcaaaagccattagtagatgaaagactttcatattcttgtggatctgagcctaagctgatagtgattaagggaacattagtttacatgggtgtctatgattttagggataaaacaggtggttcttcaacagtgataaatccttcagaaggaacctggagcatctccaattggttttctgggcttctggactggctaggtgggcctatgaaggccatactgaagatactgggcttcattgctattgggattgtttgcttcattttgttcatgattctgattagaattgcagtcaactcaataaatatcaagaagaaaaactaa

SEQ ID NO: 4338 - RNA, 3942 nt, synthetic construct
  misc_feature 1..3942: note = derived and/or modified CDS sequence (wt) from PTV__M11156.1__GP
  source 1..3942: mol_type = other RNA
atgatttttacaattttaaatgttttaacaagagccatgctcgtaatgagcatgtattctttaactacgtgggacagcaccagcagaaatgacatgtgcttttctaatgactcacctctagaaggcctagtttactactgggagacacactcaaaaaggcatgactataagaagcaagagtctcagagatgcagagttggagattcagacaaaaaaatgataactaatgtcacaataatctctctgatttctgaaatacaaaaaagcatctctgagttgtcactatcatgtgtcaatgatgacaattctactggacaagtcttaacattcaatggattagaagacacaatacgaggtgattacattgtagactgcgtgactggcttgtatcagtcagatattggagtcggtgtggggctagggaggactcaccatggtcatcagcaaatgaaaaacaaagcagttgtaatagatgagaaagaaaggatgatatcactcctagagactcaacaaagtgagaatgacataaagatgcaagtactaatgtctgaaattgaacaactgaagaatcaactgtcaaagaagcgaaatgagagaggccaggagaaaagagatgctgagaaggtgatgtcagacttgatggccaggaattctgacttacggaagcataatgacattctcactgctgaaatatctcagatgaaaaataaaaacacaatccaaagaaataaaaatacagtgagtactactgtagtcccagcaatactatcagtggccttactgtcatcatcagttgctcccattatagctgcacctccagattcaccgatgattaatccatggcctcatgcaaaaaatagagttggcacaggaatgtacaaatatgatgaaaatgatgactcaggctgtagaccaataagatatggagtttcatgcataggatttgactttatgctcaagatggacaaataccctttctttaatgcattcataggtcacaaaactcccttagaatcttttgctgataaaataattgagaaagaagaagaaacatgtgagataggaacaaacaaagagtttaaatgtttcgaggagagagcttatataaaggggacatgtccgaccaacatcaatgcagtccattacattgacaataaaggcaaattgcgatatgtaaaatgtaaggaaaatctggaaatgactgaggattgtgctttctgtaggaaaatcaagaagaaagctggtcagtctgttcaggtgcagaaaacttcagttccactccaggatgcaatttgtcaagaaaattcagacacttattctggaccaaagataccctttaaaggggtttgcaaaattggtctaatcaaatataaagaatgcaagtttaaaacatcttcttatgagactgtctcattcataacactcaaggagaaggggaagatttacattgagcacctaatgttgaaaaatatagaggtggttacgaatgtctcttttgtttgctacgaacatgtagggcaggatgagcaagaggtggaacatagggctctgaagagagtatcagttaatgattgtaagattgtggacaactcaaagcagaaaatttgcacaggagatcacgttttctgtgaaaagtatgattgttccacatcctatccagatgttacttgtatccatgcgccaggatcaggaccactgtacataaatctcatgggctcatggataaaaccccaatgtgtgggctatgagagagtcttagtagacagggaagtcaagcagccattgcttgcaccagaacagaactgtgacacctgtgtttcagagtgtctagatgagggggtccatataaagtccactggttttgagataacatcagcagtagcctgctcacatgggtcttgcatctcagctcatcaagagccatccacatcagtaattgtcccatacccaggattgttggccagtgtgggcggaagaattgggattcacctctcacatacttctgattctgctagtgtgcacatggtagtggtttgccctcctagagacagttgtgcagctcataattgcttgctatgctatcatggcatcctaaattatcagtgccattcaacattaagtgccatcctgacttcctttctattaattctcttcatatacactgtcttttctgtgacgacaaatatattatatgtgctcagactaataccaaaacagctaaagagtccagtgggatggctcaagctcttcatcaactggctgctaactgctctaagaatcaaaactagaaatgttatgaggaggataaaccagagaataggatgggttgaccatcatgatgtagagagaccaaggcacagagaacctatgagaagattcaaaacaactctattgttgactctgatcatgatgactggaggaaatgcttgctccaatacagtagtggctaactcaaagcaaaccagatgtgtacaggaaggatcaaacacaaagtgctcaatcactgcaactataactttaagggcaggtgtgattggtgcagagtcgtgctttataataaaaggccctatggagaatcagcagaaaacaatatcaatcaaaactatctccagtgagacagtatgcagagagggatcaagcttctggactagtttatatatcccatcatgtcttagctctaggaggtgtcatcttgttggtgattgtgtaggcaataaatgccagtcgtggagagatgatcagctatctagggaattttcaggagtaaaggataaccatatcatgaacgaaaataaatgctttgaacaatgtggcgcaattggttgtggttgttttaacattaatccttcctgcttgtacgttcatgcttacctcaaaagtgctagaaatgaagcagttagggttttctcatgttctgattgggtgcacagagtttcttttgaggtaaaaggtcctgatggtgaaacagagctggtcacattgggaagtccaggcaccaagtttttaaactggggcaccctgtcattatccctggatgcagaaggcatcagcggaaccaacagcatcagctttctggaaagtagtaaaggaggatttgccttatacgatgaaggctacaatgagataccaagagagggatttctaggtgagataaggtgtagttctgaatccgcagctatatcagctcataagtcttgtattagagctcctggtttaatcaagtacaagcctatgacagatcaaatagaatgtactgcatctttagtggatccattcgcaattttccttaaaggatctcttcctcagactagaaatggacaaacattcaccagcacaaaagacaagaagacagttcaggctttcactaatggagcgataaaagcgctattgtctattaatttagatgatcatgaaattgtctttattaacaaagtgaaaaactgtgatgcaacatttctaaatgttagtggttgctactcctgtgattatggagctcatgtctgtgtgaaagttaaatcttcagagtcagctgatttctttgcagaatcagaagacaagacaacagttttatctttcccaatacagtctggcacccatgattactgtcaggttttacattttcaaaaaccattagtagatgaaagactatcatattcttgtggatcagagcctaagctgatagtgatcaagggaacattggtttgcatgggtgtctatgatttcagaaacaaaacaggtggctcttcaacagtagtaaacccttcagaaggtgcctggagcatttcaaattggttttctggccttctagactggttaggtgggcctatgaaggccatactaaagattttgggctttattgccattgggattgtctgctttgttttattcatgattctgatcagaattgcagtcaactcaataaatatcaagaagaaaaactag

SEQ ID NO: 4339 - RNA, 3852 nt, synthetic construct
  misc_feature 1..3852: note = derived and/or modified CDS sequence (wt) from Phlebovirus(CoAr170255)__HM566149.1__GP
  source 1..3852: mol_type = other RNA
atgtataaacttataacaaatattttaaaactctcagtggtgtctgccatgtacagcatcatgttctgggacccaactggtatatctaaactttgcctgagcaacaattcacccctagagggtcttgtttattactgggaaaacactatgagagaaggcgagttcaaaagagaaaagaggaagaagtgtcgtttaggaatatctgagccagcccctgtcagtaatcagacaatagtatctcttattgaggaggttcaaaaaagtcctgctgagatgattttgatttgtgaggctaatggaaatagtacaggaagctctctatcatttgatggtctttctgataatgagataaaacctagcattgttgactgcacaacaggtgatagaacctctgacttacgtgttcttgttgggaagggtatatttgagaagaaaatgagtatgtctaatgagattgatagggttgtgtcactagaagatcatctacagagagaaaaggaattggttcaaacattccaggatctgcaccataatgaatctgaaaagaataaactattagagcatgagttagaaaatgtccgtcagcagttaaagagggaaagagaatctaacaagattaagatgtggaccacaaaaagaccagaaatcaccacaattgggctgacaacgactattgcaacaatcctcttggcatcacaatctgtagcctcctcagtccccatgcctggacaattaaacacatggccacatgccaaaaatagagtggggggaggagtgttcaaagctaatgatgatgatgaggatagttgtaaactaattgattatggaatagcttgtcatggttttgactatcttttgagaactgacatttatccattcttcaatgcgcatgtaagccacagatcattacttgaagctagtaatgagggcattatattaaaagacgaggcgtcatgtgaaatagaaacaaacaaggacttcaagtgctatgaagagagagcttttctgaagtggtcctgcccacatctggtgaattcagctcattttattgatagtaagggtaagctacgtataattaaatgcaaagctgagtacgagataacagaggactgcacgtactgtagacggatcaagaaaaaagccgcacaacaaaaacaagtttataaatcttctattgctcttcaagatgcagtttgccaggaaaactcagattattatgatggaccgaggatcactttcaccggagtctgtaaaattggaacaatggagtataaaaaatgcaaacacaaatcctcctcatttgagaacataggctttatcacaattagggacaagggcaagtactatatagaaaatatgagaactaaaaacattgagatggtttctaatgtctcttttatctgttataatcacaatggtcaggataccgagaaggacgtgcgattactaaagagagttaagccaggggactgcaaagttgtcgatgacagtaaaactaaacactgcacaggagatcatgtattttgtgaaaaatacgattgcaccaaatcttacccagaggcaacctgcatgcatgccccaggctcaggacctatactagttttggtgatgggagtatggtttaaaccacagtgtgttggctatgagagagttctggtcgagagagaagtcaaggctccagttttgatccaagagaaagactgtgacacatgtgtgtttgagtgtctggaggacaagattttgatcaagtccaccggattcaagatgatctctgctgttgcctgctcacatgggtcttgtgtctcatcccatcaatccccctctacctttctctacattgattatcctggactcacagcatcagttgggggtgagattggattacacttgtctcacacagatgattcggtaagtgtgcataagaagatccattgtcctgcaagggatccttgtgaagcccacagctgcatagtgtgttatcatgggctagtcaattaccagtgccacacagtcctaagctattctgtagtgtccttccttcttgtctgcatgatgtatctggccttctttattactagtagattgctgttctttctcaggataatgcccagaagactgaggaacccaatcagctggctaacactacttattaggtgggttttgcagactttgttggcgatcttacgactatcttttaagaagctgagtgagacaattggctggaattctcctaataacagacaacagatggatgtggaagctaacagaaggcctctcaggaggtatagaaccacttttattctcactttattatttgtagggctaactagtgcttgctcaaacactgcagtgtcaaattccaaacagaccaagtgtcttcagtctggaggatctgtaaaatgttcaattacagcaaccattaccttaaaagcaggcaccataggagctgaatcttgttttattatcaagggtccatcagaaaaccaacagaaggttataagagttaaaacagtctcaagtgagacagtttgtagagaaggatctagtttctggactggacaattcactcctagctgtgtcagctctagaagatgccacttggtaggggactgtgtagggaatagatgtcaagcttggagagatgaagttgtgtcaagagaatttggcaatatgaaggataacaatgtaatgtctgaaaacaagtgttttgaacaatgtggagcagcaggttgtggttgcttcaatataaatccatcatgcttgtatgtccattccacattcaaaagtgtgaggagagaggcaattcgggtatttaagtgcaatgactgggtgcacagactaacctttgaagttagtgggccatctggagagaaagacagaatagttctcaatagtctcagtacaaaatttctccaatggggaaccatctcattgagtcttgatgcggaaggaatatcagggacaaatagttattcattcttggaaagcaacaagggtggatttgctatacatgatgaggagttctctgaaattccaagagaaggatatttaggtgaaattcgctgctcctctgaatcagcagtcatagcagcacacaagtcctgcataagggccccgaatctaataaaatataagcctatgactgatcaaatagattgtacagcttctttggtggatccatttgcaatctttttaaaaggatcactacctcaaagcaggtctggatatacattcacgagctcaactgacaaaaagactgtgcaggcctttaatagtggctcgatcaaggctttgatttccattaatatggatgatcatgaaatagaattcctaaatgacgcagctgactgtgatgcaactttcttaaatgtttcaggatgctactcttgcaattatggggctcaagtttgcattaaagtcaggtcatcaaaatcatcaatctttagctctaataataatgacaactccattgtaataaactttgatgcagatcaagggactagggattattgccggataatacatttcaatgggccattagtagatgagactctacattatagctgtggaggtgaatctaaactcttacaaatgaaagggtcactaataacagtgggcccctatgacttcagaaacacgactgggggaaaatcaacgattgtcaatccacatgaagagtcatggaatctcttcagctggttctctggtcttttagattggctgggtgggccactacgagcaattctgaaaattgtgctaatcattatcattggaatcatattgttcattgttgtagccttcctcataagacttgtaatattcaatgttttgctaaagtcaaaaaagaactaa

SEQ ID NO: 4340 - RNA, 3873 nt, synthetic construct
  misc_feature 1..3873: note = derived and/or modified CDS sequence (wt) from Phlebovirus(CoAr171616)__HM566154.1__GP
  source 1..3873: mol_type = other RNA
atgtttcagattatatacttactaaccaagctgtacctggtatcatccatgtatagcattatgttttgggagaatgaaaatatatccaagctatgtcttagtaacaattcacccctagagggtcttgtttactactgggagaatgtgatgaaagagggagactttaaggaagaaaagagaaaaaaatgtagaattggtccttctgatctgaagagggtaactaatcaaacattaacaactttgatcgaagaagtgcagaaaagcccctccgagatccaactactgtgtgaagaagatggcaataagacgggaatatcaatgttttttgatggattgtcagatgacatctcaaccccaagcatagtagactgcaatggcaatatcaggatttcagatctaagggttcaggtgggaagaggtcattttgaaaaggagaatgagataagaaagatagaagaaatagtgactttagaagatgatcttaggagggaaagagacctaaacaagttgctacaggatttgaataagaaggatgcagaggagagaagaattattgaacatgagctaaccaatatgagagagcagctgcagagagaaagagagaggagcaagcaacaaattaaggaacatgagaagattgaagtgaataaccacaaagagcctgcaactcatttaaatgtgtcaaaactcttaacaattgggctcctggctcaacaggttggacaagtaatagctacagaacctggtcagctgaacacctggatccatgcaaagaataggataggaaaggggttatacaaaacagaagacactgatgaggatggatgtagaggcttggattatggtgtcagttgcttaggttttgactacttgcttagaactgatatatatccctttttcaattcttttgttagtcacttatcaatgcttgaggctagcacagaagatctaattgagaaagagggaacatcttgtgagatagaaacaaataaagagttcaagtgttatgaagaaagagcattcataaaaggctcttgtcctcatttagttaattcagcacattttctagataacaaggggaagctcagaatagtcaaatgcaagacagattttgaaatgacagaagactgtacattctgcaggaaaattaaaaagaaaaatagccaacacaagcaggtttttaagacatctattgctctgcaagatgctgtatgccagaacaactcagatctatataatggccctaggattgtatacagtaatgtgtgtaaaattggaatggtttcctacaagcagtgtaagtctaagaccagtagttatgagtctgttggctttgttattctgaaagggaaagggaagttttacatagaaaacatgaagataaaaaatatcgaagtgatcgctaatgtttctttcatttgtcatcagtatcaaggtcaagatggaacagaaaaggagcagagatctctcaagagaattagtgttggagagtgtaaaagtgtgaaccctcagaagacaaagcactgcacaggtgatcatgtgttctgtgagaaatatgactgcactaaatcctatcctgaagtgacctgcttaatggcacctggttctggacccattctagtccaaattatgggttcttggattaaaccacagtgtgttggttatgaaaaagtgctagttgagagagaggtgaaatcgccaactctcactgaagagagagactgtgacacttgtgtatatgaatgcttagaagataaaatattgataaaatcaacaggcttcaagatgatctctgctgtggcatgctcacatggcatgtgtgtatcatcacatcaggagccttctacattcttgtacataaactaccctggaatgagcgcatcaataggaggagagattggactgcacttgtcacacactgatgactctctaagccttcacaaggtgatatcgtgtccatcacgaaacccttgtgatgtacatagctgcattatttgctaccatggtataatcaattatcaatgtcatacagctcttagttacacaattgttgcattttctttcatatcttttctttatctgacattcaaagtgatcagtcaactactttacacttttaaggttgtccccaagaaattaaaaggccccttctactggatgggatacctgattaaatggatagtgaagaccattttgggagttgtaagaaataccttctttactatgagcaataggattgggtgggaaagaagagatgaaatccatgaggatatagaagcaaatccaagacggcacttgcagagatttaagaccacatttgtattaaccatgttaatgatcaatggaggtttatgttgctcaaatactctggtatcaaactcaaagcaaactcgatgtgttcagtcaggaaacgaggttaagtgctctgttagtgctacagtagtcttgaaagcaggagttataggggcagaatcttgttttataataaaaggaccatctgagaatcagcacaagatgataagtgttcgaacactttctagtgaaactgtttgtagggaaggagcaagcttttggacaggccatttctcaccctcctgtgtaagttctagaagatgccacttagttggagaatgccatggaaatagatgtcagtcttggagggatgatcagatttctcgagagttcgggggcgtaaaagataataataggatgtcagagaataagtgttttgagcagtgtggatccattggctgtggttgttttaatatgaatccatcatgcttgtacgtacacaccactcttaagagtgctaggaatgaagcagttcgagtgttcaaatgtaatgattggattcaccgtttaaatttcgaggtgattggaccatctggagagaaggatgtagtaaccctgaatagcatgagcactaaatttttgcaatggggcactatatcactcagtcttgatgcagagggaattactggaacaaacagctattcttttctagaaagtagtaagggtggatttgctatccatgatgaggagttctcagacatcccaagggaaggctatttaggggaaattcgatgctcatcagaatctgctgtaatatcagctcactcctcatgcataagagctcctgacttgataaagtataagccaatgacagatcaaattgagtgcacatcaactttaatagatccatttgccattttcatgaaaggatcactaccccaaacaaggtctggctatacattcacaagctccaaggataagaaaaccattcaggctttcaatacaaattctattaaggctctgatatccttaaatttagacgaccatgaaattgtctttgtgtctgaccaaacaaattgtgagtgcacatttctaaacctcacaggttgttactcctgtgattatggagcacatgtgtgttttagaatcaaatctgacaaaaagggtgtctttgttagcaatacagaggcaaaagatatttcttttggctttgaagttttaacaggtactcatgactattgtcaaatacaacattttaacagcccatcagtgtacaaaactttaagttacagttgcgggggagaatcaaaattactggtcattaaggggtcactaataaccataggtcctcatgattacagaaacaagacaggaggggcttccactgttgtgaatccctctgaggaaggatggagtgtgaccaactggattggtggctttatatcctggttaggaggaccactgaaggccttactaaaaatagccgtgacaatactagccggagtagtgatatttctcatcatatatttcttcttaaggctaattgcaacaaatatcttgatgaagactaaaaagaactaa

SEQ ID NO: 4341 - RNA, 3852 nt, synthetic construct
  misc_feature 1..3852: note = derived and/or modified CDS sequence (wt) from Buenaventura virus(CoAr3319)__KP272002.1__GP
  source 1..3852: mol_type = other RNA
atgtataaacttattactaatatcttaaaactctcaatggtgtctgctatgtacagcatcatgttttgggatcccactgggatatcaaaactctgcctgagtaataattcaccattagagggtcttgtttattactgggaaaataccatgagagaaggtgagttcaagagagagaagaggaaaaagtgtcgtttagggatctctgagccagcccctgtcagcaatcagacaatagtgtctctcattgaggaagttcagaaaagtcctgctgagatgattctgatctgtgaaaccagcggaaatgctacaggaagctctctatcatttgatgggctttctgataatgaagttaaacctagtattgtcgactgtgccacaggtgaaagaacatcagacctgcgagttctggtcgggaagggcacctttgaaaagaaaatgagcatgtcaaatgagattgatagagtggtctcactagaagatcatctacaaagagaaagggaattagttcaaaccttccaagatctgcaccataatgagtccgaaaagaataagctgttggaacatgaactcgaaaatgtacgacagcaattgagaagagaaagagaatctaataaggttaaagtgtggactaccaagaaaccggaggtcaccaccatagggctgaccacaactattgcaacaattctgttagcatctcaatccatagcctcctctgttcccatgcctggccagctgaatacatggccacatgcaaaaaatagagtgggaggaggtgtcttcaaagccaatgatgatgatgaagacagttgcaaactgattgactacggaatcgcctgccatggctttgactacctcctgagaactgatatatacccattctttaatgcacatgtgagccatagatcaatgcttgaggccagcaatgagggcatcatattaaaagatgaggcatcatgtgaaatagaaacaaataaagatttaaaatgttatgaagagagagcctttttaaagtggtcctgcccccatctggtaaactcagcccatttcatagatagcaagggcaaattacgcataataaaatgcaaagctgaatacgagataacagaggactgcacttattgtaggcgaatcaagaagaaggctgctcaacaaaaacaagtatacaagtcctctattgctcttcaagatgcagtctgccaggagaactcagactattatgacggaccaaggattactttcactggggtttgcaaaattggctcaatggagtacaagaaatgcaaacacaagtcctcatcattcgaaaacgttggcttcataacgattagagacaaaggtaagtattacatagaaaatatgaggataaagaatattgaaatggtttctaatgtttctttcatctgctacaatcacaatggtcaagacactgaaaaggacatacgattactaaagagggtcaaaccaagcgactgcaaggttgtggatgatagcaaatctaagcactgcacaggggatcatatattttgtgataaatacgactgcaccaaatcatatccagaagcatcctgcatgcatgctccaggctcaggacccatattagtcttagtaatgggagtctggttcaaaccacagtgcgtaggatacgaaagggttctggttgagagagaagttaaagttcctgttttgacccaagaaaaggactgtgacacatgtgtatttgaatgccaagaagataagattctaattaaatcaactggatttaagatgatctctgctgttgcttgttcacatgggtcctgtgtctcatctcatcagtctccttctacttttctctatattgattatcctggtttaacagcatcagttggaggtgagattggactacatctttctcatactgacgactcgataagtgtgcacaagaagatccactgtccagcaagggatccttgtgaggctcacaactgtgtgatatgctatcatgggctaatcaactaccagtgccatacgttcttgagttactctgttgtgtcctttctcttcattagcgtattatacttgaccttctttattgtaagcagattactgctgttcctcaagataatgcccaaaagactaaaaaatccaatcagctggctaactttgctcatcagatgggtgctacagaccttgataacgatcctacgtctatcatttaagaagctgagtgagacaattggctggaccactaatgacaataggcagcatgttgatgtagaagcaaacagaaggcccctcaggagatataggaccacctttattctaactttgttgtttataggtttagctagtggctgttcaaataccgctgtgtcaaattctaagcagaccaagtgtcttcagtctggaggttctgtgaaatgctcaataacagcaaccatcaccctaaaagcaggtatcataggagctgagtcctgtttcattatcaaaggtccatcagagaatcagcaaagagttataagagttaaaacaatttcaagcgaaacagtctgtagagaaggatctagcttttggactggtctattcactcctagctgtgttagctctagacggtgccacttggttggggactgtgtagggaataggtgtcaatcttggagagatgaagttgtgtcaagagaatttggtaacatgaaggacaacaatgcaatgtctgaaaacaaatgcttcgaacagtgtggagcagcaggctgtggttgcttcaatataaacccttcatgcctgtacgttcactcagtattcaagagtgtgagaagagaggcaattcgggtcttcaagtgtaatgactgggtacacaggctgacttttgaggttagtgggccatctggtgaaaaagacaggatagttctcaatagtctaagcactaaatttcttcaatggggaacaatctcactgagtctggatgcagaagggatatctggaaccaatagttattctttcttagagagtaacaagggtggattcgcaatacacgatgaggagttttctgaaatcccaagagagggatacttgggtgagattcgttgttcttctgaatcagcagtcatagcagcacacaaatcttgcataagggccccgaatctgataaaatataagcctatgacggaccaaatagactgcacagcttctctggtagatccttttgcaattttcctgaaaggatcattgccccaaagtaggtctggatatacgttcacgagctcaactgataaaaagactgttcaggcctttaatagtggggcaattaaagcattaatttctattaacctggatgatcatgaaattgagttcctgagtgacacagctgattgtgatgcaacatttctgaatatttcaggatgctattcctgcaattatggggctcaggtctgcattaaagtcagatcatcaaaatcatcaatcttcagctctaacaacaatgacaactctattgtgattaactttgacgcagagcaaggaactagagattattgcaggataatacacttcaatggaccattagttgatgagactctacattacagctgtgggggtgagtccaaacttttacagatgaaaggatcactaataacagtgggcccttatgacttcaggaatacaactggaggaaaatcaacagttgtcaatccgcacgaagagtcctggaatctctttagctggttctcagggttacttgattggttaggaggaccattgcgagcaattttaaaaatagtgctaatagtgatcattgggatcatactgtttattgttgtggttttcctcatgagacttgccatattaaacgttctactaaaatccaagaaaaactag

SEQ ID NO: 4342 - RNA, 3942 nt, synthetic construct
  misc_feature 1..3942: note = derived and/or modified CDS sequence (wt) from Cocle virus(GML244915)__KP272034.1__GP
  source 1..3942: mol_type = other RNA
atgatgtttacacatttagatgttttaacaagggcaatgctcgtaatgagcatgtactctttaaccacgtgggacagtatcaggagaaatgatatttgcttctcaaacgactcacctttagaaggcttggtctattactgggaaacacaatcaaagatgcatgaatataaaaaagaggactcacagaaatgcagagttggtgattcagaaaaaaagatgatttctaatgttacgatcatatctctgatttcggaaattcaaaagagtatatctgagctgtcactatcatgcgggaatgatgataattcaactgggcaggtcttgatgttcaatggtctagaagacacaatcagaggtgattacatagttgattgtttaactggcctctaccaatctgacataggagtgggtgtcggatcagggaaaactaaacacgaccatacaaagctgagaaataaagcagttataatcgatgaaaaggaaaaaatgatctccttgcttgaagctcagcagagtgaaaatgatatcaaaacacaagtgcttatgtcagagattgagcaattgaagactcaacttctgaatagacgaagtgagagaggccatgaaaaaagaaagaatgaggagattgtttcagatttgatggctaggaactctgatctacgaaagcacaatgatattctgaaagatgaaatggatcagataaaggaaaatctgacaatattcaaatcaagaaatgcgataagtactacttcagtcccggcaatcatgtcaattgcactattgtcttcctcggtaatgcccatcattgccgctgtgtctgattcaccaatgattaacccatggcctcatgcaaagaatcgtgttggatcaggaatgtataagtatgatgataatgatgaatcaggatgtagacccataaggtatggagtgtcttgcattggctttgatcacatgctcaagatggacaaatatccattctttaacgcattcataggacacaagactcttttagagtcttttgtggataagattattgaaaaagaggatgagacatgcgagattgggacaaacaaggaatttaagtgttttgaagaaagagcctatataaaagggacttgcccacataatataaatgctgtacactatcttgataataaaggtaagctccgttatgtgaaatgcaaggaaaatttggagatgactgaggactgtgcattctgtagaaagattaagaaaaaggctgggcagtcagtacaagtacagaaaacttctgtgcctctgcaagatgctatttgtcaagacaactctgacatctacacaggaccaagaattccatataaagggatgtgcaaaattgggctggtaaaatacaaggaatgtaaatccaagacctcatcttatgagactgtctctttcatcacattaaaaggaaagggcaagatatatattgagcacctcatgctaaaaaacatagaagttgtcactaatgtttcttttgtttgttatgagcatgctggtcaagttgagcaggaagtagaacatagagcactaaaaagagtgtctgttaatgattgcaagattgttgatagctcaaagcagaagatctgcacaggagatcatgtattctgtgagaaatatgattgctcaacgtcataccctgatgtcacatgtattcaagcaccaggatccggccctctgtatgttaatcttatgggatcatggataaaacctcagtgtgtgggatatgagagagttttagttgaaagagaagtgaagcagccactgttgacaccagaacaaaactgtgacacatgtgtttcagaatgtttagatgaaggggttcatataaagtctacaggttttgagatcacttctgcagttgcatgttctcatgggtcatgcatttctgctcatcaagaggcatccacttcaataattgtgccatatccaggcctattggctagtgtaggtggcaagataggattacatctttctcatacatctgactctgcaagtgtgcacatgatagttgtatgccctcctagagatagttgtgcagcacacaactgcttactttgttatcacggaatgttgaattatcaatgtcactcaacattaagtgctatcttaacatcttttctgctcattttatttatttatactactttctctttcattactaatatcttatacttgttacgtttattgcccaaacagctcaagagccctattgggtggttaaagcttttcattaattggttatttactattcttagaatcagaacgaaatacttaatgggcagactaaatcagagaataggctgggttgagaatcatgatgtagaaagaccaagacctagagagccaatgagaagattcaagacaactctcatgctcactatgctaatgataacgggtggctatgcttgctccaatacagttgtggccaattcgaagcagaccagatgtgtccaggagggatctaacactaagtgctcagttacagcaactgttacactgaaagcaggtgttataggtgcagaatcatgctttgtcattaaaggcccaatggaaaatcagcaaaagacgatatctattaaaactgtctctagtgaaactgtctgtagggaaggatctagcttctggacgagcttgtatatcccctcatgcctcagttctagaagatgccatcttgtaggggactgtgtgggaaacaggtgccaatcatggcgagaagaccaattgtctagagaattctcaggagtgaaggacaatcaaataatgaacgagaacaagtgctttgagcagtgtggtgctataggctgcggctgtttcaacataaacccatcatgcctatatgtccatgcatatctcaaaagtgctaggaatgaagcagtaagggtgttctcatgttctgactgggtccacagagtgtcatttgaggtcaaggggccagatggagaaacagagttagtcacactggggagtttaggtactaagtttttgaattgggggactctctctttgtcattagatgcagaaggcataactggcacaaatagcctaagttttttagaaagcagcaaaggagggtttgcactgtatgatgaaggtttcagtgaaattcctagggaaggtttcttaggggaaataaggtgtagttctgaatctgctgcaatctctgctcataaatcatgcattagagcaccaggcttgataaagtacaagcctatgacagatcagatagagtgcactgcatcattagtggacccatttgccatattcctaaaaggttcacttcctcaaactagaaacggacaaacttttactagcacaaaagacaagaaaacagtgcaagcattcacaactggggcaataagagctcttctatcaataaacttggatgatcatgaaataacgtttataagtaaaataaaaaactgtgaagccactttcctaaatgtgagtggctgttactcctgtgactacggagctcatgtctgcatcaagataaaatcctcagaatcagctgatttctacgcggagtcagaagataaaacaacagtgctatcgcttccggttagctcaggaactcaggattactgtcaagtgctacattttcagaagcctttagtagatgagaggttgtcatattcatgtgggtctgaacccaagcttatggtaatcaaggggacattagtctacatgggtgtttatgatttcagaaacaagacaggaggctcttcaactgtagtgaacccgtcagatgcttcttggagtattgcaaactggttttctggattattagactggttgggggggcctttaaaagccatcctaaaaatactcggattcatagcaatgggtgttgtttgtttcatactatttatgatcctgatcaagatagcagtcagatctgttaatatgaaaaagaaaaactag

SEQ ID NO: 4343 - RNA, 3873 nt, synthetic construct
  misc_feature 1..3873: note = derived and/or modified CDS sequence (wt) from Campana virus(VP-334K)__KP272041.1__GP
  source 1..3873: mol_type = other RNA
atgttacatttcataactataacaactaagttcttagctgttgcatccatgtacaacttattgtactgggaccctaacggtttatctagactgtgtcttagcaacaactccccattagaagggcttgtctactattgggaaaatttgatgaaagaaagtgatttcaaaaaagataagaagaaacattgcagaattggcactagcgtggctgcaccagtgacaaatgagactctgacaacattaattgaagaggttcaaaaaagcccatctgaaattattctccagtgcgagtcaaggaataatgatactgggaattcaatatacttcgatggtcttgcggacgatattgaatcacctagtattgtgaactgtgaatcaggtaaaagggaatcagatcttagagtcctggtaggtcagggactcaagaaagagatcattctgaatgaaattgctgcgattgacaggcaagcatccttagaagagcacctgaggggagaaaaagccttgacatcacttctgcaagagataagcaagcaggatgaagcagaaagaaagagattagagcacgaagtctccagtctcaggcaacagttaatgaatgaaagagaggagaacaaaaaaagaaaaaacatccctgcatttggtgtcagttctacaacctcatctagcctaatgaacattagcagagtggttactattgggctcctatctcagcaggccatagccaatccgtcactcccaggtcaagtgaacacttggcctcatgcgaaaaacagaattggtcaaggattatacagaattgacactagtgatgaggatgggtgcagaggactgaactatggtgttatttgcctgggatttgatcatctgcttaggatggatttgtatcctttctttaatgcttatgtgagccatctgtcattattagaggcatacacagagaacataattcaaaaggatgaaacagaatgtgagattgagggcggcaaagaattcaaatgttatgaggagagagcatatatcaaaggagtatgtccacatagaattaagtctgcacattacttagaccagaaggggaagctaaggatcataaaatgtaaggaaaatcttgaacttacagaggattgtacttactgcaggaagataaagaaagacagaggccacacaaaacaagtttataaaacctctgttcccctccaggatgccatatgccaggacaattcagatgattactcagggccaaagattagcttcaaaggtgtgtgtaaaattggcatgatagaatataaggaatgcaagtacaaatcctcttcttttgaaactgtaggattcatcaccatcaaggagaaagggaaattttatatagaagacatgaagctcaaaaatcttgaggtgaccaataatgtagcttttatctgtcatcagtacacaggtcaggatggaactacggatgaagaaaacagacacctaaagaggatgagtgtcaaggattgcaaaaatgttaactctagcaaaagcaagtattgtacaggggatcatatattttgtcaggtctacgactgcacaaagtcttatccagaagccacttgttttgtagccccaggttcaggaccagtcttagttcaggtcatggggtcttggataaaaccacaatgtgtcggttacgagaaggtcctagtagagcgagaggtcaagatgcctatcctcactgaagaaagagactgtgacacgtgtgtttatgagtgcaaagaagatcacatcttaattaaatcaacaggcttcaatatgatatcagcagtggcatgctcacatggatcatgtgtttctgcccaccaggatccctcaactttcttgaacatagagtatccaggaatgagtgcttctgttggtggtgagattggaatacacatatcacatacagatgactcactaagcctgcataaaaagatatactgtcctgccagagactcttgcgaagcacataattgtattatgtgttaccacggtctaatcaattatcagtgccacacagctttgagttatgcagtggtctcatttatgttcgttagtattgcttatgtgatttttaatgtgctaaggctagttttagtagctctccatgtagtaccaagaaagctaaagagtcctatcgactggctcattcttctaatcaagtgggtattcttactgttggctaaagtaataagagctttcctcacacacctgaatactactataggctggagagaaagacagaacaactttgcagcagatctagaggctcaaaggaggccactacaaagattcaaaaccacagtcctattgatgatgatgctcatcagcgtggtcagtagttgttctaattcagtagtctctaattctaaacagacaaggtgtattcaatcaggtagcaatactaaatgttctgtctctgctacaatcacactaaaagctggagttataggagctgaatcatgctttgtaataaaaggaccttctgaaaatcagcacaaaactattgttattagaactgtgtctagtgagaccatctgtcgagagggatcaagtttctggacaggacattttactccttcatgtttaagctcaagaaggtgccatctagtgggtgattgtgtcgggagtaggtgtcaaggttggagagaagatgttatttccagagaatttggtggagtgaaagacaataaccaaatgtcggagaataagtgctttgaacagtgcggagcagctggatgcggatgtttcaacataaatccatcatgcttatatgtacacaccatactgcgaagtgcaagaaatgaggctgttagagtattcaagtgcaatgattgggttcataaactgacattccatatcaaaggaccaaatggtgaagaggaagatgttgtcctgaatagccttagcacgaagttcctatcttggggcactatttccttaagtctggactcagaagggataacaggaacaaatagttattcgtttttagagagtagcaaagggggttttgcaattcatgatgaggagttttctgaaatcccaagagaagggttccttggagaaatccgctgctcgtctgaatcagctgttgtctctgcccataaatcatgcataagagctcccggcttaataaaatacaagccaatgactgatcaggttgagtgttctgcttctctagtggacccatttgcaatttttataaaaggttcactaccccagactcggtcgggatacacctttactagttctagagataagagaacaatccaggcctttaataatggagctataaaagcactcttaaccctaaatttggatgaccatgaagtgatcttctcagaatctgtaataacatgtgagtgcactttcctcaatatctcaggatgttattcttgcaattttggtgctcaggtatgctttaaaattaaatcaagcggcataggtgattttgtcagtagctcagagacaggaaatattctttttagttttccagtgaagtcagggacagaagactactgccagattcagcactttaatagtccaatggtgtcagagtcactacaatatagttgtggtggagaaagcaagttattgttaataaaagggtccttaatctctgttggtccttatgattataggaataaaacaggcggctcttcaacagttgtaaatccagcagaagactcatggagtattttcaattggctttcaggattcctagattggctaggaggacctcttcgagctttagttaaaatcgctcttgctattattggtgctcttgctctactattcatcaccatcatgctggccagatccgtgataagcaacactctatcaagaaagaagaaaaactga

SEQ ID NO: 4344 - RNA, 3594 nt, synthetic construct
  misc_feature 1..3594: note = derived and/or modified CDS sequence (wt) from RVFV(ZH-548)__DQ380206.1__GP
  source 1..3594: mol_type = other RNA
atgtatgttttattaacaattctaatctcggttctggtgtgtgaagcggttattagagtgtctctaagctccacaagagaagagacctgctttggtgactccactaacccagagatgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 4345 - RNA, 3594 nt, synthetic construct
  misc_feature 1..3594: note = derived and/or modified CDS sequence (wt) from RVFV(ZS-6365)__DQ380205.1__GP
  source 1..3594: mol_type = other RNA
atgtatgttttattaacaattctaatctcggttctggtgtgtgaagcggttattagagtgtctctaagctccacaagagaagagacctgctttggtgactccactaacccagagatgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaagaagatcaaaccaagttcttaaagataaaaactgtctcaagtgagctatcatgcagggagggccagagttattggactgggtcctttagtcctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgtccaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctcttttttctccttatatatcttggaagaacaggcctctctaaaatgtggcttgctgccactaagaaggcctcatag

SEQ ID NO: 4346 - RNA, 3594 nt, synthetic construct
  misc_feature 1..3594: note = derived and/or modified CDS sequence (wt) from RVFV(CAR-R1622)__DQ380219.1__GP
  source 1..3594: mol_type = other RNA
atgtatgttttattaacaattctaatctcggttctggtgtgtgaagcggttatcagagtgtctctaagctccacaagagaagagacctgttttggtgactccaccaacccagagatgattgaaggagcttgggattcactcagagaggaggagatgccagaggagctctcctgttctatatcaggcataagggaggttaagacctcaagccaggagttatacagggcattaaaagccatcattgctgctgatggcttgaacaacatcacctgccatggtaaggatcctgaggacaagatttctctcataaagggtcctcctcataaaaagcgggtggggatagttcggtgtgagagacgaagagatgctaagcaaatagggagagaaaccatggcagggattgcaatgacagtccttccagccttagcagtttttgctttggcacctgttgtttttgctgaggacccccatctcagaaacagaccagggaaggggcacaactacattgacgggatgacccaggaggatgccacatgcaaacctgtgacatatgctggggcatgtagcagttttgatgtcttgcttgagaaggggaaatttccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctaaagaaggggtcttatcctctccaagacttattttgccagtcaagtgaggatgatggatcaaaattaaaaacaaaaatgaaaggggtctgcgaagtgggggtccaagcactcaaaaagtgtgatggccaactcagcaccgcacatgaggttgtgccctttgcagtgtttaagaactcaaagaaggtttacctcgataagcttgacctcaagactgaggagaatctgctgccagactcatttgtctgcttcgagcataagggacagtataaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtgtcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatctgcagttgcttgtgctagcggagtttgcgttacaggatcacagagtccttctaccgagattacactcaagtatccagggatatcccagtcctcagggggggacataggggttcacatggcacacgatgatcagtcagttagctccaaaatagtagctcactgccctccccaggacccatgcttagtgcacggctgcatagtgtgtgctcatggcctgataaattaccagtgtcacactgctctcagtgcctttgttgttgtgtttgtattcagttctattgcaataatttgtttagccattctttatagggtgctcaagtgcttaaagattgccccaaggaaagttctgaatccactaatgtggatcacagccttcatcagatgggtgtataagaagatggttgccagagtggcagacaatattaatcaagtgaacagggagataggatggatggaaggaggtcagttggttctagggaaccctgcccctattcctcgtcatgccccaatcccacgttatagcacatacctaatgctactgctaattgtctcatatgcatcagcatgttcagaactaattcaggcaagctccagaatcactacttgctccacagagggtgtcaacaccaagtgtagactgtctggtacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggggaaagtacaaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagccaatgatagatcaattggagtgcacaacaaatctgattgatccctttgttgtatttgagaggggttctctgccacagacaaggaatgacaaaacctttgcagcttcaaaaggaaatagaggtgttcaagctttctctaagggctctgtgcaagctgatctaactctgatgtttgacaattttgaggtggactttgtgggagcagctgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcagtgccagatactacacttcactgtacctgaagtagaggaggagtttatgtactcttgtgatggagatgagcggcctctattagtgaaagggaccctgatagctattgatccatttgatgataggcgggaagcagggggagaatcaacagttgtgaatccaaaatctggatcttggaatttctttgactggttttctggactcatgagttggtttggagggcctctcaaaactatactcctcatttgcctgtatgttgcattatcaattgggctctttttcctcctcatatatcttggaagaacagggctctctaaaatgtggcttgctgctactaagaaggcctcatag

SEQ ID NO: 4347 - RNA, 3594 nt, synthetic construct
  misc_feature 1..3594: note = derived and/or modified CDS sequence (wt) from RVFV(2250/74)__DQ380209.1__GP
  source 1..3594: mol_type = other RNA
atgtatgttttattaacaattctaatctcggttctggtgtgtgaagcggttattagagtgtctctaagctccacaagagaagagacctgctttggtgactccactaacccagagatgattgaaggagcttgggattcactcagagaggaggagatgccggaggagctctcctgttctatatcaggcataagagaggttaagacctcaagccaggagttatacagggcattaaaagccatcattgctgccgatggcttgaacaacatcacctgccatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaagtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtaggatatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgccacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaatattaatcaagtgaacagggaaataggatggatggaaggaggtcagttggttctagggaaccctgcccctattcctcgtcatgccccaatcccacgttatagcacatacctgatgttactattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcagtgtggaggatgggggtgtgggtgttttaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagagattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccaaggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 4348 - RNA, 3594 nt, synthetic construct
  misc_feature 1..3594: note = derived and/or modified CDS sequence (wt) from RVFV(T1)__DQ380201.1__GP
  source 1..3594: mol_type = other RNA
atgtatgttttattaacaattctaatctcggttctggtgtgtgaagcggttattagagtgtctctaagctccacaagagaagagacctgctttggtgactccactaacccagagatgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctgttctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatctcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgataaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 4349 - RNA, 3594 nt, synthetic construct
  misc_feature 1..3594: note = derived and/or modified CDS sequence (wt) from RVFV(1853/78)__DQ380220.1__GP
  source 1..3594: mol_type = other RNA
atgtatgttttattaacaattctaatctcggttctggtgtgtgaagcggttatcagagtgtctctaagctccacaagagaagagacctgttttggtgactccaccaacccagagatgattgaaggagcttgggattcactcagagaggaggagatgccagaggagctctcctgttccatatcaggcataagggaggttaagacctcaagccaggagttatacagggcattaaaagccatcattgctgctgatggcttgaacaacatcacctgccatggtaaggatcctgaggacaagatttctctcataaagggtcctcctcataaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgacccaggaggatgccacatgcaaacctgtgacatatgctggggcatgtagcagttttgatgtcttgcttgagaaggggaaatttccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcactgaagactgcaacttttgtagacagatgacaggtgctagcctaaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttacctcgataagcttgacctcaagactgaggagaatctgctaccagactcatttgtctgcttcgagcataagggacagtataaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcaggggttgtgcagatacaagtgtcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagtccttctaccgagattacactcaagtatccagggatatcccagtcctctgggggggacataggggttcacatggcacacgatgatcagtcagttagctccaaaatagtagctcactgccctccccaggacccgtgcttagtgcacggctgcatagtgtgtgctcatggcctgataaattaccagtgtcacactgctctcagtgcctttgttgttgtgtttgtgttcagttctattgcaataatttgtttagctattctttatagggtgctcaaatgcttaaagattgccccaaggaaagttctgaatccactaatgtggattacagccttcatcagatgggtgtataagaagatggttgccagagtggcagacaatattaatcaagtgaacagggagataggatggatggaaggaggtcagttggttctaggaaaccctgcccctattcctcgtcatgccccaattccacgttatagcacatacctaatgctactactaattgtctcatatgcatcagcatgttcagaactgattcaggcaagctccagaatcactacttgctccacagagggtgtcaacaccaagtgtagactgtctggcacagcattgatcagggcagggtcagttggggcagaggcttgtttgatgttgaagggggtcaaggaagatcaaaccaagttcctaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggggaaagtacgaccatgcgagagaataagtgttttgagcagtgtggaggatggggatgtggatgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtatttgagaggggttctctgccacagacaaggaatgacaaaacctttgcagcttcaaaaggaaatagaggtgttcaagctttctctaagggctctgtgcaagctgatctaactctgatgtttgacaattttgaggtggactttgtgggagcagctgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcagtgccagatactacacttcactgtacctgaagtagaggaggagtttatgtactcttgtgatggagatgagcggcctctgttggtgaaggggaccctgatagctattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctcctcatatatcttggaagaacaggcctctctaaaatgtggcttgctgctactaagaaggcctcatag

SEQ ID NO: 4350 - RNA, 3594 nt, synthetic construct
  misc_feature 1..3594: note = derived and/or modified CDS sequence (wt) from RVFV(MP-12)__DQ380208.1__GP
  source 1..3594: mol_type = other RNA
atgtatgttttattaacaattctaacctcggttctggtgtgtgaagcgattattagagtgtctctaagctccacaagagaagagacctgctttggtgactccactaacccagagatgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcatcacctcaacaatgacgggaaaatggcttcagtcaagtgccctcctaagtatgagctcactgaagactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagttaaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaggaacaggcctctctaaaatgtggcttgctgccactaagaaggcctcatag

SEQ ID NO: 4351 - RNA, 3594 nt, synthetic construct
  misc_feature 1..3594: note = derived and/or modified CDS sequence (wt) from RVFV(ZM-657)__DQ380204.1__GP
  source 1..3594: mol_type = other RNA
atgtatgttttattaacaattctaatctcggttctggtgtgtgaagcggttattagagtgtctctaagctccacaagagaagagacctgctttggtgactccactaacccagagatgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaaagcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagtcctaaatgtttgagctcaaggagatgccaccttgtcggggaatgccatgtgaataggtgtctgtcttggagggacaatgaaacttcagcagagttttcatttgttggggaaagcacaaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctcttttttctccttatatatcttggaagaacaggcctctctaaaatgtggcttgctgccactaagaaggcctcatag

SEQ ID NO: 4352 - RNA, 3594 nt, synthetic construct
  misc_feature 1..3594: note = derived and/or modified CDS sequence (wt) from RVFV(ZH-501-777)__DQ380202.1__GP
  source 1..3594: mol_type = other RNA
atgtatgttttattaacaattctaatctcggttctggtgtgtgaagcggttattagagtgtctctaagctccacaagagaagagacctgctttggtgactccactaacccagagatgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggaccctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctgttctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtaaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatctcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgataaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 4353 - RNA, 3594 nt, synthetic construct
  misc_feature 1..3594: note = derived and/or modified CDS sequence (wt) from RVFV(OS-3)__DQ380184.1__GP
  source 1..3594: mol_type = other RNA
atgtatgttttactaacaattctaatctcggttctggtgtgtgaagcggttattagagtgtctctaagctccacaagagaagagacctgttttggtgactccaccaacccagagatgattgagggagcttgggattcactcagagaggaggagatgccagaggagctctcctgctctatatcaggcataagggaggttaagacctcaagccaggaattatacagagcattaaaagccatcattgctgctgatggcttgaacaacatcacctgccatggtaaggatcctgaggacaagatttctcttataaagggtcctcctcacaaaaagcgggtggggatagttcggtgtgagagacgaagagacgctaagcaaatagggagagaaaccatggcagggattgcaatgacagtccttccagccttagcagtttttgctttggcacctgttgtatttgctgaagacccccatctcagaaatagaccagggaaggggcacaactacattgacgggatgactcaggaggatgccacttgtaaacctgtgacatatgctggggcatgtagcagttttgatgtcttgctcgaaaagggaaaattccccctcttccagtcgtatgctcatcatagaactctactagaggcagttcatgacaccatcattgcaaaggctgatccacctagttgtgatcttcagagtgctcatgggaatccttgcatgaaagagaaactcgtgatgaagacacactgtccaaatgactaccagtcagcccactacctcaacaatgatgggaaaatggcctcagtcaagtgccctcctaagtatgagctcactgaggactgcaacttttgtaggcagatgacaggtgctagcctgaagaaggggtcttatcctctccaggacttattttgtcagtcaagtgaggatgatggatcaaaattaaaaacaaaaatgaaaggggtctgcgaagtgggggttcaggcactcaagaagtgtgatggccagctcagcactgcacatgaggttgtgccctttgcagtgtttaagaactcaaagaaggtttatcttgacaagcttgacctcaaaactgaagaaaatctgctaccagactcatttgtctgcttcgagcataagggacagtataaaggaacaatggactctggtcaaactaagagggagctcaaaagctttgatatctctcagtgccccaagattggaggacatggtagcaagaagtgcactggggacgcagcattttgctctgcttatgagtgcactgctcaatacgccaatgcctattgttcacatgctaatgggtcaggagttgtgcagatacaagtatccggggtctggaagaaacctttatgtgtagggtatgagagagtggttgtgaagagagaactctctgccaaacccatccagagagttgagccttgcacaacctgtataaccaaatgtgagcctcatggattggttgtccgatcaacagggttcaagatatcatctgcagttgcatgtgctagcggagtttgtgtcacaggatcgcagagtccttctaccgagatcacactcaagtatccagggatatcccagtcctctgggggggacataggggttcacatggcacacgatgatcagtcagttagctccaaaatagtagctcactgccccccccaggacccgtgcctagtgcatggctgcatagtgtgtgctcatggcctaataaattaccagtgtcacactgctctcagtgcctttgttgttgtgttcgtattcagctctgttgcaataatttgtttggccattctttataaggtgctcaagtgcctaaagattgccccaaggaaagttctaaatccactaatgtggattactgccttcatcagatgggtgtataagaagatggttgccagggtggcagacaatattaatcaagtgaacagagaaataggatggatggagggaggtcagttggctctagggaaccctgcccctattcctcgtcatgccccaattccacgttatagcacatacctgatgctactattgattgtctcatatgcatcagcatgttcagaactgattcaggcaagctctagaataaccacttgctccacagaaggtgtcaacaccaagtgtaggctgtctggcacagcattaatcagggcagggtcagttggggcagaggcttgcttgatgttaaagggagtcaaggaggaccaaacaaagttcttgaagataaaaactgtctcaagtgagctatcgtgcagggaaggccagagctattggactggatcctttagtcccaaatgtctgagctcaaggagatgccatcttgtcggggaatgtcatgtgaataggtgtctgtcttggagggacaatgaaacttcagcagagttttcatttgttggggaaagcacgactatgcgagagaataaatgttttgagcagtgtgggggatggggatgtgggtgcttcaatgtgaacccatcttgcttgtttgtgcacacgtatctgcagtcagttagaaaagaggcccttagagtttttaactgtatcgattgggtgcataaactcactctagagatcacagactttgatggttctgtttcaacaatagacttgggagcatcatctagccgtttcacaaactggggctcagttagcctctcactggatgcagagggcatttcaggctcaaatagcttttctttcattgagagcccaggcaaagggtatgcaattgttgatgagccattctcagaaatccctcggcaagggttcttgggggagatcaggtgcaattcagaatcttcagtcctgagtgctcatgaatcatgccttcgggcaccaaacctcatctcatacaagcccatgatagaccagttggagtgcacaacaaatctgattgatccctttgttgtctttgagaggggttctctgcctcagacaaggaatgataaaacttttgcagcttcaaaaggaaataggggtgttcaagctttctctaagggctctgtacaagctgatttaactctgatgtttgacaattttgaggtggactttgtgggagcagccgtgtcttgtgatgccgctttcttaaatctgacaggttgttattcttgtaatgcaggggccagagtctgcctgtctatcacatccacaggaactggaactctctctgcccacaataaggatgggtctctgcatatagttcttccatcagagaatggaacaaaagatcagtgtcagatactacacttcactgtacctgaggtagaggaggagtttatgtactcttgtgatggagatgagcggcctctgttggtgaaggggaccctgatcgccattgatccatttgatgacaggcgggaagcagggggagaatcaacagttgtgaatccaaaatctggatcttggaatttctttgactggttttctggactcatgagttggtttggagggcctcttaagactatactcctcatttgcctgtatgttgcattatcaattgggctctttttccttctcatatatcttggaagaacaggtctctctaaaatgtggcttgctgctactaagaaggcctcataa

SEQ ID NO: 4354 - RNA, 3594 nt, synthetic construct
  misc_feature 1..3594: note = derived and/or modified CDS sequence (wt) from RVFV(Sudan 86-2010)__JQ820489.1__GP
  source 1..3594: mol_type = other RNA
atgtatgttttattgacaattctaatctcggttctggtgtgtgaagcggttattagagtgtctctaagctccacaagagaggagacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgagtggggatagtccggtgtgagagacgaagagatgctaagcaaatagggagagaaaccatggcagggattgcgatgacagtccttccagccttagcagtttttgctttggcacctgttgtctttgctgaagacccccatctcagaaacagaccagggaaaggacacaactacattgacgggatgactcaggaggatgccacatgcaaacctgtgacatatgctggggcatgtagcagttttgatgtcttgcttgaaaaggggaaatttccccttttccagtcatatgctcatcatagaaccctactagaggcagttcacgacaccatcattgcaaaggctgatccacctagctgtgacctccagagtgctcatgggaatccctgtatgaaagagaaacttgtgatgaagacacattgtccaaacgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggatgcagcattttgctctgcttatgaatgtactgctcagtatgccaatgcctattgttcacatgctaatgggtcagggattgtgcagattcaagtatcaggggtctggaagaaacctttatgtgtggggtatgagagagtggttgtgaagagagaactctcagccaaacccatccagagagttgagccttgcacaacttgcataaccaaatgtgagcctcatggattggttgtccgatcaacagggttcaagatatcatctgcagttgcttgtgctagcggggtttgcgtcacagggtcgcaaagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtactcaagtgcctaaagattgccccaaggaaagttctgaatccactaatgtggattacagccttcatcagatgggtgtataagaagatggttgctagagtggcggacaatattaatcaagtgaacagagaaataggatggatggaaggaggtcagttggttctagggaaccctgcccctattcctcgtcatgccccaatcccacgttatagcacatacctaatgctactactgattgtctcatatgcatcagcatgttcagaactgattcaggcaagttccagaatcaccacttgctccacagagggtgtcaacaccaagtgtagactgtctggcacagcattgatcagggcagggtcagttggggcggaggcttgtttgatgttgaagggggtcaaggaagatcaaaccaagttcttaaagataaaaactgtctcaagtgagctatcgtgcagggagggccagagctattggactgggtccttcagccccaagtgcctgagctcaaggagatgccatcttgtcggggaatgtcatgtgaataggtgtctgtcctggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttatctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatctgacaggttgctattcttgcaatgcaggggccagagtttgcctgtctatcacatccacaggaactgggactctctctgcccacaataaggacgggtctctgcatatagttctcccatcagagaatgggacaaaagatcagtgtcagatactacatttcaccgtacctgaagtagaagaggagtttatgtactcttgtgatggagatgagcggcctctgttagtgaaagggaccctgatagctattgacccatttgatgataggcgggaggctgggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgctgctactaagaaggcctcatag

SEQ ID NO: 4355 - RNA, 3594 nt, synthetic construct
  misc_feature 1..3594: note = derived and/or modified CDS sequence (wt) from RVFV(T-46 (228113))__DQ380199.1__GP
  source 1..3594: mol_type = other RNA
atgtatgttttattaacaattctaatctcggttctggtgtgtgaagcggttattagagtgtctctaagctccacaagagaagagacctgctttggtgactccactaacccagagatgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaaaggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctgttctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatctcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgataaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 4356 - RNA, 3594 nt, synthetic construct
  misc_feature 1..3594: note = derived and/or modified CDS sequence (wt) from RVFV(2007000094)__EU574055.1__GP
  source 1..3594: mol_type = other RNA
atgtatgttttattgacaattctaatctcggttctggtgtgtgaagcggttattagagtgtctctaagctccacaagagaggagacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgagtggggatagtccggtgtgagagacgaagagatgctaagcaaatagggagagaaaccatggcagggattgcgatgacagtccttccagccttagcagtttttgctttggcacctgttgtctttgctgaagacccccatctcagaaacagaccagggaaaggacacaactacattgacgggatgactcaggaggatgccacatgcaaacctgtgacatatgctggggcatgtagcagttttgatgtcttgcttgaaaaggggaaatttccccttttccagtcatatgctcatcatagaactctgctagaggcagttcatgacaccatcattgcaaaggctgatccacctagctgtgacctccagagtgctcatgggaatccctgtatgaaagagaaacttgtgatgaagacacattgtcctaacgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggatgcagcattttgctctgcttatgaatgtactgctcagtatgccaatgcctattgttcacatgctaatgggtcagggattgtgcagattcaagtatcaggggtctggaagaaacctttatgtgtggggtatgagagagtggttgtgaagagagaactctcagccaaacccatccagagagttgagccttgcacaacttgcataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagagaaataggatggatggaaggaggtcagttggttctagggaaccccgcccctattcctcgtcatgccccaatcccacgttatagcacatacctaatgctactactgattgtctcatatgcatcagcatgttcagaactgattcaggcaagctccagaatcaccacttgctccacagagggtgtcaacaccaagtgtagactgtctggcacagcattgatcagggcagggtcagttggggcggaagcttgtttgatgttgaagggggtcaaggaagatcaaaccaagttcttaaagataaaaactgtctcaagtgagctatcgtgcagggagggccagagctattggactgggtcctttagccccaagtgcctgagctcaagaagatgccatcttgtcggggaatgtcatgtgaataggtgtctgtcctggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagtttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactgggactctctctgcccacaataaggacgggtctctgcatatagttctcccatcagagaatgggacaaaagatcagtgtcagatactacatttcactgtacctgaagtagaagaggagtttatgtactcttgtgatggagatgagcggcctctgttagtgaaagggaccctgatagctattgacccatttgatgataggcgggaggcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgctgctactaagaaggcctcatag

SEQ ID NO: 4357 - RNA, 3594 nt, synthetic construct
  misc_feature 1..3594: note = derived and/or modified CDS sequence (wt) from RVFV(ZC-3349)__DQ380207.1__GP
  source 1..3594: mol_type = other RNA
atgtatgttttattaacaattctaatctcggttctggtgtgtgaagcggttattagagtgtctctaagctccacaagagaagagacctgctttggtgactccactaacccagagatgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctactgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcaggcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagcctttatcagatggatatataagaagatggttgccagagtggcagacaacattaatcacgtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttaaggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctatctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaaccatactcctcatttgcctgtatgttgcattatcaattgggctctttttcctccttatatatcttggaagaacaggcctctctaaaatgtggcttgctgccactaagaaggcctcatag

SEQ ID NO: 4358 - RNA, 3594 nt, synthetic construct
  misc_feature 1..3594: note = derived and/or modified CDS sequence (wt) from RVFV(2007001602)__EU574043.1__GP
  source 1..3594: mol_type = other RNA
atgtatgttttattgacaattctaatctcggttctggtgtgtgaagcggttattagagtgtctataagctccacaagagaggaaacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaacgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4359 - RNA, 3594 nt, synthetic construct
  misc_feature 1..3594: note = derived and/or modified CDS sequence (wt) from RVFV(1260/78)__DQ380214.1__GP
  source 1..3594: mol_type = other RNA
atgtatgttttattaacaattctaatctcggttctggtgtgtgaagcggttattagagtgtctctaagctccacaagagaagagacctgctttggtgactccaccaacccagagatgattgaaggagcttgggattcactcagagaggaggagatgccagaggagctctcctgttctatatcaggcataagagaggttaagacctcaagccaggagttatacagggcattaaaagccatcattgctgctgatggcttgaacaacatcacctgccatggtaaggatcctgaggacaagatttctctcataaagggtcctcctcacaaaaagcgggtgggaatagttcggtgtgagagacgaagagatgctaagcaaatagggagagaaaccatggcagggattgcaatgacagtccttccagccttagcagtttttgctctagcacctgttgtttttgctgaagacccccatctcagaaacagaccggggaaggggcacaactacattgacgggatgactcaggaggatgccacatgcaaacctgtgacatatgctggggcatgtagcagttttgatgtcttgcttgaaaaagggaaatttcccctcttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcacagaggactgcaacttttgtaggcagatgacaggtgctagcctgaagaaggggtcttatcctctccaagacttattttgtcagtcaagtgaggacgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcacaagggacagtataagggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcttattgttcacatgctaatgggtcagggattgtgcaaatacaagtatcaggggtctggaagaagcctttatgtgtagggtatgagagagtggttgtaaagagagaactctctgccaagcccatccagagagttgagccttgcacaacttgtataaccaaatgtgagcctcatggattggttgtccgatcaacagggttcaaaatatcatctgcagttgcttgtgctagcggagtttgcgtcacaggatcgcagagtccttccaccgagattacactcaagtatccagggatatcccagtcctctgggggggacataggggttcacatggcacatgatgaccagtcagttagctccaaaatagtagctcactgccctccccaggacccgtgcttagtgcatggctgcatagtgtgtgctcatggcctgataaattaccagtgtcacactgctctcagtgcctttgttgttgtgtttgtgttcagttctattgcaataatttgtttagctattcttcatagggtgctcaagtgcttaaagattgccccaaggaaggttctgaatccactaatgtggattacagccttcatcagatgggtgtataagaagatggttgccagagtggcagacaatattaatcaagtgaacagggaaataggatggatggaaggaggtcagttggttctagggaaccctgcccctattcctcgccatgccccaattccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtctgatgttgaagggggtcaaggacgatcaaaccaagttcttaaagataaaaactgtctcaagtgagctatcgtgcagggagggccagagctattggactgggtcctttagccctaaatgtctgagctcaaggagatgccatcttgtcggggaatgtcatgtgaataggtgtctgtcttggagggacaatgaaacttcagcagagttttcatttgttggggaaagcacgaccatgcgggagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcacactagagatcacagactttgatggctctgtttcaacaatagacctgggggcatcatctagccgtttcacaaactggggttcagttagcctctcactggacgcagagggcatttcaggctcaaatagcttttctttcattgaaagcccaggcaaaggatatgcaattgttgatgagccattctcagaaattcctcgacaagggttcctgggggagatcaggtgcaattcagagtcctcagtcctgagtgctcatgaatcatgccttagggcaccaaaccttatctcatacaagcccatgatagaccaattggagtgcacaacgaatctgattgatccctttgttgtctttgagaggggttctctgccacagacaaggaatgacaaaacctttgcagcttcaaaaggaaatagaggtgtccaagctttctctaagggctctgtacaagctgatctaactctgatgtttgacaattttgaggtggactttgtgggagcagccgtatcttgtgatgccgccttcctaaatttgacaggttgctattcttgcaatgcaggggccagggtctgcctgtctatcacatccacaggaactggaaccctctctgcccacaataaggatgggtctctgcatatagttcttccatcagagaatggaacaaaagatcaatgccagatactacacttcactgtacctgaggtagaggaggagtttatgtactcttgtgacggagatgagcggcctctgttggtgaaggggaccctgatagctattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctcctcatatatcttggaagaacaggcctctctaaaatgtggcttgccgctactaagaaggcctcatag

SEQ ID NO: 4360 - RNA, 3594 nt, synthetic construct
  misc_feature 1..3594: note = derived and/or modified CDS sequence (wt) from RVFV(2007000324)__JF326195.1__GP
  source 1..3594: mol_type = other RNA
atgtatgttttattgacaattctaatctcggttctggtgtgtgaagcggttattagagtgtctctaagctccacaagagaggaaacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaagggaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaacgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4361 - RNA, 3594 nt, synthetic construct
  misc_feature 1..3594: note = derived and/or modified CDS sequence (wt) from RVFV(KEN/Gar-Msq/131B-04/06)__HM586972.1__GP
  source 1..3594: mol_type = other RNA
atgtatgttttattgacaattctaatctcggttctggtgtgtgaagcggttattagagtgtctctaagctccacaagagaggaaacctgttttggtgactccaccaacccagagatgattgaaggagcttgggattcatttagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacggaatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggataatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4362 - RNA, 3594 nt, synthetic construct
  misc_feature 1..3594: note = derived and/or modified CDS sequence (wt) from RVFV(2007004194)__EU574031.1__GP
  source 1..3594: mol_type = other RNA
atgtatgttttattgacaattctaatctcggttctggtgtgtgaagcggttattagagtgtctctaagctccacaagagaggagacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgagtggggatagtccggtgtgagagacgaagagatgctaagcaaatagggagagaaaccatggcagggattgcgatgacagtccttccagccttagcagtttttgctttggcacctgttgtctttgctgaagacccccatctcagaaacagaccagggaaaggacacaactacattgacgggatgactcaggaggatgccacatgcaaacctgtgacatatgctggggcatgtagcagttttgatgtcttgcttgaaaaggggaaatttccccttttccagtcatatgctcatcatagaactctgctagaggcagttcatgacaccatcattgcaaaggctgatccacctagctgtgacctccagagtgctcatgggaatccctgtatgaaagagaaacttgtgatgaagacacattgtcctaacgactaccagtcagctcattacctcagcaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggatgcagcattttgctctgcttatgaatgtactgctcagtatgccaatgcctattgttcacatgctaatgggtcagggattgtgcagattcaagtatcaggggtctggaagaaacctttatgtgtggggtatgagagagtggttgtgaagagagaactctcagccaaacccatccagagagttgagccttgcacaacttgcataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagagaaataggatggatggaaggaggtcagttggttctagggaaccccgcccctattcctcgtcatgccccaatcccacgttatagcacatacctaatgctactactgattgtctcatatgcatcagcatgttcagaactgattcaggcaagctccagaatcaccacttgctccacagagggtgtcaacaccaagtgtagactgtctggcacagcattgatcagggcagggtcagttggggcggaagcttgtttgatgttgaagggggtcaaggaagatcaaaccaagttcttaaagataaaaactgtctcaagtgagctatcgtgcagggagggccagagctattggactgggtcctttagccccaagtgcctgagctcaagaagatgccatcttgtcggggaatgtcatgtgaataggtgtctgtcctggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagtttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactgggactctctctgcccacaataaggacgggtctctgcatatagttctcccatcagagaatgggacaaaagatcagtgtcagatactacatttcactgtacctgaagtagaagaggagtttatgtactcttgtgatggagatgagcggcctctgttagtgaaagggaccctgatagctattgacccatttgatgataggcgggaggcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgctgctactaagaaggcctcatag

SEQ ID NO: 4363 - RNA, 3594 nt, synthetic construct
  misc_feature 1..3594: note = derived and/or modified CDS sequence (wt) from RVFV(73HB1230)__DQ380221.1__GP
  source 1..3594: mol_type = other RNA
atgtatgttttattaacaattctaatctcggttctagtgtgtgaagcggttattagagtgtctctaagctccacaagagaagagacctgttttggtgactccaccaacccagagatgattgaaggagcttgggattcgctcagagaggaggagatgccagaggagctctcctgttctatatcaggcataagggaggttaagacctcaagccaggagttgtacagggcattaaaagccatcattgctgctgatggcttgaacaacatcacctgccatggtaaggatcctgaggacaagatttctctcataaagggtcctcctcacaaaaagcgggtggggatagttcggtgtgagagacgaagagatgctaagcaagtagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcccaagtatgagctcactgaggactgcaacttttgtaggcagatgacaggtgctagcctgaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagactaagaaggagctcaaaagctttgatatctctcagtgccccaagattggaggacatggtagtaagaagtgcactggggacgcagcattttgctctgcttatgagtgcactgctcagtacgccaatgcctattgttcgcatgctaatggttcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagtccttctaccgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctattctttatagggtgctcaagtgcctaaagattgctccaaggaaagttctgaatccactaatgtggattacagccttcatcagatgggtgtataagaagatggttgctagagtggcagacaatattaatcaagtgaacagggaaataggatggatggaaggaggtcagttggtcctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgttaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaaatgtctgagctcaaggagatgccatcttgttggagagtgtcatgtgaataggtgtctgtcttggagggacaatgaaacttcagcagagttttcatttgttggggaaagcacgatcatgcgagagaataagtgttttgagcagtgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacgacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagctgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcagtgtcagatactacacttcactgtacctgaagtagaggaggagtttatgtactcttgtgatggagatgagcggcctctgttggtgaaagggaccctgatagctattgatccatttgatgataggcgggaagcagggggggaatcaacagttgtgaatccaaaatctggatcttggaatttctttgactggttttctggactcatgagttggtttggagggcctcttaaaactatactcctcatttgtctgtatgttgcattatcaattgggctctttttcctccttatatatcttggaagaacaggcctctctaaaatgtggcttgctgctactaagaaggcctcatag

SEQ ID NO: 4364 - RNA, 3594 nt, synthetic construct
  misc_feature 1..3594: note = derived and/or modified CDS sequence (wt) from RVFV(73HB1449)__DQ380211.1__GP
  source 1..3594: mol_type = other RNA
atgtatgttttattaacaattctaatctcggttctggtgtgtgaagcggttattagagtgtctctaagctccacaagagaagagacctgctttggtgactccaccaacccagagatgattgaaggagcttgggattcactcagagaggaggagatgccagaggagctctcctgttctatatcaggcataagagaggttaagacctcaagccaggagttatacagggcattaaaagccatcattgctgctgatggcttgaacaacatcacctgccatggtaaggatcctgaggacaagatttctctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttcccctcttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcacagaggactgcaacttttgtaggcagatgacaggtgctagcctgaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcacaagggacagtataagggaacaatggactctggtcagactaagagggagctcaaaagctttgatatttctcagtgccccaagattggaggacatggtagtaagaagtgcactggggacgcagcattttgctctgcttatgagtgcactgctcagtatgccaatgcttattgttcacatgctaatgggtcagggattgtgcagatacaagtatcaggggtctggaagaagcctttatgtgtagggtatgagagagtggttgtgaagagagaactctctgccaagcccatccagagggttgagccttgcacaacttgtataaccaaatgtgagcctcatggattggttgtccgatcaacagggttcaagatatcatctgcagttgcttgtgctagcggagtttgcgtcacaggatcgcagaatccttccaccgagatcacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgccacactgctctcagtgcctttgttgttgtgttcgtgttcagttctattgcaataatttgtttagctattctttatagggtgctcaagtgcctaaagattgccccaaggaaagttctgaatccactaatgtggattacagccttcatcagatgggtgtataagaagatggttgccagagtggcagacaatattaatcaagtgaatagggaaataggatggatggaaggaggtcagttggtcctagggaaccctgcccctattcctcgccatgccccaattccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtctgatgttgaagggggtcaaggacgatcaaaccaagttcttaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggggaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactaacactagagatcacagactttgatggctctgtttcaacaatagacctaggagcatcatctagccgtttcacaaactggggttcagtcagcctctcactggacgcagagggcatttcaggctcaaatagcttttctttcattgagagcccaggcaaagggtatgcaattgttgatgagccattctcagaaattcctcggcaagggttcctgggggagatcaggtgcaattcagagtcctcagtcctgagtgctcatgaatcatgccttagggcaccaaaccttatctcatacaagcccatgatagaccaattggagtgcacaacgaatctgattgatccatttgttgtctttgagaggggttctctgccacagacaaggaatgaaaaaacctttgcagcttcaaaaggaaatagaggtgtccaagccttctctaagggctctgtacaagctgatctaactctgatgtttgacaattttgaggtggattttgtgggagcagccgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcaatgccagatactacacttcactgtacctgaggtagaggaggagtttatgtactcttgtgacggagatgagcggcctctgttggtgaaggggaccctgatagctattgatccatttgatgataggcgggaagcagggggggaatcaacagttgtgaatccaaaatctggatcttggaatttctttgactggttttctggactcatgagttggtttggagggcctcttaaaactatactccttatttgcctgtatgttgcattatcaattgggctctttttcctcctcatatatcttggaagaacaggcctctctaaaatgtggcttgctgctactaagaaggcctcatag

SEQ ID NO: 4365 - RNA, 3594 nt, synthetic construct
  misc_feature 1..3594: note = derived and/or modified CDS sequence (wt) from RVFV(ZH-548M12)__M25276.1__GP
  source 1..3594: mol_type = other RNA
atgtatgttttattaacaattctaacctcggttctggtgtgtgaagcgattattagagtgtctctaagctccacaagagaagagacctgctttggtgactccactaacccagagatgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagaaaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcatcacctcaacaatgacgggaaaatggcttcagtcaagtgccctcctaagtatgagctcactgaagactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagttaaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaggaacaggcctctctaaaatgtggcttgctgccactaagaaggcctcatag

SEQ ID NO: 4366 - RNA, 3594 nt, synthetic construct
  misc_feature 1..3594: note = derived and/or modified CDS sequence (wt) from RVFV(ZINGA J83 R1)__KU978776.1__GP
  source 1..3594: mol_type = other RNA
atgtatgttttattaacaattctaatctcggttctggtgtgtgaagcggttattagagtgtctctaagctccacaagagaagagacctgttttggtgactccaccaacccagagatgattgaaggagcttgggattcactcagagaggaggagatgccagaggagctctcctgttctatatcaggcataagggaggttaagacctcaagccaggagttatacagggcattaaaagccatcattgctgctgatggcttgaacaacatcacctgccatggtaaggatcctgaggacaagatttctctcataaagggtcctcctcataaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgagaaggggaaattcccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggctgatgacaggtgctagcctgaagaaggggtcttatcctctccaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttaccttgataagcttgacctcaagactgaggagaatctgctaccagactcatttgtctgcttcgagcataagggacagtataaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtagttgtgaagagagaactctctgccaagcccatccagagagttgagccttgcacaacttgtataaccaaatgtgagcctcatgggttggttgtccgatcaacagggttcaagatatcatctgcagttgcttgtgctagcggagtttgcgtcacaggatcgcagagtccttccaccgagattacactcaagtatccagggatatcccagtcctctggaggggacataggggttcacatggcacacgatgatcagtcagttagctccaaaatagtagctcactgccctccccaggacccgtgcttagtgcacggctgcatagtgtgtgctcatggcctgataaattaccagtgtcacactgctctcagtgcctttgttgttgtgtttgtattcagttctattgcaataatttgtttagctattctttatagggtgctcaagtgcctaaagattgccccaaggaaagttctgaatccactaatgtggattacagccttcatcagatgggtgtataggaagatggttgccagagtggcagacaatattaatcaagtgaacagggagataggatggatggaaggaggtcagttggttctagggaaccctgcccctattcctcgtcatgttccaattccacgttatagcacatacctaatgctactactgattgtctcatatgcatcagcatgttcagaactgattcaggcaagctccagaatcactacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggagaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcactctggagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgagtcatgccttagggcaccaaaccttatctcatacaagcccatgatagatcaattggagtgcacaacaaatctgattgacccctttgttgtatttgagaggggttctctgccacagacaaggaatgacaaaacctttgctgcttcaaaaggaaatagaggtgttcaagctttctctaagggctctgtgcaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcagtgtcagatactacacttcactgtacctgaagtagaggaggagtttatgtactcttgtgatggagatgagcggcctctattggtgagggggactctgatagctattgatccatttgatgataggcgggaagcagggggggaatcaacagttgtgaatccaaaatctggatcttggaatttctttgactggttttctggactcatgagttggtttggagggcctcttaaaactatactcctcatttgcttgtatgttgcattatcaattgggctctttttcctcctcatatatcttggaagaacaggcctctctaaaatgtggcttgctgctactaagaaggcctcatag

SEQ ID NO: 4367 - RNA, 3594 nt, synthetic construct
  misc_feature 1..3594: note = derived and/or modified CDS sequence (wt) from RVFV(Sudan 28-2010)__JQ820491.1__GP
  source 1..3594: mol_type = other RNA
atgtatgttttattgacaattctaatctcggttctggtgtgtgaagcggttattagagtgtctctaagctccacaagagaggagacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgagtggggatagtccggtgtgagagacgaagagatgctaagcaaatagggagagaaaccatggcagggattgcgatgacagtccttccagccttagcagtttttgctttggcacctgttgtctttgctgaagacccccatctcagaaacagaccagggaaaggacacaactacattgacgggatgactcaggaggatgccacatgcaaacctgtgacatatgctggggcatgtagcagttttgatgtcttgcttgaaaaggggaaatttccccttttccagtcatatgctcatcatagaactctactagaggcagttcacgacaccatcattgcaaaggctgatccacctagctgtgacctccagagtgctcatgggaatccctgtatgaaagagaaacttgtgatgaagacacattgtccaaacgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaaaactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggatgcagcattttgctctgcttatgaatgtactgctcagtatgccaatgcctattgttcacatgctaatgggtcagggattgtgcagattcaagtatcaggggtctggaagaaacctttatgtgtggggtatgagagagtggtagtgaagagagaactctcagccaaacccatccagagagttgagccttgcacaacttgcataaccaaatgtgagcctcatggattggttgtccgatcaacagggttcaagatatcgtctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagagaaataggatggatggaaggaggtcagttggttctagggaaccccgcccctattcctcgtcatgccccaatcccacgttatagcacatacctaatgctactactgattgtctcatatgcatcagcatgttcagaactgattcaggcaagctccagaatcaccacttgctctacagagggtgtcaacaccaagtgtagactgtctggcacagcattgatcagggcagggtcagttggggcggaggcttgtttgatgttgaagggggtcaaggaagatcaaaccaagttcttaaagataaaaactgtttcaagtgagctatcgtgcagggagggccagagctattggactgggtcctttagccccaagtgcctgagctcaagaagatgccatcttgtcggagaatgtcatgtgaataggtgtctgtcctggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagtttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactgggactctctctgcccacaataaggacgggtctctgcatatagttctcccatcagagaatgggacaaaagatcagtgtcagatactacatttcactgtacctgaagtagaagaggagtttatgtactcttgtgatggagatgagcggcctctgttagtgaaagggaccctgatagctattgacccatttgatgataggcgggaggcagggggggaatcaacagttgtgaatccaaaatctggatcttggaatttctttgactggttttctggactcatgagttggtttggagggccgcttaaaactatactcctcatttgcctgtatgttgtattatcaattgggctcttcttcctccttatatatcttggaagaacaggcctctctaaaatgtggcttgctgctactaagaaggcctcatag

SEQ ID NO: 4368 - RNA, 3594 nt, synthetic construct
  misc_feature 1..3594: note = derived and/or modified CDS sequence (wt) from RVFV(2007001292)__EU574046.1__GP
  source 1..3594: mol_type = other RNA
atgtatgttttattgacaattctaatctcggttctggtgtgtgaagcggttattagagtgtctctaagctccacaagagaggaaacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacggaatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactggatcctttagccccaagtgcctgagctcaaggagatgccatcttgtcggggaatgtcatgtgaataggtgtctgtcttggagggataatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatctctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4369 - RNA, 3594 nt, synthetic construct
  misc_feature 1..3594: note = derived and/or modified CDS sequence (wt) from RVFV(Sudan 85-2010)__JQ820488.1__GP
  source 1..3594: mol_type = other RNA
atgtatgttttattgacaattctaatctcggtcctggtgtgtgaagcggttattagagtgtctctaagctccacaagagaggagacctgttttggtgactccactaacccagagatgattgaaggagcttgggattcactcagagaggaggagatgccagaggaactctcctgctctgtatcaggcataagggaggttaagacctcaagccaggagttatacagagcattaaaagccatcattgctgctgatggcctgaacaacatcacctgccatggtaagaatcctgaggacaagatttctctcataaagggccctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgcccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcacagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcgtatttgtattcagttctattgcaataatttgcttagccattctttatagggtgctcaagtgcttaaagattgccccaaggaaagttctgaatccactaatgtggattacagccttcatcagatgggtgtataagaagatggttgctagagtggcagacaatattaatcaagtgaacagagaaataggatggatggaaggaggtcagttggttctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaagaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaacaagtgttttgagcagtgtggaggatgggggtgtggatgcttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggctcagttagcctctcactggacgcagagggcatttcaggctcaaatagcttttcttttattgagagcccaggcaaagggtatgcaattgttgatgagccattctcagagatccctcggcaagggttcttgggggagattaggtgtaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgaaaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaacaaggacgggtctctgcatatagttctcccatcagagaatgggacaaaagatcagtgtcagatactacatttcactgtacctgaagtagaagaggagttcatgtactcttgtgatggagatgagcggcctctgttagtgaaagggaccctgatagctattgacccatttgatgataggcgggaagcagggggggaatcaacagttgtgaatccaaaatctggatcttggaacttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4370 - RNA, 3594 nt, synthetic construct
  misc_feature 1..3594: note = derived and/or modified CDS sequence (wt) from RVFV(2007002060)__EU574039.1__GP
  source 1..3594: mol_type = other RNA
atgtatgttttattgacaattctaatctcggttctggtgtgtgaagcggttattagagtgtctctaagctccacaagagaggaaacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaaaagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgattaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4371 - RNA, 3594 nt, synthetic construct
  misc_feature 1..3594: note = derived and/or modified CDS sequence (wt) from RVFV(2007002476)__EU574036.1__GP
  source 1..3594: mol_type = other RNA
atgtatgttttattgacaattctaatctcggttctggtgtgtgaagcggttattagagtgtctctaagctccacaagagaggaaacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcaaatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaacgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4372 - RNA, 3594 nt, synthetic construct
  misc_feature 1..3594: note = derived and/or modified CDS sequence (wt) from RVFV(2269/74)__DQ380222.1__GP
  source 1..3594: mol_type = other RNA
atgtatgttttactaacaattctaatctcggttctggtgtgtgaagcggttattagagtgtctctaagctccacaagagaagagacctgttttggtgactccaccaaccccgagatgattgaaggagcttgggattcgctcagagaggaggagatgccagaggagctctcctgttctatatcaggcataagggaggttaagacctcaagccaggaattgtacagggcattaaaagccatcattgctgctgatggcttgaacaacatcacctgccatggtaaggaccctgaggacaagatttctctcataaagggtcctcctcacaaaaaacgggtggggatagttcggtgtgagagacgaagagacgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgtaaacctgtgacatatgctggggcatgtagcagttttgatgtcttgctcgaaaaggggaaattccccctcttccagtcgtatgctcatcatagaactctactagaggcagttcacgacactatcattgcaaaggctgacccacctagctgtgaccttcagagtgctcatgggaatccctgcatgaaagagaagctcgtgatgaagacacactgtccaaatgactaccaatcagctcattaccttaacaatgacgggaaaatggcttcagtcaagtgcccccctaagtatgagctcactgaggattgcaacttttgtaggcagatgacaggtgctagcctgaagaaggggtcttatcctctccaggacttattttgtcagtcaagtgaggatgatgggtcaaaattaaaaacaaaaatgaaaggggtctgcgaagtgggagttcaagcactaaaaaagtgtgatggccaactcagcactgcacatgaggttgtgcccttcgcagtgtttaagaactcaaagaaggtttatcttgataagcttgaccttaagactgaggaaaatctgctaccagactcatttgtctgcttcgagcataaaggacaacataaaggaacaatggactctggtcagaccaagagggagctcaaaagctttgatatctctcagtgccccaagattggaggacatggtagcaagaagtgcactggggacgcagcattttgctctgcttatgagtgcactgctcagtacgccaatgcctattgttcacatgctaatgggtcaggaattgtgcagatacaagtgtcaggggtctggaagaagcctttatgtgtagggtatgagagagtggttgtaaagagagaactctctgccaagcccatccagagagttgagccttgcacaacttgtataaccaaatgcgagcctcatggactggttgtccgatcaacagggttcaagatatcatctgcagttgcttgtgctagcggagtttgcgtcacaggatcgcagagtccttctaccgagattacactcaagtatccaggaatatctcagtcctctgggggggacataggggttcacatggcacacgacgatcagtcagttagctccaaaatagtagctcactgccccccccaggacccgtgcttagtgcatggctgcatagtgtgtgctcatggcctgataaattaccagtgtcacactgctctcagtgcctttgttgttgtgttcgtgttcagctctgttgcaataatttgtttggccattctttataaggtgctcaagtgcctaaagattgccccaaagaaagttctgaatccgctaatgtggattactgccttcatcagatgggtatataagaagatggttgccagagtggcagataatataaatcaagtgaacagggaaataggatggatggaaggaggtcagttggctctagggaaccctgcccctattcctcgtcacgctccaatcccacgctatagcacatacctaatgctactactgattgtctcatatgcgtcagcatgttcagaactgattcaggcaagctctaggattaccacttgctccacagaaggtgtcaacaccaagtgtaggctgtctggcacagcattaattagggcagggtcagttggggcagaggcttgtttgatgttaaagggggtcaaggaagaccaaaccaagttcttgaagataaaaactgtctcaagtgagctatcgtgcagggagggccagagctactggactgggtcctttagccccaaatgtctgagctcaaggagatgccatcttgtcggggaatgtcatgtgaataggtgcttgtcttggagggacaatgaaacttcagcagagttttcatttgttggggaaagcacgaccatgcgagagaataagtgttttgagcagtgtggaggatggggatgtgggtgtttcaatgtgaacccatcttgcttatttgtgcacacgtacctgcagtcagttagaaaagaggcccttagagtttttaactgtatcgattgggtgcataaactcactctagagatcacagactttgatggctctgtttcaacaatagacttgggagcatcatctagccgtttcacaaactggggttcagttagcctctcactggacgcagagggcatttcaggctcaaatagcttttcattcattgagagcccaggcaaagggtatgcaattgttgatgagccattctcagaaattcctcggcaagggttcctgggggagatcaggtgcaactcagaatcttcagtcctgagtgctcatgaatcatgccttagggcaccaaaccttatctcatacaagcctatgatagatcagttggagtgcacaacaaatctgattgatccctttgttgtctttgagaggggttctctgccacagacaagaaatgacaaaacttttgcagcttcaaaaggaaataggggtgttcaagctttctctaagggctctgtgcaagctgatctaactctgatgtttgacaattttgaggtggactttgtgggagcagccgtgtcttgtgatgccgccttcttaaatttgacaggttgctattcttgcaatgcaggggccagggtctgcctgtctatcacatccacaggaactggaactctctctgcccacaacaaggatgggtctctgcatatagttctcccatcagaaaatggaacaaaagatcagtgtcagatactacacttcactgtgcctgaggtagaggaggagtttatgtactcttgtgatggagatgagcggcctttgttagtgaaggggaccctgatagccattgatccatttgatgataggcgggaagcaggaggggaatcaacagttgtgaatccaaaatctggatcttggaatttctttgactggttctctggactcatgagttggtttggagggcctcttaagaccatactcctcatatgcctgtatgttgcattatcaattgggctctttttccttcttatatatcttggaagaacaggtctctctaaaatgtggcttgctgctactaagaaggcttcatag

SEQ ID NO: 4373 - RNA, 3594 nt, synthetic construct
  misc_feature 1..3594: note = derived and/or modified CDS sequence (wt) from RVFV(SA-51 (Van Wyck))__DQ380195.1__GP
  source 1..3594: mol_type = other RNA
atgtatgttttactaacaattctaatctcggttctggtgtgtgaagcggttattagagtgtctctaagctccacaagagaagagacctgttttggtgactccaccaacccagagatgattgaaggagcttgggattcactcagagaggaggagatgccagaggagctctcctgttctatatcaggcataagggaggttaagacctcaagccaggaattatacagggcattaaaagccatcattgctgctgatggcttgaacaacatcacctgccatggtaaggatcctgaggacaagatctctctcataaagggtcctcctcacaaaaaacgggtggggatagttcggtgtgagagacgaagagacgctaagcaaatagggagagaaaccatggcagggattgcaatgacagtccttccagccttagcagtttttgctttggcacctgttgtttttgctgaagacccccatctcagaaacagaccagggaagggacacaactacattgacgggatgactcaggaggatgccacatgtaaacctgtgacatatgctggggcatgtagcagttttgatgtcttgctcgaaaagggaaaatttcccctttttcagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaacgacgggaaaatggcttcagtcaagtgccctcctaagtatgagctcactgaggactgcaacttttgtaggcagatgacaggtgctagcctgaagaaggggtcttatcctctccaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaaaactgaggaaaatctgctaccagactcatttgtctgcttcgagcataagggacagtataaaggaacaatggactctggtcagactaagagggagctcaagagctttgatatctctcagtgccccaagattggaggacgtggtagcaagaagtgcactggggacgcagcattttgctctgcttatgagtgcactgctcaatacgccaatgcctattgttcacatgctaatgggtcaggaattgtgcagatacaagtatcaggggtctggaagaagcctttatgtgtaggatatgagagagtggttgtgaaaagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagcccttctacagagattacactcaagtacccagggatatcccagtcctctggaggggacataggggttcacatggcacacgatgatcagtcagttagctccaaaatagtagctcactgccccccccaagacccgtgcttagtgcatggctgcatagtgtgtgctcatggcctgataaattaccagtgtcacactgctctcagtgcctttgttgttgtgttcgtattcagctctgttgcaataatctgtttagccattctttataaggtgctcaagtgcctaaagattgccccaaggaaagttctgaatccactaatgtggattactgccttcatcagatgggtgtataagaagatggttgccagagtggcagacaatattaatcaagtgaacagggagataggatggatggaaggaggtcagttggctctagggaatcctgcccctattcctcgtcatgctccaattccacgttatagcacatacctaatgctactattgattgtctcatatgcatcagcatgctcagaactgattcaggcaagctccagaatcaccacttgctctacagaaggtgtcaacaccaagtgtaggctgtctggcacagcattaatcagggcagggtcagttggggcagaggcttgtttgatgttgaagggggtcaaggaagaccaaaccaagttcttgaagataaaaactgtctcaagtgagctatcgtgcagggagggccagagctattggactgggtcctttagccccaagtgtctgagctcaaggagatgccatcttgtcggggaatgtcatgtgaataggtgtctgtcttggagggataatgaaacttcagcagagttttcatttgttggggaaagcacgaccatgcgagaaaataagtgttttgagcagtgtggaggatggggatgtgggtgtttcaatgtgaacccatcttgcttatttgtgcacacgtatctgcagtcagttagaaaagaggcccttagagtttttaactgtatcgattgggtgcataaactcactctggaggtcacagattttgatggctctgtttcaacaatagacttgggagcatcatctagccgtttcacaaactggggttcagttagcctctcactggatgcagagggcatttcaggctcaaatagcttttctttcattgagagcccaggcaaagggtatgcaattgttgatgagccattctcagaaattcctcggcaagggttcttgggggagatcaggtgcaattcagaatcttcagttctgagtgcccacgaatcatgccttagggcaccaaaccttatctcatacaagcccatgatagatcagttggagtgcacaacaaatctgattgatccctttgttgtctttgagaggggttccctgccacagacaaggaatgacaaaacctttgcagcttcaaaaggaaacaggggtgttcaagctttctctaagggctctgtacaagctgatctaactctgatgtttgacaattttgaggtggactttgtgggagcagccgtgtcttgtgatgctgccttcttaaatttgacagggtgctattcttgcaatgcaggggccagggtctgcctgtctatcacatccacaggaactggaaccctctctgcccacaataaggatgggtctctgcatatagttcttccatcagagaatggaacaaaagatcagtgtcagatactacacttcactgttcctgaagtagaggaagagtttatgtactcttgtgatggagatgagcggcctctgttggtgaaggggaccctgatagctattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttccttcttatatatcttggaagaacaggtctttctaaaatgtggcttgctgctactaagaaggcctcatag

SEQ ID NO: 4374 - RNA, 3594 nt, synthetic construct
  misc_feature 1..3594: note = derived and/or modified CDS sequence (wt) from RVFV(OS-8)__DQ380185.1__GP
  source 1..3594: mol_type = other RNA
atgtatgttttactaacaattctaatctcggttctggtgtgtgaagcggttattagagtgtctctaagctccacaagagaagagacctgttttggtgactccaccaacccagagatgattgagggagcttgggattcactcagagaggaggagatgccagaggagctctcctgctctatatcaggcataagggaggttaagacctcaagccaggaattatacagagcattaaaagccatcattgctgctgatggcttgaacaacatcacctgccatggtaaggatcctgaggacaagatttctcttataaagggtcctcctcacaaaaagcgggtggggatagttcggtgtgagagacgaagagacgctaagcaaatagggagagaaaccatggcagggattgcaatgacagtccttccagccttagcagtttttgctttggcacctgttgtatttgctgaagacccccatctcagaaatagaccagggaaggggcacaactacattgacgggatgactcaggaggatgccacttgtaaacctgtgacatacgctggggcatgtagcagttttgatgtcttgctcgaaaagggaaaattccccctcttccagtcgtatgctcatcatagaactctactagaggcagttcatgacaccatcattgcaaaggctgatccacctagttgtgatcttcagagtgctcatgggaatccttgcatgaaagagaaactcgtgatgaagacacactgtccaaatgactaccagtcagcccactacctcaacaatgatgggaaaatggcctcagtcaagtgccctcctaagtatgagctcactgaggactgcaacttttgtaggcagatgacaggtgctagcctgaagaaggggtcttatcctctccaggacttattttgtcagtcaagtgaggatgatggatcaaaattaaaaacaaaaatgaaaggggtctgcgaagtgggggttcaggcactcaagaagtgtgatggccagctcagcactgcacatgaggttgtgccctttgcagtgtttaagaactcaaagaaggtttatcttgacaagcttgacctcaaaactgaagaaaatctgctaccagactcatttgtctgcttcgagcataagggacagtataaaggaacaatggactctggtcaaactaagagggagctcaaaagctttgatatctctcagtgccccaagattggaggacatggtagcaagaagtgcactggggacgcagcattttgctctgcttatgagtgcactgctcaatacgccaatgcctattgttcacatgctaatgggtcaggagttgtgcagatacaagtatccggggtctggaagaaacctttatgtgtagggtatgagagagtggttgtgaagagagaactctctgccaaacccatccagagagttgagccttgcacaacctgtataaccaaatgtgagcctcatggattggttgtccgatcaacagggttcaagatatcatctgcagttgcatgtgctagcggagtttgtgtcacaggatcgcagagtccttctaccgagatcacactcaagtatccagggatatcccagtcctctgggggggacataggggttcacatggcacacgatgatcagtcagttagctccaaaatagtagctcactgccccccccaggacccgtgcctagtgcatggctgcatagtgtgtgctcatggcctaataaattaccagtgtcacactgctctcagtgcctttgttgttgtgttcgtattcagctctgttgcaataatttgtttggccattctttataaggtgctcaagtgcctaaagattgccccaaggaaagttctaaatccactaatgtggattactgccttcatcagatgggtgtataagaagatggttgccagggtggcagacaatattaatcaagtgaacagagaaataggatggatggagggaggtcagttggctctagggaaccctgcccctattcctcgtcatgccccaattccacgttatagcacatacctgatgctactattgattgtctcatatgcatcagcatgttcagaactgattcaggcaagctctagaataaccacttgctccacagaaggtgtcaacaccaagtgtaggctgtctggcacagcattaatcagggcagggtcagttggggcagaggcttgcttgatgttaaagggagtcaaggaggaccaaacaaagttcttgaggataaaaactgtctcaagtgagctatcgtgcagggaaggccagagctattggactggatcctttagtcccaaatgtctgagctcaaggagatgccatcttgtcggggaatgtcatgtgaataggtgtctgtcttggagggacaatgaaacttcagcagagttttcatttgttggggaaagcacgactatgcgagagaataaatgttttgagcagtgtgggggatggggatgtgggtgcttcaatgtgaacccatcttgcttgtttgtgcacacgtatctgcagtcagttagaaaagaggcccttagagtttttaactgtatcgattgggtgcataaactcactctagagatcacagactttgatggttctgtttcaacaatagacttgggagcatcatctagccgtttcacaaactggggctcagttagcctctcactggatgcagagggcatttcaggctcaaatagcttttctttcattgagagcccaggcaaagggtatgcaattgttgatgagccattctcagaaatccctcggcaagggttcttgggggagatcaggtgcaattcagaatcttcagtcctgagtgctcatgaatcatgccttcgggcaccaaacctcatctcatacaagcccatgatagaccagttggagtgcacaacaaatctgattgatccctttgttgtctttgagaggggttctctgcctcagacaaggaatgataaaacttttgcagcttcaaaaggaaataggggtgttcaagctttctctaagggctctgtacaagctgatttaactctgatgtttgacaattttgaggtggactttgtgggagcagccgtgtcttgtgatgccgctttcttaaatctgtcaggttgttattcttgtaatgcaggggccagagtctgcctgtctatcacatccacaggaactggaactctctctgcccacaataaggatgggtctctgcatatagttcttccatcagagaatggaacaaaagatcagtgtcagatactacacttcactgtacctgaggtagaggaggagtttatgtactcttgtgatggagatgagcggcctctgttggtgaaggggaccctgatcgccattgatccatttgatgacaggcgggaagcagggggagaatcaacagttgtgaatccaaaatctggatcttggaatttctttgactggttttctggactcatgagttggtttggagggcctcttaagactatactcctcatttgcctgtatgttgcattatcaattgggctctttttccttctcatatatcttggaagaacaggtctctctaaaatgtggcttgctgctactaagaaggcctcataa

SEQ ID NO: 4375 - RNA, 3594 nt, synthetic construct
  misc_feature 1..3594: note = derived and/or modified CDS sequence (wt) from RVFV(BIME-01)__KX609032.1__GP
  source 1..3594: mol_type = other RNA
atgtatgttttactaacaattctaatctcggttctggtgtgtgaagcgattattagagtgtctctaagctccacaagagaggaaacctgttttggtgactccaccaacccagagatgattgaaggagcttgggattcactcagagaggaggagatgccagaagagctctcctgttccatatctggcataagggaggtcaagacctcaagccaggaattatacagggcattaaaagccatcattgctgctgatggcttgaacaacatcacctgccatggtaaggatcctgaggacaaaatttctctcataaagggtcctcctcacaagaagcgggtggggatagttcggtgtgagagacgaagggacgctaagcaaatagggagagaaaccatggcagggattgcaatgacagttcttcccgccttagcagtttttgctttggcacctgttgtttttgctgaggaccctcatctcagaaacagaccagggaagggacataactacattgacgggatgactcaggaggatgccacatgcaaacctgtgacatatgctggggcatgtagcagttttgatgttttgctcgaaaagggaaaattccccctcttccagtcatatgctcatcatagaactctactagaggcagttcacgacaccatcattgcaaaggctgatccacctagctgtgatctccagagtgctcatgggaatccctgcatgaaagagaaactcgtgatgaagacacactgtccaaatgactaccagtcagctcattacctcaacaatgacgggaaaatggcttcagtcaagtgccctcctaagtatgagcttactgaggactgcaacttttgtaggcagatgacaggtgctagcttgaagaaggggtcttatcctctccaggacttattttgtcagtcaagtgaggatgatggatcaaaactaaagacaaaaatgaaaggggtctgcgaagtgggggttcaggcactcaaaaagtgtgatggccaactcagcactgcacatgaggttgtgccctttgcagtgtttaagaattcaaagaaggtttatcttgacaagcttgaccttaagactgaagaaaatctgctaccagactcatttgtctgctttgagcataagggacagtataaaggaacaatggactctggtcagactaagagggagctcaaaagctttgatatctctcagtgccccaagattgggggacatggtagcaagaagtgcactggggacgcagcattttgctctgcttatgagtgtactgctcaatatgccaatgcctattgttcacatgctaatgggtctgggattgtacagatacaagtatccggggtctggaagaagcctttatgtgtggggtatgagagagtggttgtgaagagagaactctctgccaagcccatccagagagttgagccttgcacaacttgcataaccaaatgtgagcctcatggattggttgtccgatcaacagggttcaagatatcatctgcagttgcttgtgccagcggagtttgcgtcacaggatcgcagagcccttctactgagatcactctcaagtatccagggatatcccagtcctctgggggggatataggggttcacatggcacatgatgatcagtcagttagctccaaaatagtggctcactgccccccccaggacccgtgcctagtgcatggctgcatagtgtgtgctcatggcttgataaattaccagtgtcacactgctcttagtgcttttgttgttgtgttcgtattcagctctgttgcaataatttgtctggccattctttataaggtgctcaggtgcctaaagattgccccaaagaaagttctgaatccactaatgtggatcactgccttcatcagatgggtgtataagaagatggttgccagagtggcagacaatatcaatcaagtgaacagagaaataggatggatggaaggaggccagttggctctagggaaccctgctcccattcctcgtcatgctccgattccacgttatagcacatacctaatgctactattgattatctcatatgcatcagcatgttcagaactgattcaggcaagctccagaatcaccacttgctccacagaaggtgtcaacaccaagtgtaggctgtctggcacagcattaatcagggcagggtcagttggggcagaggcttgtttaatgttaaagggggtcaaggaagaccagaccaagttcttgaagataaaaactgtctcaagtgagctatcgtgcagggagggccagagctattggactgggtcctttagccccaaatgtctgagctcaaggagatgccatcttgtcggagaatgtcatgtgaataggtgtctgtcttggagggacaatgaaacttcagcagaattttcatttgttggggaaagcacgaccatgcgagagaataagtgttttgagcagtgtggaggatggggatgtggatgtttcaatgtgaacccatcttgcttatttgtgcacacgtatctgcaatcagttagaaaagaggctcttagagtttttaactgtattgattgggtgcataaactcactctagagatcacagactttgatggctctgtttcaacaatagacttgggagcatcatctagccgtttcacaaactggggctcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagaatcttctgtcctgagtgctcatgagtcatgccttagggcaccaaaccttatctcatacaaacccatgatagatcagttggagtgcacaacaaatctgattgatccctttgttgtctttgagaggggatctctgccacagacaaggaatgacaaaacctttgcagcttcaaaaggaaataggggtgttcaagctttctctaaaggctctgtacaggctgatctaactctgatgtttgacaattttgaggtggactttgtgggagcagccgtgtcttgtgatgccgccttcttaaatttgacaggttgctattcctgcaatgctggagccagagtctgcctgtctatcacatccacaggaactggaactctttctgcccacaataaggatgggtctctgcatatagttcttccatcagagaatggaacaaaagatcagtgtcagatactacacttcactgtacctgaggtggaggaggagttcatgtactcttgtgatggagatgagcgacctttgttggtgaaggggaccctaatagctattgatccatttgatgataggcgagaagcagggggagaatcaacagttgtgaatccaaaatctggatcttggaacttctttgactggttttctggacttatgagttggtttggaggacctcttaagactatactcctaatttgcctgtatgtagcattatcaattgggctctttttccttcttatatatcttggaagaacaggtctctctaaaatgtggcttgctgccactaagaaagcctcatag

SEQ ID NO: 4376 - RNA, 3594 nt, synthetic construct
  misc_feature 1..3594: note = derived and/or modified CDS sequence (wt) from RVFV(Kenya 83 (21445))__DQ380198.1__GP
  source 1..3594: mol_type = other RNA
atgtatgttttattgacaattctaatctcggttctggtgtgtgaagcggttattagagtgtctctaagctccacaagagaagagacctgttttggtgactccaccaacccagagatgattgaaggagcttgggattcactcagagaggaggagatgccagaggagctctcctgctctatatcaggcataagggaggttaagacctcaagccaagagttatacagggcattaaaagccatcattgctgctgatggcttgaacaacatcacctgccatggtaagaatcctgagaacaagatttctctcataaagggtcctcctcacaaaaagcgggtggggatagtccggtgtgagagacgaagagatgctaagcaaatagggagagaaaccatggcagggattgcaatgacagtccttccagccttagcagtttttgctttggcacctgttgtttttgctgaagacccccacctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcatatgctcatcatagaactctactagaggcagttcacgacaccatcattgcaaaggctgatccacctagctgtgaccttcagagtgctcatgggaatccctgtatgaaagagaaactcgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaaaaaggggtcttaccctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgtttcgagcataagggacagtataaaggaacaatggactctggtcagaccaagagggagctcaaaagctttgatatctctcagtgccccaagattggagggcatggtagtaagaagtgcactggggacgcagcattctgctctgcttatgagtgcactgctcagtacgccaatgcctattgttcacatgctaatgggtcagggattgtgcagattcaagtatcaggggtctggaagaagcctttatgtgtagggtatgagagagtggttgtgaagagagaactctctgccaagcccatccagagagttgagccttgcacaacttgcataaccaaatgtgagcctcatggattggttgtccgatcaacagggttcaagatatcatctgcagttgcttgtgctagcggggtttgcgtcacaggatcgcagagtccttctactgagattacactcaagtatccagggatatctcagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagctttcatcagatgggtgtataagaagatggttgctagagtggcagacaacattaatcaagtgaacagggaaataggatggatggaaggaggtcagttggctctagggaaccctgcccctattcctcgtcatgccccaatcccacgttatagcacatacctaatgctactattgattgtctcatatgcatcagcatgttcagaactgatccaggcaagctccagaatcaccacttgctccacagagggtgtcaacaccaagtgtagactgtctggcacagcattgatcagggcagggtcagttggggcagaggcttgtttgatgttgaagggggtcaaggaggatcaaaccaaattcttaaagataaaaacagtctcaagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggttcaaatagcttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgacccctttgttgtctttgagaggggttctctgccacagacaaggaatgacaaaacctttgcagcttcaaaaggaaatagaggtgttcaggctttctctaagggctctgtacaagctgatctgactctgatgtttgacaattttgaggtggactttgtgggagcagccgtgtcttgtgatgccgccttcttgaatttgacaggttgctattcttgtaatgcaggggccagggtctgcctgtctatcacatccacaggaactggaactctctctgcccacaataaggatgggtctctgcatatagttctcccatcagagaatgggacaaaagatcagtgtcagatactacacttcactgtacctgaagtagaggaggagtttatgtactcttgtgatggagatgagcggcctctgttagtgaaagggaccctgatagctattgacccatttgatgataggcgggaagcaggaggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgccgctactaagaaggcctcatag

SEQ ID NO: 4377 - RNA, 3594 nt, synthetic construct
  misc_feature 1..3594: note = derived and/or modified CDS sequence (wt) from RVFV(2007000253)__JF326192.1__GP
  source 1..3594: mol_type = other RNA
atgtatgttttattgacaattctaatctcggttctggtgtgtgaagcagttattagagtgtctctaagctccacaagagaggaaacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcaccagttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagctggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4378 - RNA, 3594 nt, synthetic construct
  misc_feature 1..3594: note = derived and/or modified CDS sequence (wt) from RVFV(200803166)__JF311381.1__GP
  source 1..3594: mol_type = other RNA
atgtatgttttattgacaattctaatctcggttctggtgtgtgaagcggttattagagtgtctctaagctccacaagagaggagacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccctagcggtttttgctttagcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttaaaaaggggaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggatccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagggaaataggatggatggaaggaggtcagttggttctagggaaccctgcccctattcctcgtcatgccccaatcccacgttatagcacatacctaatgctactattgattgtctcatatgcaacagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggttaaggaagatcaaaccaagttcttgaagataaaaactgtctcaagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagtctctcactggacgcagagggcatttcaggctcaaatagcttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtccatcacatccacaggaactggaactctctctgcccacaataaggacgggtctctgcatgtagttctcccatcagagaatgggacaaaagatcagtgtcagatactgcatttcactgtacctgaagtagaagaggagtttatgtactcttgtgatggagatgagcggcctctgttagtgaaagggaccctgatagctattgacccatttgatgataggcgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4379 - RNA, 3594 nt, synthetic construct
  misc_feature 1..3594: note = derived and/or modified CDS sequence (wt) from RVFV(2007001107)__EU574047.1__GP
  source 1..3594: mol_type = other RNA
atgtatgttttattgacaattctaatctcggttctggtgtgtgaagcggttattagagtgtctctaagctccacaagagaggaaacctgttttggtgactccaccaacccagagatgattgaaggagcttgggattcactcagagaggaggagatgccagaggagctctcctgctctgtatcaggcataagggaggttaagacctcaaaccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacggaatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggataatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagtttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggggcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4380 - RNA, 3594 nt, synthetic construct
  misc_feature 1..3594: note = derived and/or modified CDS sequence (wt) from RVFV(ANK-3837)__DQ380215.1__GP
  source 1..3594: mol_type = other RNA
atgtatgttttattaacaattctaatctcggttctggtgtgtgaagcggttattagagtgtctctaagctccacaagagaagagacctgttttggtgactccaccaacccagagatgattgaaggagcttgggattcactcagagaggaggagatgccagaggagctctcctgttctatatcaggcataagggaggttaagacctcaagccaggagttatacagggcattaaaagccatcattgctgctgatggcttgaacaacatcacctgccatggtaaggatcctgaggacaagatttctctcataaagggtcctcctcataaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgagaaggggaaattcccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttaccttgataagcttgacctcaagactgaggagaatctgctaccagactcatttgtctgcttcgagcataagggacagtataaaggaaaattggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtagttgtgaagagagaactctctgccaagcccatccagagagttgagccttgcacaacttgtataaccaaatgtgagcctcatgggttggttgtccgatcaacagggttcaagatatcatctgcagttgcttgtgctagcggagtttgcgtcacaggatcgcagagtccttccaccgagattacactcaagtatccagggatatcccagtcctctggaggggacataggggttcacatggcacacgatgatcagtcagttagctccaaaatagtagctcactgccctccccaggacccgtgcttagtgcacggctgcatagtgtgtgctcatggcctgataaattaccagtgtcacactgctctcagtgcctttgttgttgtgtttgtattcagttctattgcaataatttgtttagctattctttatagggtgctcaagtgcctaaagattgccccaaggaaagttctgaatccactaatgtggattacagccttcatcagatgggtgtataggaagatggttgccagagtggcagacaatattaatcaagtgaacagggagataggatggatggaaggaggtcagttggttctagggaaccctgcccctattcctcgtcatgttccaattccacgttatagcacatacctaatgctactactgattgtctcatatgcatcagcatgttcagaactgattcaggcaagctccagaatcactacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggagaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcactctggagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgagtcatgccttagggcaccaaaccttatctcatacaagcccatgatagatcaattggagtgcacaacaaatctgattgacccctttgttgtatttgagaggggttctctgccacagacaaggaatgacaaaacctttgctgcttcaaaaggaaatagaggtgttcaagctttctctaagggctctgtgcaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcagtgtcagatactacacttcactgtacctgaagtagaggaggagtttatgtactcttgtgatggagatgagcggcctctattggtgagggggactctgatagctattgatccatttgatgataggcgggaagcagggggggaatcaacagttgtgaatccaaaatctggatcttggaatttctttgactggttttctggactcatgagttggtttggagggcctcttaaaactatactcctcatttgcttgtatgttgcattatcaattgggctctttttcctcctcatatatcttggaagaacaggcctctctaaaatgtggcttgctgctactaagaaggcctcatag

SEQ ID NO: 4381 - RNA, 3594 nt, synthetic construct
  misc_feature 1..3594: note = derived and/or modified CDS sequence (wt) from RVFV(OS-1)__DQ380186.1__GP
  source 1..3594: mol_type = other RNA
atgtatgttttactaacaattctaatctcggttctggtgtgtgaagcggttattagagtgtctctaagctccacaagagaagagacctgttttggtgactccaccaacccagagatgattgagggagcttgggattcactcagagaggaggagatgccagaggagctctcctgctctatatcaggcataagggaggttaagacctcaagccaggaattatacagagcattaaaagccatcattgctgctgatggcttgaacaacatcacctgccatggtaaggatcctgaggacaagatttctcttataaagggtcctcctcacaaaaagcgggtggggatagtccggtgtgagagacaaagagacgctaagcaaatagggagagaaaccatggcagggattgcaatgacagtccttccagccttagcagtttttgctttggcacctgttgtatttgctgaagacccccatctcagaaatagaccagggaaggggcacaactacattgacgggatgactcaggaggatgccacttgtaaacctgtgacatatgctggggcatgtagcagttttgatgtcttgctcgaaaagggaaaattccccctcttccagtcgtatgctcatcatagaactctactagaggcagttcatgacaccatcattgcaaaggctgatccacctagttgtgatcttcagagtgctcatgggaatccttgcatgaaagagaaactcgtgatgaagacacactgtccaaatgactaccagtcagcccactacctcaacaatgatgggaaaatggcctcagtcaagtgccctcctaagtatgagctcactgaggactgcaacttttgtaggcagatgacaggtgctagcctgaagaaggggtcttatcctctccaggacttattttgtcagtcaagtgaggatgatggatcaaaattaaaaacaaaaatgaaaggggtctgcgaagtgggggttcaggcactcaagaagtgtgatggccagctcagcactgcacatgaggttgtgccctttgcagtgtttaagaactcaaagaaggtttatcttgacaagcttgacctcaaaactgaagaaaatctgctaccagactcatttgtctgcttcgagcataagggacagtataaaggaacaatggactctggtcaaactaagagggagctcaaaagctttgatatctctcagtgccccaagattggaggacatggtagcaagaagtgcactggggacgcagcattttgctctgcttatgagtgcactgctcaatacgccaatgcctattgttcacatgctaatgggtcaggagttgtgcagatacaagtatccggggtctggaagaaacctttatgtgtagggtatgagagagtggttgtgaagagagaactctctgccaaacccatccagagagttgagccttgcacaacctgtataaccaaatgtgagcctcatggattggttgtccgatcaacagggttcaagatatcatctgcagttgcatgtgctagcggagtttgtgtcacaggatcgcagagtccttctaccgagatcacactcaagtatccagggatatcccagtcctctgggggggacataggggttcacatggcacacgatgatcagtcagttagctccaaaatagtagctcactgccctccccaggacccgtgcctagtgcatggctgcatagtgtgtgctcatggcctaataaattaccagtgtcacactgctctcagtgcctttgttgttgtgttcgtattcagctctgttgcaataatttgtttggccattctttataaggtgctcaagtgcctaaagattgccccaaggaaagttctaaatccactaatgtggattactgccttcatcagatgggtgtataagaagatggttgccagggtggcagacaatattaatcaagtgaacagagaaataggatggatggagggaggtcagttggctctagggaaccctgcccctattcctcgtcatgccccaattccacgttatagcacatacctgatgctactattgattgtctcatatgcatcagcatgttcagaactgattcaggcaagctctagaataaccacttgctctacagaaggtgtcaacaccaagtgtaggctgtctggcacagcattaatcagggcagggtcagttggggcagaggcttgcttgatgttaaagggagtcaaggaggaccaaacaaagttcttgaagataaaaactgtctcaagtgagctatcgtgcagggaaggccagagctattggactggatcctttagtcccaaatgtctgagctcaaggagatgccatcttgtcggggaatgtcatgtgaataggtgtctgtcttggagggacaatgaaacttcagcagagttttcatttgttggggaaagcacgactatgcgagagaataaatgttttgagcagtgtgggggatggggatgtgggtgcttcaatgtgaacccatcttgcttgtttgtgcacacgtatctgcagtcagttagaaaagaggcccttaaagtttttaactgtatcgattgggtgcataaactcactctagagatcacagactttgatggttctgtttcaacaatagacttgggagcatcatctagccgtttcacaaactggggctcagttagcctctcactggatgcagagggcatttcaggctcaaatagcttttctttcattgagagcccaggcaaagggtatgcaattgttgatgagccattctcagaaatccctcggcaagggttcttgggggagatcaggtgcaattcagaatcttcagtcctgagtgctcatgaatcatgccttcgggcaccaaacctcatctcatacaagcccatgatagaccagttggagtgcacaacaaatctgattgatccctttgttgtctttgagaggggttctctgcctcagacaaggaatgataaaacttttgcagcttcaaaaggaaataggggtgttcaagctttctctaagggctctgtacaagctgatttaactctgatgtttgacaattttgaggtggactttgtgggagcagccgtgtcttgtgatgccgctttcttaaatctgacaggttgttattcttgtaatgcaggggccagagtctgcctgtctatcacatccacaggaactggaactctctctgcccacaataaggatgggtctctgcatatagttcttccatcagagaatggaacaaaagatcagtgtcagatactacacttcactgtacctgaggtagaggaggagtttatgtactcttgtgatggagatgagcggcctctgttggtgaaggggaccctgatcgccattgatccatttgatgacaggcgggaagcagggggagaatcaacagttgtgaatccaaaatctggatcttggaatttctttgactggttttctggactcatgagttggtttggagggcctcttaagactatactcctcatttgcctgtatgttgcattatcaattgggctctttttccttctcatatatcttggaagaacaggtctctctaaaatgtggcttgctgctactaagaaggcctcataa

SEQ ID NO: 4382 - RNA, 3594 nt, synthetic construct
  misc_feature 1..3594: note = derived and/or modified CDS sequence (wt) from RVFV(Sudan 2V-2007)__JQ820490.1__GP
  source 1..3594: mol_type = other RNA
atgtatgttttattgacaattctaatctcggttctggtgtgtgaagcggttattagagtgtctctaagctccacaagagaggagacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaatatcacttgccatggtaagaatcctgaggacaagatttctctcataaagggtcctcctcacaaaaagcgagtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcatatgctcatcatagaactctactagaggcagttcacgacaccatcattgcaaaggctgatccacctagctgtgacctccagagtgctcatgggaatccctgtatgaaagagaaacttgtgatgaagacacattgtccaaatgactaccagtcagctcattacctcaacaatgacgggaaaatggcctcagtcaagtgcccacctaagtatgagctcactgaggactgcaacttttgtagacagatgacaggtgctagcctgaagaaggggtcttatcctctccaagacttattttgtcagtcgagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtctatcttgataagcttgacctcaagactgaggagaatctgctaccagactcatttgtctgcttcgagcataagggacagtataaaggaacaatggactctggtcagaccaagagggagctcaagagctttgatatctctcagtgccccaagattggagggcatggtagtaagaagtgcactggggatgcagcattttgctctgcttatgaatgcactgctcagtatgccaatgcctattgttcacatgctaatgggtcagggattgtgcagattcaagtatcaggggtctggaagaaacctttgtgtgtagggtatgagagagtggttgtgaagagagaactctctgccaaacccatccagagagttgagccttgcacaacttgcataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggatataggggttcacatggcacacgatgatcagtcagttagctccaaaatagtagctcactgccccccccaggacccgtgctcagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagagaaataggatggatggaaggaggtcagttggttctagggaaccctgcccctattcctcgtcatgccccaatcccacgttatagcacatacctaatgctactattgattgtctcacatgcatcagcatgttcagaacttattcaggcaagctccagaatcaccacttgctccacagagggtgtcaacaccaagtgtagactgtctggcacagcattgatcagggcagggtcagttggggcggaggcttgtttgatgttgaagggggtcaaggaagatcaaactaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatgggggtgtggatgtttcaatgtaaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagaaattcctcggcaagggtttttgggggagatcaggtgcaattcagagtcctcagtcctaagtgctcatgaatcatgccttagggcgccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaagacgggtctctgcatatagttctcccatcagagaatgggacaaaagatcagtgtcagatactacattttactgtacctgaagtagaagaggagtttatgtactcttgtgatggagatgagcggcctctgttagtaaaagggaccctgatggctattgacccatttgatgataggcgggaggcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4383 - RNA, 3594 nt, synthetic construct
  misc_feature 1..3594: note = derived and/or modified CDS sequence (wt) from RVFV(200803162)__JF311377.1__GP
  source 1..3594: mol_type = other RNA
atgtatgttttattgacaattctaatctcggttctggtgtgtgaagcggttattagagtgtctctaagctccacaagagaggaaacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaaatatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtatagccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctaaggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4384 - RNA, 3594 nt, synthetic construct
  misc_feature 1..3594: note = derived and/or modified CDS sequence (wt) from RVFV(2007001811)__EU574040.1__GP
  source 1..3594: mol_type = other RNA
atgtatgttttattgacaattctaatctcggttctggtgtgtgaagcggttattagagtgtctctaagctccacaagagaggagacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgagtggggatagtccggtgtgagagacgaagagatgctaagcaaatagggagagaaaccatggcagggattgcgatgacagtccttccagccttagcagtttttgctttggcacctgttgtctttgctgaagacccccatctcagaaacagaccagggaaaggacacaactacattgacgggatgactcaggaggatgccacatgcaaacctgtgacatatgctggggcatgtagcagttttgatgtcttgcttgaaaaggggaaatttccccttttccagtcatatgctcatcatagaactctgctagaggcagttcacgacaccatcattgcaaaggctgatccacctagctgtgacctccagagtgctcatgggaatccctgtatgaaagagaaacttgtgatgaagacacattgtcctaacgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggatgcagcattttgctctgcttatgaatgtactgctcagtatgccaatgcctattgttcacatgctaatgggtcagggattgtgcagattcaagtatcaggggtctggaagaaacctttatgtgtggggtatgagagagtggttgtgaagagagaactctcagccaaacccatccagagagttgagccttgcacaacttgcataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagagaaataggatggatggaaggaggtcagttggttctagggaaccccgcccctattcctcgtcatgccccaatcccacgttatagcacatacctaatgctactactgattgtctcatatgcatcagcatgttcagaactgattcaggcaagctccagaatcaccacttgctccacagagggtgtcaacaccaagtgtagactgtctggcacagcattgatcagggcagggtcagttggggcggaagcttgtttgatgttgaagggggtcaaggaagatcaaaccaagttcttaatgataaaaactgtctcaagtgagctatcgtgcagggagggccagagctattggactgggtcctttagccccaagtgcctgagctcaagaagatgccatcttgtcggggaatgtcatgtgaataggtgtctgtcctggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagtttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgaaaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactgggactctctctgcccacaataaggacgggtctctgcatatagttctcccatcagagaatgggacaaaagatcagtgtcagatactacatttcactgtacctgaagtagaagaggagtttatgtactcttgtgatggagatgagcggcctctgttagtgaaagggaccctgatagctattgacccatttgatgataggcgggaggcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgctgctactaagaaggcctcatag

SEQ ID NO: 4385 - RNA, 3594 nt, synthetic construct
  misc_feature 1..3594: note = derived and/or modified CDS sequence (wt) from RVFV(clone 13)__DQ380213.1__GP
  source 1..3594: mol_type = other RNA
atgtatgttttattaacaattctaatctcggttctggtgtgtgaagcggttattagagtgtctctaagctccacaagagaagagacctgctttggtgactccaccaacccagagatgattgaaggagcttgggattcactcagagaggaggagatgccagaggagctctcctgttctatatcaggcataagagaggttaagacctcaagccaggagttatacagggcattaaaagccatcattgctgctgatggcttgaacaacatcacctgccatggtaaggatcctgaggataagatttctctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttcccctcttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagcatgagctcacagaggactgcaacttttgtaggcagatgacaggtgctagcctgaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcacaagggacagtataagggaacaatggactctggtcagactaagagggagctcaaaagctttgatatttctcagtgccccaagattggaggacatggtagtaagaagtgcactggggacgcagcattttgctctgcttatgagtgcactgctcagtatgccaatgcttattgttcacatgctaatgggtcagggattgtgcagatacaagtatcaggggtctggaagaagcctttatgtgtagggtatgagagagtggttgtgaagagagaactctctgccaagcccatccagagggttgagccttgcacaacttgtataaccaaatgtgagcctcatggattggttgtccgatcaacagggttcaagatatcatctgcagttgcttgtgctagcggagtttgcgtcacaggatcgcagaatccttccaccgagatcacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgccacactgctctcagtgcctttgttgttgtgttcgtgttcagttctattgcaataatttgtttagctattctttatagggtgctcaagtgcctaaagattgccccaaggaaagttctgaatccactaatgtggattacagccttcatcagatgggtgtataagaagatggttgccagagtggcagacaatattaatcaagtgaatagggaaataggatggatggaaggaggtcagttggtcctagggaaccctgcccctattcctcgccatgccccaattccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtctgatgttgaagggggtcaaggacgatcaaaccaagttcttaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggggaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactaacactagagatcacagactttgatggctctgtttcaacaatagacctaggagcatcatctagccgtttcacaaactggggttcagtcagcctctcactggacgcagagggcatttcaggctcaaatagcttttctttcattgagagcccaggcaaagggtatgcaattgttgatgagccattctcagaaattcctcggcaagggttcctgggggagatcaggtgcaattcagagtcctcagtcctgagtgctcatgaatcatgccttagggcaccaaaccttatctcatacaagcccatgatagaccaattggagtgcacaacgaatctgattgatccatttgttgtctttgagaggggttctctgccacagacaaggaatgaaaaaacctttgcagcttcaaaaggaaatagaggtgtccaagccttctctaagggctctgtacaagctgatctaactctgatgtttgacaattttgaggtggattttgtgggagcagccgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcaatgccagatactacacttcactgtacctgaggtagaggaggagtttatgtactcttgtgacggagatgagcggcctctgttggtgaaggggaccctgatagctattgatccatttgatgataggcgggaagcagggggggaatcaacagttgtgaatccaaaatctggatcttggaatttctttgactggttttctggactcatgagttggtttggagggcctcttaaaactatactccttatttgcctgtatgttgcattatcaattgggctctttttcctcctcatatatcttggaagaacaggcctctctaaaatgtggcttgctgctactaagaaggcctcatag

SEQ ID NO: 4386 - RNA, 3594 nt, synthetic construct
  misc_feature 1..3594: note = derived and/or modified CDS sequence (wt) from RVFV(MP12)__Z30318.1__GP
  source 1..3594: mol_type = other RNA
atgtatgttttattaacaattctaacctcggttctggtgtgtgaagcgattattagagtgtctctaagctccacaagagaagagacctgctttggtgactccactaacccagagatgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagaaaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcatcacctcaacaatgacgggaaaatggcttcagtcaagtgccctcctaagtatgagctcactgaagactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcacacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagttaaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaggaacaggcctctctaaaatgtggcttgctgccactaagaaggcctcatag

SEQ ID NO: 4387 - RNA, 3594 nt, synthetic construct
  misc_feature 1..3594: note = derived and/or modified CDS sequence (wt) from RVFV__JQ068143.1__GP
  source 1..3594: mol_type = other RNA
atgtatgttttactaacaattctaatctcggttctggtgtgtgaagcggttattagagtgtctctaagctccacaagagaagaaacctgttttggtgactccaccaacccagagatgattgaaggagcctgggattcactcagagaggaggagatgccagaagagctctcctgttccatatctggcataagggaggttaagacctctagccaggaattatacagggcattaaaagccatcattgctgctgatggcttgaacaacatcacctgccatggtaaggatcctgaggacaagatttccctcataaagggtcctcctcacaagaagcgggtggggatagttcggtgtgagagacgaagggacgctaagcaaatagggagagaaaccatggcagggattgcaatgacagtccttcccgccttagcagtttttgctttggcacctgttgtttttgctgaggaccctcatctcagaaacagaccagggaagggacacaactacattgacgggatgactcaggaggatgccacatgcaaacctgtgacatatgctggggcatgtagcagttttgatgttttgctcgaaaagggaaaattccccctcttccagtcatatgctcatcatagaactctactagaggcagttcacgacaccatcattgcaaaggctgacccacctagctgtgatcttcagagtgctcatgggaacccctgcatgaaagagaaactcgtgatgaagacacactgtccaaatgactaccagtcagctcattatctcaacaatgacgggaaaatggcttcagtcaagtgccctcctaagtatgagctcactgaggactgcaacttttgtaggcagatgacaggtgctagcttgaagaaggggtcttatcctctccaggacttattttgtcagtcaagtgaggatgatgggtcaaaattaaagacaaaaatgaaaggggtctgcgaagtgggggttcaagcactcaaaaagtgtgatggccaactcagcactgcacatgaggttgtgccctttgcagtgtttaagaactcaaagaaggtttatcttgacaagcttgacctcaagactgaagaaaatctgctaccagactcatttgtctgctttgagcataaaggacagtataaaggaacaatagactctggtcagactaagagagagctcaaaagctttgatatctctcagtgccccaagattggaggacatggtagcaagaagtgcactggggacgcagcattttgctctgcttatgagtgtactgctcagtatgccaatgcctattgttcacatgctaatgggtctgggattgtacagatacaagtgtccggggtctggaagaagcctctgtgtgtaggatatgagagagtggttgtgaagagagaactctctgccaagcccatccagagagttgagccttgcacaacttgcataaccaaatgtgagcctcatggattggttgtccgatcaacagggtttaagatatcatctgcagttgcttgtgctagcggggtttgcgtcacaggatcgcagagcccttctactgagatcactcttaagtatccagggatatcccaatcctctgggggggacataggagttcacatggcacatgatgatcagtcagttagctccaaaatagtggctcactgccccccccaggacccgtgcctagtgcatggctgcatagtgtgtgctcatggcttgataaattaccagtgtcacactgctctcagtgcttttgttgttgtattcgtattcagctctgttgcaataatttgtctggccatcctttataaggtgctcaggtgcctaaagattgccccaaagaaagttctgaatccactaatgtggatcactgccttcatcagatgggtgtataagaagatggttgccagagtggcagacaatatcaatcaagtgaacagagaaataggatggatggaaggaggccagttggctctagggaaccctgctcctattcctcgtcatgctccaattccacgttatagcacgtatctaatgctactattgattatctcatatgcatcagcatgttcagaactgattcaggcaagctccagaatcactacttgctccacagaaggtgtcaacaccaagtgtaggctgtctggcacagcattaatcagggcagggtcagttggggcagaggcttgtttaatgttaaagggggtcaaggaagaccagaccaagttcttgaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacctcagcagaattttcatttgttggggaaagcacgaccatgcgagagaataagtgttttgagcagtgtggaggatggggatgtggatgtttcaatgtgaacccatcttgcttatttgtgcacacgtatctgcagtcagttagaaaagaggcccttagagtttttaactgtattgattgggtgcataaactcactctagagatcacagactttgatggctctgtttcaacaatagacttgggggcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggagagatcaggtgcaattcagaatcttctgtcctgagtgctcatgaatcatgccttagggctccaaaccttatctcatacaaacccatgatagatcagttggagtgcacaacaaatctgattgatccctttgttgtctttgagaggggatctctgccacagacaaggaatgacaaaacctttgcagcttcaaaaggaaataggggtgttcaagctttctctaagggctctgtacaagctgatctaactctgatgtttgacaattttgaggtggactttgtgggggcagccgtgtcttgtgatgccgccttcttaaatttgacaggttgctattcctgcaatgctggagccagagtctgcctgtctatcacatccacaggaactggaactctttctgcccacaataaggatgggtctctgcacatagttcttccatcagagaatggaacaaaagatcagtgtcagatactacacttcactgtacctgaggtggaggaggagtttatgtactcttgtgatggagatgagcggcctttgttggtgaaggggaccctaatagctattgatccatttgatgataggcgagaagcagggggagaatcaacagttgtgaatccaaaatctggatcttggaacttctttgactggttttctggacttatgagttggtttggagggcctcttaagactatactcctaatttgcctgtatgtagcattatcaattgggctctttttccttcttatatatctcggaagaacaggtctctctaaaatgtggcttgctgccactaagaaagcctcatag

SEQ ID NO: 4388 - RNA, 3594 nt, synthetic construct
  misc_feature 1..3594: note = derived and/or modified CDS sequence (wt) from RVFV(2007002445)__EU574037.1__GP
  source 1..3594: mol_type = other RNA
atgtatgttttattgacaattctaatctcggttctggtgtgtgaagcggttattagagtgtctctaagctccacaagagaggaaacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactatattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgaaaaaacctttgcagcttcaaaaggaaatagaggtgttcaggctttctctaagggctctatacaagctgatctgactctgatgtttgataattttgaggtggactttgtgggagcagccgtgtcttgtgatgccgccttcttgaatttgacaggttgctattcttgcaacgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4389 - RNA, 3594 nt, synthetic construct
  misc_feature 1..3594: note = derived and/or modified CDS sequence (wt) from RVFV(2008/00101)__HE687306.1__GP
  source 1..3594: mol_type = other RNA
atgtatgttttattgacaattctaatctcggttctggtgtgtgaagcggttattagagtgtctctaagctccacaagagaggaaacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaactatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggcattctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactacactcctcatttgcctgtatgttgcattatcaattgggctcttcttcctccttatatatcttggaagaacaggcctctctaaaatgtggcttgccgctactaagaaggcctcatag

SEQ ID NO: 4390 - RNA, 3594 nt, synthetic construct
  misc_feature 1..3594: note = derived and/or modified CDS sequence (wt) from RVFV(Hv-B375)__DQ380218.1__GP
  source 1..3594: mol_type = other RNA
atgtatgttttattaacaattctaatctcggttctggtgtgtgaagcggttatcagagtgtctctaagctccacaagagaagagacctgttttggtgactccaccaacccagagatgattgaaggagcttgggattcactcagagagggggagatgccagaggagctctcctgttctatatcaggcataagggaggttaagacctcaagccaggagttatacagggcattaaaagccatcattgctgctgatggcttgaacaacatcacctgccatggtaaggatcctgaggacaagatttctctcataaagggtcctcctcataaaaagcgggtggggatagttcggtgtgagagacgaagagatgctaagcaaatagggagagaaaccatggcagggattgcaatgacagtccttccagccttggcagtttttgctttggcacctgttgtttttgctgaggacccccatctcagaaacagaccagggaaggggcacaactacattgacgggatgacccaggaggatgccacatgcaaacctgtgacatatgctggggcatgtagcagttttgatgtcttgcttgagaaggggaaatttccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagaatgagctcactgaggactgcaacttttgtaggcagatgacaggtgctagcctaaagaaggggtcttatcctctccaagacttattttgccagtcaagtgaggatgatggatcaaaattaaaaacaaaaatgaaaggggtctgcgaagtgggggtccaagcactcaaaaagtgtgatggccaactcagcaccgcacatgaggttgtgccctttgcagtgttcaagaactcaaagaaggtttacctcgataagcttgacctcaagactgaggagaatctgctgccagactcatttgtctgcttcgagcataagggacagtataaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtgtcaggggtctggaagaagcctttatgtgtagggtatgagagagtggttgtgaagagagaactctctgccaagcccatccagagagttgagccttgcacaacttgtataaccaaatgtgagcctcatggtttggttgtccgatcaacagggttcaagatatcatctgcagttgcttgtgctagcggagtttgcgtcacaggatcacagagcccttctaccgagattacactcaagtatccagggatatcccagtcctctgggggggacataggggttcacatggcacacgatgatcagtcagttagctccaaaatagtagctcactgccctccccaggacccatgcttagtgcacggctgcatagtgtgtgctcatggcctgataaattaccagtgtcacactgccctcagtgcctttgttgttgtgtttgtattcagttctattgcaataatttgtttagccattctttatagggtgctcaagtgcttaaagattgccccaaggaaagttctgaatccactaatgtggatcacagccttcatcagatgggtgtataagaagatggttgccagagtggcagacaatattaatcaagtgaacagggagataggatggatggaaggaggtcagttggttctagggaaccctgctcctattcctcgtcatgccccaattccacgttatagcacatacctaatgctactgctaattgtctcatatgcatcagcatgttcagaactaattcaggcaagctccagaatcactacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggggaaagtacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaactcagagtcctcagtcctgagtgctcatgaatcatgccttagggcaccaaaccttatctcatacaagcccatgatagatcaattggagtgcacaacaaatctgattgatccctttgttgtatttgagaggggttctctgccacagacaaggaatgacaaaacctttgcagcttcaaaaggaaatagaggtgttcaagctttctctaagggctctgtgcaagctgatctaactctgatgtttgacaattttgaggtggactttgtgggagcagctgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcaatgccagatactacacttcactgtacctgaagtagaggaggagtttatgtactcttgtgatggagatgagcggcctctattagtgaaagggaccctgatagctattgatccatttgatgataggcgggaagcagggggagaatcaacagttgtgaatccaaaatctggatcttggaatttctttgactggttttctggactcatgagttggtttggagggcctctcaaaactatactcctcatttgcctgtatgttgcattatcaattgggctctttttcctcctcatatatcttggaagaacagggctctctaaaatgtggcttgctgctactaagaaggcctcatag

SEQ ID NO: 4391 - RNA, 3594 nt, synthetic construct
  misc_feature 1..3594: note = derived and/or modified CDS sequence (wt) from RVFV(763/70)__DQ380188.1__GP
  source 1..3594: mol_type = other RNA
atgtatgttttactaacaattctgatcacggttctggtgtgtgaagcggttattagagtgtctctaagttccacaagagaagagacctgctttggtgactccaccaacccagagatgattgaaggagcttgggattcactcagagaggaggagatgccagaagagctctcctgttccatatcaggcataagggaggtcaaaacctcaagccaggaattatatagggcattaaaagccatcattgctgctgatggcttgaacaacatcacctgccatggtaaggatcctgaggataagatttctctcgtaaagggtcctcctcacaaaaagcgggtggggatagttcggtgtgagagacgaagagacgctaagcaaataggaagagaaaccatggcagggattgcaatgacagtccttccagccttagcagtttttgctttggcacctgttgtttttgctgaagaccctcatctcagaaacagaccagggaaggggcacaactacattgacgggatgactcaggaggacgccacatgcaaacctgtgacatatgctggggcttgtagcagttttgatgtcttgctcgaaaagggaaaattccccctcttccagtcgtatgcccatcacagaaccctactagaagcagttcacgacaccatcattgcaaaggctgatccacctagctgtgaccttcagagtgctcatgggaatccctgcatgaaggagaaactcgtgatgaagacacactgtccaaatgactaccagtcagctcattacctcaacaatgacgggaaaatggcttcagtcaagtgccctcctaaatatgggctcactgaggactgcaatttttgcaggcagatgacaggtgctagcttgaagaaggggtcttatcctcttcaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtatttaagaactcaaagaaggtttatcttgataagcttgacctcaagactgaggaaaatctgttgccagactcatttgtctgcttcgagcataagggacagtataaaggaacaatggactctggtcagaccaagagggagctcaaaagctttgatatctctcagtgccccaagattggaggacatggtagcaagaagtgcactggggacgcagctttttgctctgcttatgagtgcactgctcaatacgccaatgcttattgttcacatgctaatgggtcaggaattgtacagatacaagtatccggggtctggaagaagcctttgtgtgtcgggtatgagagggtggttgtgaagagagaactctctgctaagcccatccagagagttgagccttgcacaacttgtataaccaaatgtgagcctcacggattggttgtccgatcaacaggtttcaagatatcatctgcagttgcttgtgctagcggagtttgcgttacaggatcgcagagcccttctaccgagatcacactcaagtatccagggatatcccagtcctctgggggggacataggggttcacatggcacatgatgatcagtcagttagctccaaaatagtagctcactgccctccccaggatccatgcctagtgcatggctgcatagtgtgtgctcatggcctgataaattaccagtgtcacactgctctcagtgcctttgttgttgtgttcgtatttagctctgtcgcaataatttgtttggccattctttataaagttctcaagtgcctaaagattgccccaaggaaagttctgaatccactaatgtggattactgctttcatcagatgggtgtataagaagatggttgccagagtggcagacaatatcaatcaggtgaacagggaaataggatggatggaaggaggccagctggctctagggaaccctgcccctattcctcgtcatgctccaattccacgttatagcacatacttaatgctactattgattgtctcatatgcatcagcatgttcagaactgattcaggcaagctccagaatcaccacttgctccacagaaggtgtcaacaccaagtgtaggctgtctggcacagcattaatcagggcagggtcagttggggcagaggcttgtttgatgttaaagggggtcaaggaagaccaaaccaagtttttgaagataaaaactgtctcaagtgagctatcgtgcagggagggccagagctattggactgggtcctttagccctaaatgtctgagctcaaggagatgccatcttgtcggggaatgtcatgtgaataggtgtctgtcttggagagacaatgaaacctcagcagaattttcatttgttggggaaagcacgaccatgcgggagaataagtgttttgagcagtgtggaggatggggatgtgggtgtttcaatgtgaacccatcttgcttatttgtgcacacgtatctgcagtcagtcagaaaagaggcccttagagttttcaactgtatcgattgggtgcataaactcactctagagattactgactttgacggctctgtttcaacaatagacctgggagcatcatctagccgtttcacaaactggggttcagttagcctctcactggacgcagagggcatttcaggctcaaacagcttttccttcattgagagcccaggcaaagggtatgcaattgttgatgagccattctcagaaattcctcggcaagggttcttgggggagatcaggtgcaattcagaatcttcagtcctgagtgctcatgaatcatgccttagggcaccaaatcttatttcatacaagcccatgatagatcagttggagtgcacaacaaatctgattgatccctttgttgtctttgagaggggctctctgccacagacaaggaatgacaaaacctttgcagcttcaaaaggaaataggggtgttcaagctttctctaagggctctgtacaggctgatctaacactgatgtttgacaattttgaggtggactttgtgggagcagccgtgtcttgtgatgccgccttcttaaatttgacaggttgctattcctgcaatgcaggggccagagtctgcctgtctatcacatccacaggaactggaactctctctgcccacaataaagatgggtctctgcatatagttcttccatcagagaatggaacaaaagatcagtgtcagatactacacttcactgtacctgaggtagaggaggagtttatgtactcttgtgatggagatgagcggcctctgttggtgaagggaaccctgatagctattgatccatttgatgataggcgagaagcagggggggaatcaacagttgtgaatccaaaatctggatcttggaatttctttgactggttttctggactcatgagttggtttggagggcctcttaagactatactcctcatttgcctgtatgtagcattatcaattgggctctttttccttcttatatatcttggaagaacaggcctctctaaaatgtggcttgctgccaccaagaaagcctcatag

SEQ ID NO: 4392 - RNA, 3594 nt, synthetic construct
  misc_feature 1..3594: note = derived and/or modified CDS sequence (wt) from RVFV(RVFBJ01/2016)__KX785331.1__GP
  source 1..3594: mol_type = other RNA
atgtatgttttactaacaattctaatctcggttctggtgtgtgaagcgattattagagtgtctctaagctccacaagagaggaaacctgttttggtgactccaccaacccagagatgattgaaggagcttgggattcactcagagaggaggagatgccagaagagctctcctgttccatatctggcataagggaggtcaagacctcaagccaggaattatacagggcattaaaagccatcattgctgctgatggcttgaacaacatcacctgccatggtaaggatcctgaggacaaaatttctctcataaagggtcctcctcacaagaagcgggtggggatagttcggtgtgagagacgaagggacgctaagcaaatagggagagaaaccatggcagggattgcaatgacagttcttcccgccttagcagtttttgctttggcacctgttgtttttgctgaggaccctcatctcagaaacagaccagggaagggacataactacattgacgggatgactcaggaggatgccacatgcaaacctgtgacatatgctggggcatgtagcagttttgatgttttgctcgaaaagggaaaattccccctcttccagtcatatgctcatcatagaactctactagaggcagttcacgacaccatcattgcaaaggctgatccacctagctgtgatctccagagtgctcatgggaatccctgcatgaaagagaaactcgtgatgaagacacactgtccaaatgactaccagtcagctcattacctcaacaatgacgggaaaatggcttcagtcaagtgccctcctaagcatgagcttactgaggactgcaacttttgtaggcagatgacaggtgctagcttgaagaaggggtcttatcctctccaggacttattttgtcagtcaagtgaggatgatggatcaaaactaaagacaaaaatgaaaggggtctgcgaagtgggggttcaggcactcaaaaagtgtgatggccaactcagcactgcacatgaggttgtgccctttgcagtgtttaagaattcaaagaaggtttatcttgacaagcttgaccttaagactgaagaaaatctgctaccagactcatttgtctgctttgagcataagggacagtataaaggaacaatggactctggtcagactaagagggagctcaaaagctttgatatctctcagtgccccaagattgggggacatggtagcaagaagtgcactggggacgcagcattttgctctgcttatgagtgtactgctcaatatgccaatgcctattgttcacatgctaatgggtctgggattgtacagatacaagtatccggggtctggaagaagcctttatgtgtggggtatgagagagtggttgtgaagagagaactctctgccaagcccatccagagagttgagccttgcacaacttgcataaccaaatgtgagcctcatggattggttgtccgatcaacagggttcaagatatcatctgcagttgcttgtgccagcggagtttgcgtcacaggatcgcagagcccttctactgagatcactctcaagtatccagggatatcccagtcctctgggggggatataggggttcacatggcacatgatgatcagtcagttagctccaaaatagtggctcactgccccccccaggacccgtgcctagtgcatggctgcatagtgtgtgctcatggcttgataaattaccagtgtcacactgctcttagtgcttttgttgttgtgttcgtattcagctctgttgcaataatttgtctggccattctttataaggtgctcaggtgcctaaagattgccccaaagaaagttctgaatccactaatgtggatcactgccttcatcagatgggtgtataagaagatggttgccagagtggcagacaatatcaatcaagtgaacagagaaataggatggatggaaggaggccagttggctctagggaaccctgcacccattcctcgtcatgctccgattccacgttatagcacatacctaatgctactattgattatctcatatgcatcagcatgttcagaactgattcaggcaagctccagaatcaccacttgctccacagaaggtgtcaacaccaagtgtaggctgtctggcacagcattaatcagggcagggtcagttggggcagaggcttgtttaatgttaaagggggtcaaggaagaccagaccaagttcttgaagataaaaactgtctcaagtgagctatcgtgcagggagggccagagctattggactgggtcctttagccccaaatgtctgagctcaaggagatgccatcttgtcggagaatgtcatgtgaataggtgtctgtcttggagggacaatgaaacttcagcagaattttcatttgttggggaaagcacgaccatgcgagagaataagtgttttgagcagtgtggaggatggggatgtggatgtttcaatgtgaacccatcttgcttatttgtgcacacgtatctgcaatcagttagaaaagaggctcttagagtttttaactgtattgattgggtgcataaactcactctagagatcacagactttgatggctctgtttcaacaatagacttgggagcatcatctagccgtttcacaaactggggctcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagaatcttctgtcctgagtgctcatgagtcatgccttagggcaccaaaccttatctcatacaaacccatgatagatcagttggagtgcacaacaaatctgattgatccctttgttgtctttgagaggggatctctgccacagacaaggaatgacaaaacctttgcagcttcaaaaggaaataggggtgttcaagctttctctaaaggctctgtacaggctgatctaactctgatgtttgacaattttgaggtggactttgtgggagcagccgtgtcttgtgatgccgccttcttaaatttgacaggttgctattcctgcaatgctggagccagagtctgcctgtctatcacatccacaggaactggaactctttctgcccacaataaggatgggtctctgcatatagttcttccatcagagaatggaacaaaagatcagtgtcagatactacacttcactgtacctgaggtggaggaggagttcatgtactcttgtgatggagatgagcgacctttgttggtgaaggggaccctaatagctattgatccatttgatgataggcgagaagcagggggagaatcaacagttgtgaatccaaaatctggatcttggaacttctttgactggttttctggacttatgagttggtttggaggacctcttaagactatactcctaatttgcctgtatgtagcattatcaattgggctctttttccttcttatatatcttggaagaacaggtctctctaaaatgtggcttgctgccactaagaaagcctcatag

SEQ ID NO: 4393 - RNA, 3594 nt, synthetic construct
  misc_feature 1..3594: note = derived and/or modified CDS sequence (wt) from RVFV(Lunyo)__KU167026.1__GP
  source 1..3594: mol_type = other RNA
atgtatgttttactaacaattctaatctcggttttggtgtgtgaagcggttattagagtgtctctaagctccacaagagaagagacctgttttggtgactccaccaacccagagatgattgaaggagcttgggattcactcagagaggaggagatgccagaagaactctcctgttctatatcaggcataagagaggttaaaacctcaagccaggaattatacagggcattaaaagccatcattgctgctgatggcttgaacaacatcacctgccatggtaaggatcctgaggacaagatttctctcataaagggtcctcctcacaaaaagcgggtggggatagttcggtgtgagagacgaagagacgctaagcaaatagggagagaaaccatggcagggattgcaatgacagtccttccagccttagcagtttttgctttggcacctgttgtttttgctgaagaccctcatctcagaaatagaccagggaaggggcacaactacattgacgggatgactcaggaggatgccacatgtaaacctgtgacatatgctggggcatgtagcagttttgatgtcttgcttgaaaagggaaaatttcccctcttccagtcgtatgctcatcatagaactctactggaggcagttcatgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcactgaagactgcaacttttgtaggcagatgacaggtgctagcttgaagaaggggtcttatcccctccaggacctattttgtcagtcaagtgaggatgatggatcaaaattaaaaacaaaaatgaaaggggtctgcgaagttggggttcaagcactcaaaaagtgtgatggccaactcagcactgcacatgaggttgtgccctttgcagtgtttaagaactcaaagaaggtttatcttgataagcttgacctcaagactgaggaaaatctgctaccagactcatttgtctgcttcgagcacaagggacagtataaaggaacaatggtctctggtcagactaagagggagctcaaaagctttgatatctctcagtgtcccaagattggaggacatggtagcaagaagtgcactggggacgcagcattttgctctgcttatgagtgcactgctcaatatgccaatgcctattgctcacatgctaatggatcaggaattgtacagatacaagtatccggggtctggaagaagcctttatgtgtagggtatgagagagtggttgtgaagagagaactctctgccaagcccatccagagagttgagccttgcacaacttgtataaccaaatgtgagcctcatggattggttgtccggtcaacagggttcaagatatcatctgcagttgcttgtgctagcggagtttgcgtcacaggatcgcagagtccttctaccgagattacactcaagtatccagggatatcccagtcctctgggggggacataggggttcacatggcacatgatgatcagtcagttagttccaaaatagtagctcactgccctccccaggacccgtgcctagtgcatggctgcatagtgtgtgctcatggcctgataaattaccagtgtcacactgctctcagtgcctttgttgttgtgttcgtattcagctctgttgcaataatttgtttggccattctttataaggtgctcaagtgcctaaagattgccccaaggaaagttctgaatccactaatgtggattactgccttcatcagatgggtgtataagaagatggttgccagagtggcagacaatatcaatcaagtgaacagggaaataggatggatggaaggaggtcagttggctctagggaaccctgcccctattcctcgtcatgctccaattccacgttatagcacatacctaatgctactattgattgtctcatatgcatcagcatgttcagaactgattcaggcaagctccagaatcaccacttgctccacagaaggtgtcaacaccaggtgtaggctgtctggcacagcattaatcagggcagggtcagttggggcagaggcttgtttgatgttaaagggggtcaaggaagaccaaaccaagttcttgaagataaaaactgtctcaagtgagctatcgtgcagggagggccagagctattggactggatcctttagccccaaatgtctgagctcaaggagatgccatcttgtcggggaatgtcatgtgaataggtgtctgtcttggagggacaatgaaacttcagcagaattttcatttgttggggaaagcacgactatgcgagagaataaatgttttgagcagtgtggaggatggggatgtgggtgtttcaatgtgaacccatcttgcttatttgtgcacacgtatctgcagtcagttagaaaagaggcccttagagttttcaactgtatcgattgggtgcataaactcactctagagattacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagaatcttcagtcctgagtgctcatgaatcatgccttagggcaccaaaccttatttcatacaagcccatgatagatcagttggagtgcacaacaaatttgattgatccctttgttgtctttgagaggggttctctaccacagacaaggaatgacaaaacctttgcagcttcaaaaggaaataggggtgttcaagctttctctaagggctctgtacaagctgacctaactctgatgtttgacaattttgaggtggactttgtgggggcagccgtgtcttgtgatgccgccttcttaaatttgacaggttgctattcctgcaatgcaggggccagagtctgcctgtctatcacatccacaggaactggaactctctctgcccacaataaggatgggtctctgcatatagttcttccatcagagaatggaacaaaagatcagtgtcagatactacacttcactgtacctgaggtggaggaggagtttatgtactcttgtgatggagatgagcggcctctgttggtgaaggggaccctgatagctattgatccatttgatgataggcgagaagcagggggggaatcaacagttgtgaatccaaaatctggatcttggaatttctttgactggttttctggactcatgagttggtttggagggccccttaagactatactccttatttgcctgtatgtagcattatcaattgggctctttttccttcttatatatcttggaagaacaggtctctctaaaatgtggcttgctgccactaagaaagcctcatag

SEQ ID NO: 4394 - RNA, 3594 nt, synthetic construct
  misc_feature 1..3594: note = derived and/or modified CDS sequence (wt) from RVFV(2007000234)__JF326191.1__GP
  source 1..3594: mol_type = other RNA
atgtatgttttattgacaattctaatctcggttctggtgtgtgaagcggttattagagtgtctctaagctccacaagagaggaaacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaataaggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtaccagaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4395 - RNA, 3594 nt, synthetic construct
  misc_feature 1..3594: note = derived and/or modified CDS sequence (wt) from RVFV(KEN07-KUR340)__EF460404.1__GP
  source 1..3594: mol_type = other RNA
atgtatgttttattgacaattctaatctcggttctggtgtgtgaagcggttattagagtgtctctaagctccacaagagaggaaacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctcttataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgacccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgacatctctcagtgccccaagattggagggcatggtagtaagaagtgcactggggacgcagcattctgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttataggatgctcaagtgcttaaagattgccccaaggatagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcgtctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4396 - RNA, 3594 nt, synthetic construct
  misc_feature 1..3594: note = derived and/or modified CDS sequence (wt) from RVFV(2373/74)__DQ380194.1__GP
  source 1..3594: mol_type = other RNA
atgtatgttttactaacaattctaatctcggttctggtgtgtgaagcagttattagagtgtctctaagctccacaagagaagaaacctgttttggtgactccaccaacccagagatgattgaaggagcttgggattcactcagagaggaggagatgccagaagagctctcctgttccatatcaggcataagagaggttaagacctcaagccaggaattatacagggcactaaaagccatcattgctgctgatggcttgaacaacatcacctgctatggtaaggatcctgaggacaagatttctctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagaccctcatctcagaaacagaccagggaaggggcacaactacattgacgggatgactcaggaggatgccacatgtaaacctgtgacatatgctggggcatgtagcagttttgatgtcttgctcgaaaagggaaaattccccctcttccagtcatatgctcatcatagaactctactagaggcagttcacgacaccatcattgcaaaggctgacccacctagctgtgacctccagagtgctcatgggaatccctgcatgaaagagaaactcgtgatgaagacacactgcccaaatgactaccagtcagctcattacctcaacaatgacgggaaaatggcttcagtcaagtgccctcctaagtatgagctcactgaggactgcaacttttgtaggcagatgacaggtgctagcttgaagaaggggtcttatcctctccaggacttgttctgtcaatcaagtgaggatgatggatcaaaattaaaaacaaaaatgaaaggggtctgcgaagtgggggttcaagcactcaaaaagtgtgatggccaactcagcactgcacatgaggttgtgccatttgcagtgtttaaaaactcaaagaaggtttatcttgacaagcttgacctcaagactgaggaaaatctgctaccagactcatttgtctgcttcgagcataagggacagtataaagggacaatggactctggtcagactaagagggagctcaaaagttttgatatctctcagtgccccaagattggaggacatggtagcaagaagtgcactggggacgcagcattttgctctgcttatgagtgcactgctcaatacgccaatgcctattgttcacatgctaatgggtcaggaattgtacagatacaagtatccggggtctggaagaagcctttatgtgtaggatatgagagagtggttgtgaagagagaactctctgctaagcccatccagagagttgagccttgcacaacttgtataaccaaatgcgagcctcatgggttggttgtccgatcaacagggttcaagatatcttctgcagttgcttgtgctagcggagtttgcgtcacaggatcacagagcccttctaccgagattacactcaagtatccaggaatatcccagtcctctgggggggacataggggttcacatggcacatgatgatcagtcagttagctccaaaatggtagctcactgccccccccaggacccgtgcctagtgcatggctgcatagtgtgtgctcatggcttgataaattaccagtgtcacactgctctcagtgcctttgttgttgtgttcgtattcagctctgttgcaataatttgtttggccattctttataaggtgctcaagtgcctaaagattgccccaaggaaagttctgaatccactaatgtggattactgccttcatcaggtgggtgtataagaagatggttgccagagtggcagacaatatcaatcaagtgaacagggaaataggatggatggaaggaggccagttggctctagggaaccctgcccctattcctcgtcatgccccaattccacgttatagcacatacctaatgctactattgattgtctcatatgcatcagcatgttcagaactgattcaggcaagctccagaatcaccacctgctccacagaaggtgtcaacaccaagtgtaggctgtctggcacagcattaatcagggcagggtcagttggggcagaggcttgtttgatgttaaagggggtcaaagaagaccaaaccaagttcttgaagataaaaactgtctcaagtgagctatcgtgcagggaaggccagagctattggactgggtcctttagccccaaatgcctgagctcaaggaggtgccatcttgtcggggaatgtcatgtgaataggtgtctgtcttggagggacaatgaaacttctgcagaattttcatttgttggggaaagcacgaccatgcgagagaataagtgttttgagcagtgtggaggatggggatgtgggtgtttcaatgtgaatccatcttgcttatttgtgcacacgtatctgcagtcggttagaaaagaggcccttagagttttcaactgtattgattgggtgcataaactcactctagagatcacagactttgatggctctgtttcaacattagacttgggagcatcatctagccgtttcacaaactggggttcggttagcctctcactggatgcagagggcatttcaggctcaaatagcttttctttcattgagagcccaggcaaagggtatgcaattgttgatgagccattctcagaaattcctcggcaagggttcttgggagagatcaggtgcaattcagaatcttcagtcctgagtgctcatgaatcatgccttagggcaccaaaccttatctcatacaagcctatgatagatcagttggagtgcacaacaaatctgattgatccctttgttgtctttgagaggggttctctgccacagacaaggaatgaaaaaacctttgcagcttcaaaaggaaataggggtgttcaagctttctccaagggctctgtacaagctgatcttactctgatgtttgacaattttgaggtggactttgtgggagcagccgtgtcttgtgatgccgccttcttaaatttaacaggttgctattcctgcaatgcaggagccagagtctgcttgtctatcacatccacaggaactggaactctctctgcccacaataaggatgggtctctgcacatagttcttccatcagagaatggaacaaaagatcagtgtcagatactacacttcactgtacctgaggtggaggaggagtttatgtactcttgtgatggagatgagcggcctctattggtgaaggggaccctgatagctattgatccatttgatgataggcgagaagcaggaggggaatcaacagttgtgaatccaaaatctggttcttggaatttctttgactggttttctggacttatgagttggtttggagggcctcttaagaccatactcctaatttgcctgtatgtggcattatcaattgggctctttttcctccttatatatcttggaagaacaggtctctctaaaatgtggcttgctgccactaagaaagcctcatag

SEQ ID NO: 4397 - RNA, 3594 nt, synthetic construct
  misc_feature 1..3594: note = derived and/or modified CDS sequence (wt) from RVFV(200803169)__JF311384.1__GP
  source 1..3594: mol_type = other RNA
atgtatgttttattgacaattctaatctcggttctggtgtgtgaagcggttattagagtgtctctaagctccacaagagaggaaacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgacccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgacatctctcagtgccccaagattggagggcatggtagtaagaagtgcactggggacgcagcattctgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggtagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagattcctcggcaagggttcttgggggaggtcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4398 - RNA, 3594 nt, synthetic construct
  misc_feature 1..3594: note = derived and/or modified CDS sequence (wt) from RVFV(200803167)__JF311382.1__GP
  source 1..3594: mol_type = other RNA
atgtatgttttattgacaattctaatctcggttctggtgtgtgaagcggttattagagtgtctctaagctccacaagagaggagacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacctccatctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattgcactcaagtatccagggatatcccagtcctctgggggggatataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagggaaataggatggatggaagggggtcagttggttctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgtttcgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaatgggacaaaagatcagtgtcagatactacatttcactgtacctgaagtagaagaggagtttatgtactcttgtgatggagatgagcggcctctgttagtgaaagggaccctgatagctattgacccatttgatgataggcgggaagcagggggggaatcaacagttgtgaatccaaaatctggatcttggaatttctttgactggttttctggactcatgagttggtttggagggccgcttaaaactatgctcctcatttgcctgtatgttgcattatcaattgggctcttcttcctccttatatatcttggaagaacaggcctctctaaaatgtggcttgccgctactaagaaggcctcatag

SEQ ID NO: 4399 - RNA, 3594 nt, synthetic construct
  misc_feature 1..3594: note = derived and/or modified CDS sequence (wt) from RVFV(Entebbe)__DQ380191.1__GP
  source 1..3594: mol_type = other RNA
atgtatgctttactaacaattctaatctcggttctggtgtgtgaagcggttattagagtgtctctaagctccacaagagaagaaacctgttttggtgactccaccaacccagagatgattgaaggagcttgggattcactcagagaggaggagatgccagaggagctctcctgttccatatcaggcataagggaggttaagacctcaagccaggaattacacagggcattaaaagccatcattgctgctgatggcttgaacaacatcacctgccatggtaaggatcctgaggacaagatttctctcataaaaggtcctcctcacaaaaagcgggtgggggtagttcggtgtgagagacgaagagacgctaagcaaatagggagagaaaccatggcagggattgcaatgacagtccttccagccttagcagtttttgctttggcacctgttgtttttgctgaagaccctcatctcagaaacagaccagggaagggacacaactacattgacgggatgactcaggaggatgccacatgtaaacctgtgacatatgctggggcatgtagcagttttgatgtcttgctcgaaaagggaaaatttcccctcttccagtcgtatgctcatcatagaactctattagaggcagttcacgacaccatcattgcaaaggctgatccacctagctgtgaccttcagagtgctcatgggaatccctgcatgaaagagaaactcgtaatgaagacacactgtccaaatgactaccagtcagctcattacctcaacaatgacgggaaaatggcttcagtcaagtgccctcctaagtatgagctcactgaggactgcaacttttgtaggcagatgacaggtgctagcttgaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgacaagcttgacctcaagactgaggaaaatctgctaccagactcatttgtctgcttcgagcataagggacagtacaaaggaacaatggactctggtcagattaagagggagctcaaaagctttgatatctctcagtgccccaagattggaggacatggtagcaagaagtgcactggggacgcagcattttgctctgcttatgagtgtactgctcaatacgccaatgcctattgttcacatgctaatgggtcaggaattgtacagatacaagtatccggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagcccttctactgagattacactcaagtatccagggatatcccagtcctctgggggagacataggggttcacatggcacatgatgatcagtcagttagctccaaaatagtagctcactgccccccccaggacccgtgcctagtgcatggctgcatagtgtgtgctcatggcttgataaattaccagtgtcacactgctctcagtgcctttgttgttgtgttcgtattcagctctgttgcaataatttgtttggccattctttataaggtgctcaagtgcctaaagattgccccaaggaaagttctgaatccactaatgtggattactgccttcatcagatgggtgtataagaagatggttgctagagtggcagacaatatcaatcaagtgaacagggaaataggatggatggaaggaggccagttggttctagggaaccctgcccctattcctcgtcatgctccaattccacgttatagcacatacctaatgctgctattgattgtctcatatgcatcagcatgttcagaactaattcaggcaagctccagaatcaccacctgctccacagaaggtgtcaacaccaagtgtaggctgtctggcacagcattaatcagggcagggtcagttggggcagaggcttgtttgatgttaaagggggtcaaggaagaccagaccaagttcttgaagataaaaactgtctcaagtgagctatcgtgtagggagggccagagctattggactgggtcctttagccccaaatgtctgagctcaaggagatgccatcttgtcggagaatgtcatgtgaataggtgtctgtcttggagggacaatgagacttcagcagaattttcatttgttggggaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtattgattgggtgcataaactcactctagagatcacagactttgatggctctgtttcaacagtagacttgggagcatcatctagccgtttcacaaactggggttcagttagcctctcactggacgcagagggcatttcaggctcaaatagcttctctttcattgagagcccaggcaaagggtatgcaattgttgatgagccattctcagaaattcctcggcaagggttcttgggagagatcaggtgcaattcagaatcttcagtcctgagtgctcatgaatcatgccttagggcaccaaaccttatctcatacaaacccatgatagatcagttggagtgcacaacaaatctgattgatccctttgttgtctttgagaggggttctctgcctcagacaaggaatgacaaaacctttgcagcttcaaaaggaaataggggtgttcaagctttctctaagggctctgtacaagctgatctaactctgatgtttgacaattttgaggtggactttgtgggagcagccgtgtcttgtgatgccgccttcttaaacttgacaggttgctattcctgcaatgcaggggccagagtctgtctgtctatcacatctacaggaactggaactctttctgcccacaataaggatgggtctctgcatatagttcttccatcagagaatggaacaaaagatcagtgtcagatactacacttcactgtacctgaggtggaggaggagtttatgtactcttgtgatggagatgagcggcctctgttggtgaaggggaccctgatagctattgatccatttgatgataggcgagaagcagggggggaatcaacagttgtgaatccaaaatctggatcttggaacttctttgactggttttctggacttatgagttggtttggagggcctcttaagactatactcctaatttgcctgtatgtagcattatcaattgggctctttttccttcttatatatcttggaagaacaggtctctccaaaatgtggcttgctgccactaagaaagcttcatag

SEQ ID NO: 4400 - RNA, 3594 nt, synthetic construct
  misc_feature 1..3594: note = derived and/or modified CDS sequence (wt) from RVFV(25010-24)__KM210509.1__GP
  source 1..3594: mol_type = other RNA
atgtatgttttactaacaattctaatctcggttctggtgtgtgaagcggttattagagtgtctctaagctccacaagagaagaaacctgttttggtgactccaccaacccagaaatgattgagagagcttgggattcactcagagaggaggagatgccagaagagctctcttgttccatatcaggcataagggaggttaagacctcaagccaggaattatacagggcattaaaagctatcattgctgctgatggcttgaacaacatcacctgccatggtaaggatcctgaggacaagatttctctcataaagggtcctcctcacaagaagcgagtggggatagttcggtgtgagagacgaagagacgctaagcaagtagggagagaaaccatggcagggattgcaatgacagtccttccagccttagcagtttttgctttggcacctgttgtctttgccgaagaccctcatcttagaaacaggccaggaaagggacacaactacattgacgggatgactcaggaggatgccacatgtaaacctgtgacatatgctggggcatgtagcagttttgatgtcttgctcgaaaagggaaaatttcccctcttccagtcatacgctcatcatagaactctactagaggccgtccacgacaccattattgcaaaggctgatccacctagctgtgaccttcagagtgctcatgggaatccctgcatgaaggagaaactcgtgatgaagacacactgtccaaatgactaccagtcagctcattaccttaacaatgacgggaaaatggcctcagtcaagtgccctcctaagtatgagctcactgaggactgcaacttttgtaggcagatgacaggtgctagcctgaagaaagggtcttatcctctccaggacttattttgtcagtcaagtgaggatgatgggtcaaaattaaaaacaaaaatgaaaggggtctgcgaagtgggagttcaagcactcaaaaagtgtgatggccaactcagcactgcacatgaggttgtgccctttgcagtatttaagaactcaaagaaggtttatcttgacaagcttgacctcaagactgaggaaaatctgctaccagactcatttgtctgcttcgagcataaggggcagtataaaggaacaatggactctggtcagacaaagagggagctcaaaagctttgatatctctcagtgtcccaagattggagggcatggtagcaagaaatgtactggggacgcagcattctgctctgcttatgagtgcactgctcaatacgccaatgcctattgttcacatgctaatgggtcaggaattgtacagatacaagtatccggggtctggaagaagcctttgtgtgtagggtatgagagagtggttgtgaagagagagctctctgccaagcccatccagagagttgagccttgcacaacttgtataaccaaatgtgagcctcatggattaattgtccgatcaacagggttcaagatatcatctgcagttgcttgtgctagcggagtttgcgtcacaggatcgcagagcccgtctactgagatcacactcaagtacccagggatatcccagtcctctgggggggacataggggttcacatggcacatgatgatcagtcagttagctccaaaatagtagctcactgccccccccaggacccgtgcctagtgcatggctgcatagtgtgtgctcatggcttgataaattaccagtgtcacactgctctcagtgcctttgtcgttgtgttcgtgttcagctctgttgcaataatttgtttggctattctttataaggtgctcaagtgcctaaaaattgccccaaagaaagttctaaatccactgatgtggattactgctttcatcagatgggtgtataagaagatggttgccagagtggcagacaatatcaatcaagtgaacagggaaataggatggatggaaggaggccagttagctctagggaatcctgctcctatccctcgtcatgctccaattccacgttatagcacatacctaatgctactattgattgtctcatatgcatcagcatgttcagaactgattcaggccagctccagaatcactacttgctccacagaaggtgttaacactaagtgtaggctgtctggcacagcattgatcagggcaggatcagttggagcagaagcttgtctgatgttaaagggggtcaaggatgaccaaaccaagttcctgaagataaaaactgtctcaagtgagctatcgtgcagggagggccagagctattggactgggtccttcagccccaaatgtctgagctcaaggaggtgccatcttgtcggggaatgtcatgtgaataggtgtctgtcttggagggacaatgagacttcagcagaattttcatttgttggggaaagcacgaccatgcgagagaacaagtgttttgagcagtgtggaggatggggatgtgggtgtttcaacgtaaacccatcttgcttgtttgtgcacacgtatctacagtcagtcagaaaagaggcccttagagtttttaactgcattgattgggtgcataaacttactctagagatcacagactttgatggctctgtttcaacaatagacttgggagcttcatctagccgtttcacaaactggggttcagttagcctctcactggacgcagagggcatttcaggctcaaatagcttttctttcattgagagcccaggcaaagggtatgcaattgttgatgagccattctcagaaattcctcggcaaggattcttaggagagatcaggtgcaattcagaatcttcagttctgagtgctcatgaatcatgccttagggcgccaaaccttatctcatacaaaccaatgatagatcagttggagtgcacaacaaatctaattgatccttttgtagtctttgagaggggttccctgccacaaacaaggaatgacaaaacctttgcagcttcaaaagggaataggggtgttcaagctttctctaagggctctgtacaagctgatctaactctgatgtttgacaattttgaggtggacttcgtgggagcagccgtgtcttgtgatgccgccttcttgaatttgacaggttgctattcatgcaatgcaggagccagagtctgcctgtctatcacatccacaggaactggaactctttctgcccacaataaggatgggtctctgcatatagttcttccatcagagaatggaacaaaagatcagtgtcagatactacacttcactgtacctgaggtggaggaggagtttatgtactcttgtgatggagatgagcggcctctgttggtgaaagggaccctgatagctattgatccatttgatgataggcgagaagcagggggggaatcaacagttgtgaatccaaaatctggatcttggaatttctttgactggttttctggactcatgagttggtttggagggcctctcaagactatactcctaatttgcctgtatgtagcattatcaattgggctctttttccttcttatatatcttgggagaacaggtctctctaaaatgtggcttgctgctactaagaaggcctcatag

SEQ ID NO: 4401 - RNA, 3594 nt, synthetic construct
  misc_feature 1..3594: note = derived and/or modified CDS sequence (wt) from RVFV(Kenya 9800523)__DQ380196.1__GP
  source 1..3594: mol_type = other RNA
atgtatgttttattgacaattctaatctcggttctggtgtgtgaagcggttattagagtgtctctaagctccacaagagaggagacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatactaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggccagaccaagagggagctcaaaagctttgatatctctcagtgccccaagattggagggcacggtagtaagaagtgcactggggacgcagcattttgctctgcttatgaatgcactgctcagtatgccaatgccttttgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgaacctcatggattggttgtccgatcaacagggttcaagatatcatctgcagttgcttgtgctagcggagtttgcgtcacagggtcgcagagtccttctactgagattacactcaagtatccagggatatcccagtcctctgggggggacataggggttcacatggcacatgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccattaatgtggattacagccttcatcagatgggtgtataagaagatggttgctagagtggcggacaatattaatcaagtgaacagggaaataggatggatggaaggaggtcagttggttctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagaaattcctcggcaagggttcttgggggagatcaggtgcaattcagagtcctcagtcctgaatgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgttattcctgcaatgcaggggccagagtctgcctgtctatcacatccacaggaactggaactctctctgcccacaataaggaggggtctctgcatatagttctcccatcagagaatgggacaaaagatcagtgtcagatactacatttcactgtgcctgaagtagaagaggagtttatgtactcttgtgatggagatgagcggcctctgttagtgaaagggaccctgatagctattgacccatttgatgataggcgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4402 - RNA, 3594 nt, synthetic construct
  misc_feature 1..3594: note = derived and/or modified CDS sequence (wt) from RVFV(ANK-6087)__DQ380216.1__GP
  source 1..3594: mol_type = other RNA
atgtatgttttattaacaattctaatctcggttctggtgtgtgaagcggttattagagtgtctctaagctccacaagagaagagacctgttttggtgactccaccaacccagagatgattgaaggagcttgggattcactcagagaggaggagatgccagaggagctctcctgttctatatcaggcataagggaggttaagacctcaagccaggagttatacagggcattaaaagccatcattgctgctgatggcttgaacaacatcacctgccatggtaaggatcctgaggacaagatttctctcataaagggtcctcctcataaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgagaaggggaaattcccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttaccttgataagcttgacctcaagactgaggagaatctgctaccagactcatttgtctgcttcgagcataagggacagtataaaggaaaattggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtagttgtgaagagagaactctctgccaagcccatccagagagttgagccttgcacaacttgtataaccaaatgtgagcctcatgggttggttgtccgatcaacagggttcaagatatcatctgcagttgcttgtgctagcggagtttgcgtcacaggatcgcagagtccttccaccgagattacactcaagtatccagggatatcccagtcctctggaggggacataggggttcacatggcacacgatgatcagtcagttagctccaaaatagtagctcactgccctccccaggacccgtgcttagtgcacggctgcatagtgtgtgctcatggcctgataaattaccagtgtcacactgctctcagtgcctttgttgttgtgtttgtattcagttctattgcaataatttgtttagctattctttatagggtgctcaagtgcctaaagattgccccaaggaaagttctgaatccactaatgtggattacagccttcatcagatgggtgtataggaagatggttgccagagtggcagacaatattaatcaagtgaacagggagataggatggatggaaggaggtcagttggttctagggaaccctgcccctattcctcgtcatgttccaattccacgttatagcacatacctaatgctactactgattgtctcatatgcatcagcatgttcagaactgattcaggcaagctccagaatcactacttgctccacagagggtgtcaacaccaagtgtagactgtctggcacagcattgatcagggcagggtcagttggggcagaggcttgtttgatgttgaagggggtcaaggaagatcaaaccaagttcttaaaaataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggagaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcactctggagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgagtcatgccttagggcaccaaaccttatctcatacaagcccatgatagatcaattggagtgctcaacaaatctgattgacccctttgttgtatttaagaggggttctctgccacagacaaggaatgacaaaacctttgctgcttcaaaaggaaatagaggtgttcaagctttctctaagggctctgtgcaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcagtgtcagatactacacttcactgtacctgaagtagaggaggagtttatgtactcttgtgatggagatgagcggcctctattggtgagggggactctgatagctattgatccatttgatgataggcgggaagcagggggggaatcaacagttgtgaatccaaaatctggatcttggaatttctttgactggttttctggactcatgagttggtttggagggcctcttaaaactatactcctcatttgcttgtatgttgcattatcaattgggctctttttcctcctcatatatcttggaagaacaggcctctctaaaatgtggcttgctgctactaagaaggcctcatag

SEQ ID NO: 4403 - RNA, 3594 nt, synthetic construct
  misc_feature 1..3594: note = derived and/or modified CDS sequence (wt) from RVFV(SAUDI 200010901)__KU978778.1__GP
  source 1..3594: mol_type = other RNA
atgtatgttttattgacaattctaatctcggttctggtgtgtgaagcagttattagagtatctctaagctccacaagagaggagacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgggagacgaagagatactaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttcctcttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaagaaggggtcttatcctctccaagacttattttgtcagtcaagtgaggatgatggatcaaaattgaaaacaaaaatgaaaggggtctgcgaagtgggagttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggccagaccaagagggagctcaaaagctttgatatctctcagtgccccaagattggagggcatggtagtaagaagtgcactggggacgcagcattttgctctgcttatgaatgcactgctcagtatgccaatgccttttgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgaacctcatggattggttgtccgatcaacagggttcaagatatcatctgcagttgcttgtgctagcggagtttgcgtcacagggtcgcagagtccttctactgagattacactcaagtatccagggatatcccagtcctctgggggggacataggggttcacatggcacatgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccattaatgtggattacagccttcatcagatgggtgtataagaagatggttgctagagtggcggacaatattaatcaagtgaacagggaaataggatggatggaaggaggtcagttggttctagggaaccctgcccctattcctcgtcatgccccaatcccacgttatagcacatacctaatgctgctattgattatctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggagtcaaggaagatcaaaccaagttcttaaagataaaaactgtctctagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatgggggtgtggatgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgaaaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgttattcctgcaatgcaggggccagagtctgcctgtctatcacatccacaggaactggaactctctctgcccacaataaggacgggtctctgcatatagttctcccatcagagaatgggacaaaagatcagtgtcagatactacatttcactgtgcctgaagtagaagaggagtttatgtactcttgtgatggagatgagcggcctctgttagtgaaagggaccctgatagctattgacccatttgatgataggcgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4404 - RNA, 3594 nt, synthetic construct
  misc_feature 1..3594: note = derived and/or modified CDS sequence (wt) from RVFV(35/74)__JF784387.1__GP
  source 1..3594: mol_type = other RNA
atgtatgttttactaacaattctgatcacggttctggtgtgtgaggcggttattagagtgtctctaagttccacaagagaagagacctgctttggtgactacaccaacccagagatgattgaaggagcttgggattcactcagagaggaggagatgccagaagagctctcctgttccatatcaggcataagggaggtcaaaacctcaagccaggaattgtatagggcattaaaagccatcattgctgctgatggcttgaacaacatcacctgccatggtaaggatcctgaggataagatttctctcgtaaagggtcctcctcacaaaaagcgggtggggatagttcggtgtgagagacgaagagacgctaagcaaataggaagagaaaccatggcagggattgcaatgacagtccttccagccttagcagtttttgctttggcacctgttgtttttgctgaagaccctcatctcagaaacagaccagggaaggggcacaactacattgacgggatgactcaggaggacgccacatgcaaacctgtgacatatgctggggcttgtagcagttttgatgtcttgctcgaaaagggaaaattccccctcttccagtcgtatgcccatcacagaaccctactagaagcagttcacgacaccatcattgcaaaggctgatccacctagctgtgaccttcagagtgctcatgggaatccctgcatgaaggagaaactcgtgatgaagacacactgtccaaatgactaccagtcagctcattacctcaacaatgacgggaaaatggcttcagtcaagtgccctcctaaatatgagctcactgaggactgcaatttttgcaggcagatgacaggtgctagcttgaagaaggggtcttatcctcttcaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtatttaagaactcaaagaaggtttatcttgataagcttgacctcaagactgaggaaaatctgttgccagactcatttgtctgcttcgagcataagggacagtataaaggaacaatggactctggtcagaccaagagggagctcaaaagctttgatatctctcagtgccccaagattggaggacatggtagcaagaagtgcactggggacgcagctttttgctctgcttatgagtgcactgctcaatacgccaatgcttattgttcacatgctaatgggtcaggagttgtacagatacaagtatccggggtctggaagaagcctttgtgtgtcgggtatgagagggtggttgtgaagagagaactctctgctaagcccatccagagagttgagccttgcacaacttgtataaccaaatgtgagcctcacggattggttgtccgatcaacaggtttcaagatatcatctgcagttgcttgtgctagcggagtttgcgttacaggatcgcagagcccttctaccgagattacactcaagtatccagggatatcccagtcctctgggggggacataggggttcacatggcacatgatgatcagtcagttagctccaaaatagtagctcactgccctccccaggatccatgcctagtgcatggctgcatagtgtgtgctcatggcctgataaattaccagtgtcacactgctctcagtgcctttgttgttgtgttcgtatttagctctgtcgcaataatttgtttggccattctttataaagttctcaagtgcctaaagattgccccaaggaaagttctggatccactaatgtggattactgttttcatcagatgggtgtataagaagatggttgccagagtagcagacaatatcaatcaggtgaacagggaaataggatggatggaaggaggccagctggctctagggaaccctgcccctattcctcgtcatgctccaattccacgttatagcacatacctaatgctactattgattgtctcatatgcatcagcatgttcagaactgattcaggcaagctccagaatcaccacttgctccacagaaggtgtcaacaccaagtgtaggctgtctggcacagcattaatcagggcagggtcagttggggcagaggcttgtttgatgttaaagggggtcaaggaagaccaaaccaagtttttgaagataaaaactgtctcaagtgagctatcgtgcagggagggccagagctattggactgggtcctttagccctaaatgtctgagctcaaggagatgccatcttgtcggggaatgtcatgtgaataggtgtctgtcttggagagacaatgaaacctcagcagaattttcatttgttggggaaagcacgaccatgcgggagaacaagtgttttgagcagtgtggaggatggggatgtgggtgtttcaatgtgaacccatcttgcttatttgtgcacacgtatctgcagtcagtcagaaaagaggcccttagagttttcaactgtatcgattgggtgcataaactcactctagagattactgactttgatggctctgtttcaacaatagacctgggagcatcatctagccgtttcacaaactggggttcagttagcctctcactggacgcagagggcatttcaggctcaaacagcttttccttcattgagagcccaggcaaagggtatgcaattgttgatgagccattctcagaaattcctcggcaagggttcttgggggagatcaggtgcaattcagaatcttcagtcctgagtgctcatgaatcatgccttagggcaccaaatcttatttcatacaagcccatgatagatcagttggagtgcacaacaaatctgattgatccctttgttgtctttgagaggggctctctgccacagacaaggaatgacaaaacctttgcagcttcaaaaggaaataggggtgttcaagctttctctaagggctctgtacaggctgatctaacactgatgtttgacaattttgaggtggactttgtgggagcagccgtgtcttgtgatgccgccttcttaaatttgacaggttgctattcctgcaatgcaggggccagagtctgcctgtctatcacatccacaggaactggaactctctctgcccacaataaagatggatctctgcatatagttcttccatcagagaatggaacaaaagatcagtgtcagatactacacttcactgtacctgaggtagaggaggagtttatgtactcttgtgatggagatgagcggcctctgttggtgaagggaaccctgatagctattgatccatttgatgataggcgagaagcagggggggaatcaacagttgtgaatccaaaatctggatcttggaatttctttgactggttttctggactcatgagttggtttggagggcctcttaagactatactcctcatttgcctgtatgtagcattatcaattgggctctttttccttcttatatatcttggaagaacaggcctctctaaaatgtggcttgctgccaccaagaaagcctcatag

SEQ ID NO: 4405 - RNA, 3594 nt, synthetic construct
  misc_feature 1..3594: note = derived and/or modified CDS sequence (wt) from RVFV(KEN/Kil-006/07)__HM586966.1__GP
  source 1..3594: mol_type = other RNA
atgtatgttttattgacaattctaatctcggttctggtgtgtgaagcggttattagagtgtctctaagctccacaagagaggaaacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtgggggtagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctgatggtaataaatgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgccactaagaaggcctcatag

SEQ ID NO: 4406 - RNA, 3594 nt, synthetic construct
  misc_feature 1..3594: note = derived and/or modified CDS sequence (wt) from RVFV(MgH824)__DQ380210.1__GP
  source 1..3594: mol_type = other RNA
atgtatgttttattaacaattctaatctcggttctggtgtgtgaagcggttattagagtgtctctaagctccacaagagaagagacctgctttggtgactccactaacccagagatgattgaaggagcttgggattcactcagagaggaggagatgccggaggagctctcctgttctatatcaggcataagggaggttaagacctcaagccaggagttatacagggcattaaaagccatcattgctgccgatggcttgaacaacatcacctgccatggtaaggatcctgaggacaagatttccctcataaagggtcctcctcacaaaaagcgggtggggatagttcggtgtgagaggcgaagagatgctaagcaaatagggagagaaaccatggcagggattgcaatgacagtccttccagccttagcagtttttgctttggcacctgttgtttttgctgaagacccccatctcagaaacagaccagggaaggggtacaactacattgacgggatgactcaggaggatgccacatgcaaacctgtgacatatgctggggcatgtagcagttttgatgtcttgcttgaaaaggggaaatttccccttttccagtcgtatgctcatcatagaactctactagaggcagttcacgacaccatcattgcaaaggctgacccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcgtaagggacagtacaaaggaacaatggactctggtcagactaagagggagctcaaaagctttgatatctctcagtgccccaagattggaggacatggtagtaagaagtgcactggggacgcagcattttgctctgcttatgagtgcactactcagtacgccaatgcctattgttcacatgctaatgggtcaggggttgtgcagatacaagtgtcaggggtctggaagaagcctttatgtgtaggatatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgccacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaatattaatcaagtgaacagggaaataggatggatggaaggaggtcagttggttctagggaaccctgcccctattcctcgtcatgccccaatcccacgttatagcacatacctgatgttactattgattgtctcatatgcatcagcatgttcagaactgattcaggcaagctccagaatcaccacttgctctacagagggtgttgacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacaaccatgcgagagaataagtgttttgagcagtgtggaggatgggggtgtgggtgtttcaatgtgaacccatcttgcttatttgtgcacacgtatctgcagtcagttagaaaagaggcccttagagtttttaactgtatcgactgggtacataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattcccagagattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgacccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacatttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaaggacaggcctctctaaaatgtggcttgctgccactaagaaggcctcatag

SEQ ID NO: 4407 - RNA, 3594 nt, synthetic construct
  misc_feature 1..3594: note = derived and/or modified CDS sequence (wt) from RVFV(Kenya 57 (Rintoul))__DQ380192.1__GP
  source 1..3594: mol_type = other RNA
atgtatgctttactaacaattctaatctcggttctggtgtgtgaagcggttattagagtgtctctaagctccacaagagaagaaacctgttttggtgactccaccaacccagagatgattgaaggagcttgggattcactcagagaggaggagatgccagaggagctctcctgttccatatcaggcataagggaggttaagacctcaagccaggaattacacagggcattaaaagccatcattgctgctgatggcttgaacaacatcacctgccatggtaaggatcctgaggacaagatttctctcataaagggtcctcctcacaaaaagcgggtgggggtagttcggtgtgagagacgaagagacgctaagcaaatagggagagagaccatggcagggattgcaatgacagtccttccagccttagcagtttttgctttggcacctgttgtttttgctgaagaccctcatctcagaaacagaccagggaagggacacaactacattgacgggatgactcaggaggatgccacatgtaaacctgtgacatatgctggggcatgtagcagttttgatgtcttgctcgaaaagggaaaatttcccctcttccagtcgtatgctcatcatagaactctattagaggcagttcacgacaccatcattgcaaaggctgatccacctagctgtgaccttcagagtgctcatgggaatccctgcatgaaagagaaactcgtaatgaagacacactgtccaaatgactaccagtcagctcattacctcaacaatgacgggaaaatggcttcagtcaagtgccctcctaagtatgagctcactgaggactgcaacttttgtaggcagatgacaggtgctagcttgaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgacaagcttgacctcaagactgaggaaaatctgctaccagactcatttgtctgcttcgagcataagggacagtacaaaggaacaatggactctggtcagattaagagggagctcaaaagctttgatatctctcagtgccccaagattggaggacatggtagcaagaagtgcactggggacgcagcattttgctctgcttatgagtgtactgctcaatacgccaatgcctattgttcacatgctaatgggtcaggaattgtacagatacaagtatccggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagcccttctactgagattacactcaagtatccagggatatcccagtcctctgggggagacataggggttcacatggcacatgatgatcagtcagttagctccaaaatagtagctcactgccccccccaggacccgtgcctagtgcatggctgcatagtgtgtgctcatggcttgataaattaccagtgtcacactgctctcagtgcctttgttgttgtgttcgtattcagctctgttgcaataatttgtttggccattctttataaggtgctcaagtgcctaaagattgccccaaggaaagttctgaatccactaatgtggattactgccttcatcagatgggtgtataagaagatggttgccagagtggcagacaatatcaatcaagtgaacagggaaataggatggatggaaggaggccagttggttctagggaaccctgcccctattcctcgtcatgctccaattccacgttatagcacatacctaatgctgctattgattgtctcatatgcatcagcatgttcagaactaattcaggcaagctccagaatcaccacttgctccacagaaggtgtcaacaccaagtgtaggctgtctggcacagcattaatcagggcagggtcagttggggcagaggcttgtttgatgttaaagggggtcaaggaagaccagaccaagttcttgaagataaaaactgtctcaagtgagctatcgtgtagggagggccagagctattggactgggtcctttagccccaaatgtctgagctcaaggagatgccatcttgtcggagaatgtcatgtgaataggtgtctgtcttggagggacaatgaaacttcagcagaattttcatttgttggggaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtattgattgggtgcataaactcactctagagatcacagactttgatggctctgtttcaacagtagacttgggagcatcatctagccgtttcacaaactggggttcagttagcctctcactggacgcagagggcatttcaggctcaaatagcttctctttcattgagagcccaggcaaagggtatgcaattgttgatgagccattctcagaaatttctcggcaagggttcttgggagagatcaggtgcaattcagaatcttcagtcctgagtgctcatgaatcatgccttagggcaccaaaccttatctcatacaaacccatgatagatcagttggagtgcacaacaaatctgattgatccctttgttgtctttgagaggggttctctgcctcagacaaggaatgacaaaacctttgcagcttcaaaaggaaataggggtgttcaagctttctctaagggctctgtacaagctgatctaactctgatgtttgacaattttgaggtggactttgtgggagcagccgtgtcttgtgatgccgccttcttaaacttgacaggttgctattcctgcaatgcaggggccagagtctgcctgtctatcacatccacaggaactggaactctttctgcccacaataaggatgggtctctgcatatagttcttccatcagagaatggaacaaaagatcagtgtcagatactacacttcactgtacctgaggtggaggaggagtttatgtactcttgtgatggagatgagcggcctctgttggtgaaggggaccctgatagctattgatccatttgatgataggcgagaagcagggggggaatcaacagttgtgaatccaaaatctggatcttggaatttctttgactggttttctggacttatgagttggtttggagggcctcttaagactatactcctaatttgcctgtatgtagcattatcaattgggctctttttccttcttatatatcttggaagaacaggtctctccaaaatgtggcttgctgccactaagaaagcttcatag

SEQ ID NO: 4408 - RNA, 3594 nt, synthetic construct
  misc_feature 1..3594: note = derived and/or modified CDS sequence (wt) from RVFV(SA-75)__DQ380189.1__GP
  source 1..3594: mol_type = other RNA
atgtatgttttactaacaattctgatcacggttctggtgtgtgaggcggttattagagtgtctctaagttccacaagagaagagacctgctttggtgactacaccaacccagagatgattgaaggagcttgggattcactcagagaggaggagatgccagaagagctctcctgttccatatcaggcataagggaggtcaaaacctcaagccaggaattgtatagggcattaaaagccatcattgctgctgatggcttgaacaacatcacctgccatggtaaggatcctgaggataagatttctctcgtaaagggtcctcctcacaaaaagcgggtggggatagttcggtgtgagagacgaagagacgctaagcaaataggaagagaaaccatggcaaggattgcaatgacagtccttccagccttagcagtttttgctttggcacctgttgtttttgctgaagaccctcatctcagaaacagaccagggaaggggcacaactacattgacgggatgactcaggaggacgccacatgcaaacctgtgacatatgctggggcttgtagcagttttgatgtcttgctcgaaaagggaaaattccccctcttccagtcgtatgcccatcacagaaccctactagaagcagttcacgacaccatcattgcaaaggctgatccacctagctgtgaccttcagagtgctcatgggaatccctgcatgaaggagaaactcgtgatgaagacacactgtccaaatgactaccagtcagctcattacctcaacaatgacgggaaaatggcttcagtcaagtgccctcctaaatatgagctcactgaggactgcaatttttgcaggcagatgacaggtgctagcttgaagaaggggtcttatcctcttcaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtatttaagaactcaaagaaggtttatcttgataagcttgacctcaagactgaggaaaatctgttgccagactcatttgtctgcttcgagcataagggacagtataaaggaacaatggactctggtcagaccaagagggagctcaaaagctttgatatctctcagtgccccaagattggaggacatggtagcaagaagtgcactggggacgcagctttttgctctgcttatgagtgcactgctcaatacgccaatgcttattgttcacatgctaatgggtcaggagttgtacagatacaagtatccggggtctggaagaagcctttgtgtgtcgggtatgagagggtggttgtgaagagagaactctctgctaagcccatccagagagttgagccttgcacaacttgtataaccaaatgtgagcctcacggattggttgtccgatcaacaggtttcaagatatcatctgcagttgcttgtgctagcggagtttgcgttacaggatcgcagagcccttctaccgagattacactcaagtatccagggatatcccagtcctctgggggggacataggggttcacatggcacatgatgatcagtcagttagctccaaaatagtagctcactgccctccccaggatccatgcctagtgcatggctgcatagtgtgtgctcatggcctgataaattaccagtgtcacactgctctcagtgcctttgttgttgtgttcgtatttagctctgtcgcaataatttgtttggccattctttataaagttctcaagtgcctaaagattgccccaaggaaagttctgaatccactaatgtggattactgttttcatcagatgggtgtataagaagatggttgccagagtagcagacaatatcaatcaggtgaacagggaaataggatggatggaaggaggccagctggctctagggaaccctgcccctattcctcgtcatgctccaattccacgttatagcacatacctaatgctactattgattgtctcatatgcatcagcatgttcagaactgattcaggcaagctccagaatcaccacttgctccacagaaggtgtcaacaccaagtgtaggctgtctggcacagcattaatcagggcagggtcagttggggcagaggcttgtttgatgttaaagggggtcaaggaagaccaaaccaagtttttgaagataaaaactgtctcaagtgagctatcgtgcagggagggccagagctattggactgggtcctttagccctaaatgtctgagctcaaggagatgccatcttgtcggggaatgtcatgtgaataggtgtctgtcttggagagacaatgaaacctcagcagaattttcatttgttggggaaagcacgaccatgcgggagaacaagtgttttgagcagtgtggaggatggggatgtgggtgtttcaatgtgaacccatcttgcttatttgtgcacacgtatctgcagtcagtcagaaaagaggcccttagagttttcaactgtatcgattgggtgcataaactcactctagagattactgactttgatggctctgtttcaacaatagacctgggagcatcatctagccgtttcacaaactggggttcagttagcctctcactggacgcagagggcatttcaggctcaaacagcttttccttcattgagagcccaggcaaagggtatgcaattgttgatgagccattctcagaaattcctcggcaagggttcttgggggagatcaggtgcaattcagaatcttcagtcctgagtgctcatgaatcatgccttagggcaccaaatcttatttcatacaagcccatgatagatcagttggagtgcacaacaaatctgattgacccctttgttgtctttgagaggggctctctgccacagacaaggaatgacaaaacctttgcagcttcaaaaggaaataggggtgttcaagctttctctaagggctctgtacaggctgatctaacactgatgtttgacaattttgaggtggactttgtgggagcagccgtgtcttgtgatgccgccttcttaaatttgacaggttgctattcctgcaatgcaggggccagagtctgcctgtctatcacatccacaggaactggaactctctctgcccacaataaagatggatctctgcatatagttcttccatcagagaatggaacaaaagatcagtgtcagatactacacttcactgtacctgaggtagaggaggagtttatgtactcttgtgatggagatgagcggcctctgttggtgaagggaaccctgatagctattgatccatttgatgataggcgagaagcagggggggaatcaacagttgtgaatccaaaatctggatcttggaatttctttgactggttttctggactcatgagttggtttggagggcctcttaagactatactcctcatttgcctgtatgtagcattatcaattgggctctttttccttcttatatatcttggaagaacaggcctctctaaaatgtggcttgctgccaccaagaaagcctcatag

SEQ ID NO: 4409 - RNA, 3594 nt, synthetic construct
  misc_feature 1..3594: note = derived and/or modified CDS sequence (wt) from RVFV(SA01-1322)__KX096942.1__GP
  source 1..3594: mol_type = other RNA
atgtatgttttattgacaattctaatctcggttctggtgtgtgaagcagttattagagtatctctaagctccacaagagaggagacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgggagacgaagagatactaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttcctcttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaagaaggggtcttatcctctccaagacttattttgtcagtcaagtgaggatgatggatcaaaattgaaaacaaaaatgaaaggggtctgcgaagtaggagttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggccagaccaagagggagctcaaaagctttgatatctctcagtgccccaagattggagggcatggtagtaagaagtgcactggggacgcagcattttgctctgcttatgaatgcactgctcagtatgccaatgccttttgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgaacctcatggattggttgtccgatcaacagggttcaagatatcatctgcagttgcttgtgctagcggagtttgcgtcacagggtcgcagagtccttctactgagattacactcaagtatccagggatatcccagtcctctgggggggacataggggttcacatggcacatgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccattaatgtggattacagccttcatcagatgggtgtataagaagatggttgctagagtggcggacaatattaatcaagtgaacagggaaataggatggatggaaggaggtcagttggttctaggggaccctgcccctattcctcgtcatgccccaatcccacgttatagcacatacctaatgctgctattgattatctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggagtcaaggaagatcaaaccaagttcttaaagataaaaactgtctctagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatgggggtgtggatgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggtaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgaaaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgttattcctgcaatgcaggggccagagtctgcctgtctatcacatccacaggaactggaactctctctgcccacaataaggacgggtctctgcatatagttctcccatcagagaatgggacaaaagatcagtgtcagatactacatttcactgtgcctgaagtagaagaggagtttatgtactcttgtgatggagatgagcggcctctgttagtgaaagggaccctgatagctattgacccatttgatgataggcgggaagcagggggggaatcaacagttgtgaatccaaaatctggatcttggaatttctttgactggttttctggacttatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4410 - RNA, 3594 nt, synthetic construct
  misc_feature 1..3594: note = derived and/or modified CDS sequence (wt) from RVFV(KEN/Mal-032/07)__HM586967.1__GP
  source 1..3594: mol_type = other RNA
atgtatgttttattgacaattctaatctcggttctggtgtgtgaagcggttattagagtgtctctaagctccacaagagaggaaacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggagacttcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctgatggtaataaatgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4411 - RNA, 3594 nt, synthetic construct
  misc_feature 1..3594: note = derived and/or modified CDS sequence (wt) from RVFV(KEN/Gar-008/06)__HM586965.1__GP
  source 1..3594: mol_type = other RNA
atgtatgttttattgacaattctaatctcggttctggtgtgtgaagcggttattagagtgtctctaagctccacaagagaggaaacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaagggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataatttgaaggtggactttgtgggagcagccgtgtcttgtgatgccgccttcttgaatttgacaggttgctattcttgcaatgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtaaaagaggagttcatgtactcttgtgatggagatgagcgggctctgttaatgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4412 - RNA, 3594 nt, synthetic construct
  misc_feature 1..3594: note = derived and/or modified CDS sequence (wt) from RVFV(Kenya 56 (IB8))__DQ380190.1__GP
  source 1..3594: mol_type = other RNA
atgtatgttttactaacaattctgatcacggttctggtgtgtgaagcggttatcagagtgtctctaagttccacaagagaagagacctgctttggtgactccaccagcccagagatgattgaaggagcttgggattcactcagagaggaggagatgccagaagagctctcctgttccatatcaggcataagggaggttaaaacctcaagccaggaattatatagggcattaaaagccatcattgctgctgatggcttgaacaacatcacctgccatggtaaggatcctgaggataagatttctctcataaagggtcctcctcacaaaaagcaggtggggatagttcggtgtgagagacgaagagacgctaagcaaataggaagagaaaccatggcagggattgcaatgacagtccttccagccttagcagtttttgctttggcacctgttgtttttgctgaagaccctcatctcagaaacagaccagggaaggggcacaactacattgacgggatgactcagggggatgccacatgcaaacctgtgacatatgctggggcttgtagcagttttgatgtcttgctcgaaaagggaaaattccccctcttccagtcgtatgcccatcacagaaccctactagaagcagttcacgacaccatcattgcaaaggctgatccacctagctgtgaccttcagagtgctcatgggaatccttgcatgaaggagaaactcgtgatgaagacacactgtccaaaagactaccagtcagctcattacctcaacaatgacgggaaaatggcttcagtcaagtgccctcctaaatatgagctcactgaggactgcaatttttgcaggcagatgacaggtgccagcttgaagaaggggtcttatcctcttcaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtatttaagaactcaaagaaggtttatcttgataagcttgacctcaagactgaggaaaatctgttgccagactcatttgtctgcttcgagcataagggacagtataaaggaacaatggactctggtcagaccaagagggagctaaaaagctttgatatctctcagtgccccaagattggaggacatggtagcaagaagtgcactggggacgcagctttttgctctgcttatgagtgcactgctcaatacgccaatgcttattgttcacatgctaatgggtcaggaattgtacagatacaagtatccggggtctggaagaggcctttgtgtgtagggtatgagagggtggttgtgaagagagaactctctgctaagcccatccagagagttgagccttgcacaacttgtataaccaaatgtgagcctcatggattggttgtccgatcaacaggtttcaagatatcatctgcagttgcttgtgctagcggagtttgcgttacaggatcgcagagcccttctaccgagattacactcaagtatccagggatgtcccagtcctctgggggggacataggggttcatatggcacatgatgatcagtcagttagctccaaaatagtagctcactgccctccccaggatccatgcctagtgcatggctgcatagtgtgtgctcatggcctgataaattaccagtgtcacactgctctcagtgcctttgttgttgtgttcgtatttagctctgtcgcaataatttgtttggccattctttataaagttctcaagtgcctaaagattgccccaaggaaagttctgaatccactaatgtggattactgctttcatcagatgggtgtataagaagatggttgccagagtggcagacaatatcaatcaggtgaacagggaaataggatggatggaaggaggccagccggctctagggaaccctgcccctattcctcgtcatgctccaattccacgttatagcacatacctaatgctactattgattgtctcatatgcatcagcatgttcagaactgattcaggcaagctccagaatcaccacttgctccacagaaggtgtcaacaccaagtgtaggctgtctggcacagcattaatcagggcagggtcagttggggcagaggcttgtttgatgttaaagggggtcaaggaagaccaaaccaagtttttgaagataaaaactgtctcaagtgagctatcgtgcagagagggccagagctattggactgggtcctttagccctaaatgtctgagctcaaggaggtgccatcttgtcggggaatgtcatgtgaataggtgtctgtcttggagagacaatgaaacttcagcagaattttcatttgttggggaaagcacgaccatgcgggagaataagtgttttgagcagtgtggaggatggggatgtgggtgtttcaatgtgaacccatcttgcttatttgtgcacacgtatctgcagtcagtcagaaaagaggcccttagagttttcaactgtatcgattgggtgcataaactcactctagagattactgactttgatggctctgtttcaacaatagacctgggagcatcatctagccgtttcacaaactggggttcagttagcctctcactggacgcagagggcatttcaggctcaaacagcttttctttcattgagagcccaggcaaagggtatgcaattgttgatgagccattctcagaaattcctcggcaagggttcttgggggagatcaggtgcaattcagaatcttcagtcctgagtgctcatgaatcatgccttagggcaccaaaccttatttcatacaagcccatgatagatcagttggagtgcacaacaaatctgattgatccctttgttgcctttgagaggggctctctgccacagacaaggaatgacaaaacctttgcagcttcaaaaggaaataggggtgttcaagctttctctaagggctctgtacaggctgatctaacactgatgtttgacaattttgaggtggactttgtgggagcagccgtgtcttgtgatgccgccttcttaaatttgacaggttgctattcctgcaatgcaggggccagagtctgcctgtctatcacatccacaggaactggaactctctctgcccacaataaagatgggtctctgcatatagttcttccatcagagaatggaacaaaagatcagtgtcagatactacacttcactgtacctgaggtagaggaggagtttatgtactcttgtgatggagatgagcggcctctgttggtgaagggaaccctgatagctattgatccatttgatgataggcgagaagcagggggggaatcaacagttgtgaatccaaaatctggatcttggaatttctttgactggttttctggactcatgagttggtttggagggcctcttaagactatactcctcatttgcctgtatgtagcattatcaattgggctctttttcctccttatatatcttggaagaacaggcctctctaaaatgtggcttgctgccaccaagaaagcctcatag

SEQ ID NO: 4413 - RNA, 3594 nt, synthetic construct
  misc_feature 1..3594: note = derived and/or modified CDS sequence (wt) from RVFV(KEN/Bar-035/07)__HM586969.1__GP
  source 1..3594: mol_type = other RNA
atgtatgttttattgacaattctaatctcggttctggtgtgtgaagcggttattagagtgtctctaagctccacaagagaggaaacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggagacttcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctgacggtaataaatgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcacggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggataatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaacgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4414 - RNA, 3594 nt, synthetic construct
  misc_feature 1..3594: note = derived and/or modified CDS sequence (wt) from RVFV(TAN/Dod-002/07)__HM586971.1__GP
  source 1..3594: mol_type = other RNA
atgtatgttttattgacaattctaatctcggttctggtgtgtgaagcggttattagagtgtctctaagctccacaagagaggaaacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggtccaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtaggaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcaggcctggataatctctcagtggcacacggctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaacgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4415 - RNA, 3594 nt, synthetic construct
  misc_feature 1..3594: note = derived and/or modified CDS sequence (wt) from RVFV(Beijing-01)__KX611606.1__GP
  source 1..3594: mol_type = other RNA
atgtatgttttattaacaattctaatctcggttctggtgtttgaggtggttattagagtgtctctaagctccacaagagaggaaacctgttttggtgactccaccaacccagagatgattgaaggagcttgggattcactcagagaggaggagatgccagaagagctctcctgttccatatctggcataagggaggtcaagacctcaagccaggaattatacagggcattaaaagccatcattgctgctgatggcttgaacaacatcacctgccatggtaaggatcctgaggacaaaatttctctcataaagggtcctcctcacaagaagcgggtggggatagttcggtgtgagagacgaagggacgctaagcaaatagggagagaaaccatggcagggattgcaatgacagttcttcccgccttagcagtttttgctttggcacctgttgtttttgctgaggaccctcatctcagaaacagaccagggaagggacataactacattgacggggtgactcaggaggatgccacatgcaaacctgtgacatatgctggggcatgtagcagttttgatgttttgctcgaaaagggaaaattccccctcttccagtcatatgctcatcatagaactctactagaggcagttcacgacaccatcattgcaaaggctgatccacctagctgtgatctccagagtgctcatgggaatccctgcatgaaagagaaactcgtgatgaagacacactgtccaaatgactaccagtcagctcattacctcaacaatgacgggaaaatggcttcagtcaagtgccctcctaagtatgagcttactgaggactgcaacttttgtaggcagatgacaggtgctagcttgaagaaggggtcttatcctctccaggacttattttgtcagtcaagtgaggatgatggatcaaaactaaagacaaaaatgaaaggggtctgcgaagtgggggttcaagcactcaaaaagtgtgatggccgactcagcactgcacatgaggttgtgccctttgcagtgtttaagaattcaaagaaggtttatcttgacaagcttgaccttaagactgaagaaaatctgctaccagactcatttgtctgctttgagcataagggacagtataaaggaacaatggactctggtcagactaagagggagctcaaaagctttgatatctctcagtgccccaagattgggggacatggtagcaagaagtgcactggggacgcagcattttgctctgcttatgagtgtactgctcaatatgccaatgcctattgttcacatgctaatgggtctgggattgtacagatacaagtatccggggtctggaagaagcctttatgtgtggggtatgagagagtggttgtgaagagagaactctctgccaagcccatccagagagttgagccttgcacaacttgcataaccaaatgtgagcctcatggattggttgtccgatcaacagggttcaagatatcatctgcagttgcttgtgccagcggagtttgcgtcacaggatcgcagagcccttctactgagatcactctcaagtatccagggatatcccagtcctctgggggggatataggggttcacatggcacatgatgatcagtcagttagctccaaaatagtctttgactgccctccccaggacccgtgcctagtgcatggctgcatagtgtgtgctcatggcttgataaattaccagtgtcacactgctcttagtgcttttgttgttgtgttcgtattcagctctgttgcaataatttgtctggccattctttataaggtgctcaggtgcctaaagattgccccaaagaaagttctgaatccactaatgtggatcactgccttcatcagatgggtgtataagaagatggttgccagagtggcagacaatatcaatcaagtgaacagagaaataggatggatggaaggaggccagttggctctagggaaccctgctcccattcctcgtcatgctccgattccacgttatagcacatacctaatgctactattgattatctcatatgcatcagcatgttcagaactgattcaggcaagctccagaatcaccacttgctccacagaaggtgtcaacaccaagtgtaggctgtctggcacagcattaatcagggcagggtcagttggggcagaggcttgtttgatgtttgagggggtcaaggaagaccagaccaagttcttaaagataaaaactgtctcaagtgagctatcgtgcagggagggccagagctattggactgggtcctttagccccaaatgtctgagctcaaggagatgccatcttgtcggagaatgtcatgtgaataggtgtctgtcttggagggacaatgaaacttcagcagaattttcatttgttggggaaagcacgaccatgcgagagaataagtgttttgagcagtgtggaggatggggatgtggatgtttcaatgtgaacccatcttgcttatttgtgcacacgtatctgcaatcagttagaaaagaggctcttagagtttttaactgtattgattgggtgcataaactcactctagagatcacagactttgatggctctgtttcaacaatagacttgggagcatcatctagccgtttcacaaactggggctcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagaatcttctgtcctgagtgctcatgagtcatgccttagggcaccaaaccttatctcatacaaacccatgatagatcagttggagtgcacaacaaatctgattgatccctttgttgtctttgagaggggatctctgccacagacaaggaatgacaaaacctttgcagcttcaaaaggaaataggggtgttcaagctttctctaaaggctctgtacaggctgatctaactctgatgtttgacaattttgaggtggactttgtgggagcagccgtgtcttgtgatgccgccttcttaaatttgacaggttgctattcctgcaatgctggagccagagtctgcctgtctatcacatccacaggaactggaactctttctgcccacaataaggatgggtctctgcatatagttcttccatcagagaatggaacaaaagatcagtgtcagatactacacttcactgtacctgaggtggaggaggagttcatgtactcttgtgatggagatgagcgacctttgttggtgaaggggaccctaatagctattgatccatttgatgataggcgagaagcagggggagaatcaacagttgtgaatccaaaatctggatcttggaacttctttgactggttttctggacttatgagttggtttggaggacctcttaagactatactcctaatttgcctgtatgtagcattatcaattgggctctttttccttcttatatatcttggaagaacaggtctctctaaaatgtggcttgctgccactaagaaagcctcatag

SEQ ID NO: 4416 - RNA, 3594 nt, synthetic construct
  misc_feature 1..3594: note = derived and/or modified CDS sequence (wt) from RVFV(Smithburn)__DQ380193.1__GP
  source 1..3594: mol_type = other RNA
atgtatgttttactaacaattctaatctcggttctggtgtgtgaagcggtcattagagtgtctctaagctccacaagagaagaaacctgttttggtgactccaccaacccagagatgattgaaggagcttgggattcactcagagaggaggagatgccagaggagctctcctgttccatatcaggcataagggaggttaagacctcaagccaggaattatacagggcattaaaagccaccattgctgctgatggcttgaacaacatcacctgccatggtaaggatcctgaggacaagatttctctcataaagggtcctcctcacaaaaagcgggtgggggtagttcggtgtgagagacaaagagacgctaagcaaatagggagaggaaccatggcagggattgcaatgacagtctttccagccttagtagtttttgctttggcacctgttgtttttgctgaagaccctcatctcagaaacagaccagggaagggacacaactacattgacgggatgactcaggaggatgccacatgtaaacctgtgacatatgctggggcatgtagcagttttgatgtcttgctcgaaaagggaaaatttcccctcttccagtcgtatgctcatcatagaactctattagaggcagttcacgacatcatcattgcaaaggctgatccacctagctgtaaccttcagagtgctcatgggaatccctgcatgaaagagaaactcgtaatgaagacatactgtccaaatgactaccagtcagctcattacctcaacaatgacgggaaaatggcttcagtcaagtgccctcctaagcatgagctcactgaggactgcaacttttgtaggcagatgacaggtgctagcttgaaggaggggtcttatcctctccaagacttattttgtcagtcaagtgaggatgatggatcaaaattaaaaacaaaaatgaaaggggtctgcgaagtgggggttcaagtactcaaaaagtgtgatggccaactcagcactgcacatgaagttgtgccctttgcagtgtttaagaactcaaagaaggtttatcttgacaagcttgacctcaagactgaggaaaatctgctaccagactcatttgtctgcttcgagcataagggacagtacaaaggaacaatggactctggtcagattaagagggagctcaaaagctttgatatctctcagtgccccaagattggaggacatggtagcaagaagtgcactggggacgcagcattttgctctgcttatgagtgtactgctcaatacgccaatgcctattgttcacatgctaatgggtcaggaattgtacagatacaagtatccggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagcccttctactgagattacactcaagtatccagggatatcccagtcctctgggggagacataggggttcacatggcacatgatgatcagtcagttagctccaaaatagtggcccactgccccccccaggacccgtgcctagtgcatggctgcatagtgtgtgctcatggcttgataaattaccagtgtcacactgctttcagtgcctttgttgttgtgttcgtattcagctctgttgtgataatttgtttggccattctttataaggtgctcaagtgcctaaagattgccccaaggaaagttctgaatccactaatgtggatcactgccttcatcagatgggtgtataagaagatggttgccagagtggcagacaatattaatcaagtaaacagggaaataggatggatggaaggaggccagttggttctagggaaccctgcccctattcctcgtcatgctccaattccacgttatagcacatacctaatgctgctattgattgtctcatatgcatcagcatgttcagaactaattcaggcaagctccagaatcaccacttgctccacagaaggtgtcaacaccaagtgcaggctgtctggcacagcattaatcagggcagggtcagttggggcagaggcttgtttgatgttaaagggggtcaaggaagaccagaccaagttcttgaagataaaaactgtctcaagtgagctatcatgtagggagggccagagctattggactgggtcctttagccccaaatgtctgagctcaaggagatgccatcttgtcggagaatgtcatgtgaataggtgtctgtcttggagggacaatgaaacttcagcagaattttcatttgttggggaaagcacgaccatgcgagagaataagtgttttgaacagtgtggaggatggggatgtgggtgtttcaatgtgaacccatcttgcttatttgtgcacacgtatctgcagtcagttagaaaagaagcccttagagtttttaactgtattgattgggtgcataaactgactctagagattacagactttgatggctctgtttcaacagtagacttgggagcatcatctagccgtttcacaaactggggttcagtcagcctctcactggacgcagagggcatttcaggctcaaatagcttctctttcattgagagcccaggcaaagggtatgcaattgttgatgagccattctcagaaattcctcggcaagggttcttgggagagatcaggtgcaattcagaatcttcagtcctgagtgctcatgaatcatgccttagggcaccaaaccttatctcatacaaacccatgatagatcagttggagtgcacaacaaatctgattgatccctttgttgtctttgagaggggttctctgcctcagacaaggaatgacaaaacctttgcagcttcaaaaggaaataggggtgttcaagctttctctaagggctctgtacaagctgatctaactctgatgtttgacaattttgaggtggactttgtgggagcagccgtgtcttgtgatgccgccttcttaaacttgacaggttgctattcctgcaatgcaggggccagagtctgcctgtctatcacatccacaggaactggaactctttctgcccacaataaggatgggtctctgcatatagttcttccatcagagaatggaacaaaagatcagtgtcagatactacacttcactgtacctgaggtagaggaggagtttatgtactcttgtgatggagatgagcggcctctgttggtgaaggggaccctgatagctattgatccatttgatgataggcgagaagcagggggggaatcaacagttgtgaatccaaaatctggatcttggaatttctttgactggttttctggacttatgagttggtttggagggcctcttaagactatactcctaatttgcctgtatgtagcattatcaattgggctttttttctttcttatatatcttggaagaacaggtctctctaaaatgtggcttgctgccactaagaaagcttcatag

SEQ ID NO: 4417 - RNA, 3594 nt, synthetic construct
  misc_feature 1..3594: note = derived and/or modified CDS sequence (wt) from RVFV(KEN/Bar-032/07)__HM586968.1__GP
  source 1..3594: mol_type = other RNA
atgtatgttttattgacaattctaatctcggttctggtgtgtgaagcggttattagagtgtctctaagctccacaagagaggaaacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggagacttcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgacccacctagctgtgaccttcagagtgctgatggtaataaatgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaaatgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgtgggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctcacacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgaggtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4418 - RNA, 3594 nt, synthetic construct
  misc_feature 1..3594: note = derived and/or modified CDS sequence (wt) from RVFV(KEN/Gar-004/06)__HM586964.1__GP
  source 1..3594: mol_type = other RNA
atgtatgttttattgacaattctaatctcggtttgggtgtgtgaagcggttattagagtgtctctaagctccacaagagaggaaacctgttttggtgactccaccaacccagagatgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacggaatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcacagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtaggaagaagagaactggggacgcagcattttgctctgcttatgaatgcactgctcagtatgccaatgcctattgttcacgtgccaacgggtcagggattgtgcagattcaagtatcaagggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaataaccagtcacactctgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggataatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagattacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgaggtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4419 - RNA, 3621 nt, synthetic construct
  misc_feature 1..3621: note = derived and/or modified CDS sequence (wt) from RVFV(RVFV)__M11157.1__GP
  source 1..3621: mol_type = other RNA
atgtatgttttattaacaattctaatctcggttctggtgtgtgaagcggttattagagtgtctctaagctccacaagagaagagacctgctttggtgactccactaacccagagatgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgggctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcacacaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgtttagtgcatggctgcatagtgtgtgctcatggcctgataaattaccagtgtcacactgctctcagtgcctttgttgttgtgtttgtattcagttctattgcaataatttgtttagctgttctttatagggtgcttaagtgcctgaagattgccccaaggaaagttctgaatccactaatgtggatcacagccttcatcagatggatatataagaagatggttgccagagtggcacacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtccattagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatctcaggctcaaatagcttttctttcattgagagcccaagcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgataaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaactatactcctcatttgcctgtatgttgcattatcaattgggctctttttcctccttatatatcttggaagaacaggcctctctaaaatgtggcttgctgccactaagaaggcctcatagatcagtacgtgtaaaagtaatatgttga

SEQ ID NO: 4420 - RNA, 3480 nt, synthetic construct
  misc_feature 1..3480: note = derived and/or modified CDS sequence (wt) from RVFV(ZH-548)__DQ380206.1__NSm-Gn-Gc
  source 1..3480: mol_type = other RNA
atgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 4421 - RNA, 3480 nt, synthetic construct
  misc_feature 1..3480: note = derived and/or modified CDS sequence (wt) from RVFV(ZS-6365)__DQ380205.1__NSm-Gn-Gc
  source 1..3480: mol_type = other RNA
atgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaagaagatcaaaccaagttcttaaagataaaaactgtctcaagtgagctatcatgcagggagggccagagttattggactgggtcctttagtcctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgtccaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctcttttttctccttatatatcttggaagaacaggcctctctaaaatgtggcttgctgccactaagaaggcctcatag

SEQ ID NO: 4422 - RNA, 3480 nt, synthetic construct
  misc_feature 1..3480: note = derived and/or modified CDS sequence (wt) from RVFV(MP-12)__DQ380208.1__NSm-Gn-Gc
  source 1..3480: mol_type = other RNA
atgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcatcacctcaacaatgacgggaaaatggcttcagtcaagtgccctcctaagtatgagctcactgaagactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagttaaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaggaacaggcctctctaaaatgtggcttgctgccactaagaaggcctcatag

SEQ ID NO: 4423 - RNA, 3480 nt, synthetic construct
  misc_feature 1..3480: note = derived and/or modified CDS sequence (wt) from RVFV(T1)__DQ380201.1__NSm-Gn-Gc
  source 1..3480: mol_type = other RNA
atgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctgttctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatctcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgataaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 4424 - RNA, 3480 nt, synthetic construct
  misc_feature 1..3480: note = derived and/or modified CDS sequence (wt) from RVFV(1853/78)__DQ380220.1__NSm-Gn-Gc
  source 1..3480: mol_type = other RNA
atgattgaaggagcttgggattcactcagagaggaggagatgccagaggagctctcctgttccatatcaggcataagggaggttaagacctcaagccaggagttatacagggcattaaaagccatcattgctgctgatggcttgaacaacatcacctgccatggtaaggatcctgaggacaagatttctctcataaagggtcctcctcataaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgacccaggaggatgccacatgcaaacctgtgacatatgctggggcatgtagcagttttgatgtcttgcttgagaaggggaaatttccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcactgaagactgcaacttttgtagacagatgacaggtgctagcctaaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttacctcgataagcttgacctcaagactgaggagaatctgctaccagactcatttgtctgcttcgagcataagggacagtataaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcaggggttgtgcagatacaagtgtcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagtccttctaccgagattacactcaagtatccagggatatcccagtcctctgggggggacataggggttcacatggcacacgatgatcagtcagttagctccaaaatagtagctcactgccctccccaggacccgtgcttagtgcacggctgcatagtgtgtgctcatggcctgataaattaccagtgtcacactgctctcagtgcctttgttgttgtgtttgtgttcagttctattgcaataatttgtttagctattctttatagggtgctcaaatgcttaaagattgccccaaggaaagttctgaatccactaatgtggattacagccttcatcagatgggtgtataagaagatggttgccagagtggcagacaatattaatcaagtgaacagggagataggatggatggaaggaggtcagttggttctaggaaaccctgcccctattcctcgtcatgccccaattccacgttatagcacatacctaatgctactactaattgtctcatatgcatcagcatgttcagaactgattcaggcaagctccagaatcactacttgctccacagagggtgtcaacaccaagtgtagactgtctggcacagcattgatcagggcagggtcagttggggcagaggcttgtttgatgttgaagggggtcaaggaagatcaaaccaagttcctaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggggaaagtacgaccatgcgagagaataagtgttttgagcagtgtggaggatggggatgtggatgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtatttgagaggggttctctgccacagacaaggaatgacaaaacctttgcagcttcaaaaggaaatagaggtgttcaagctttctctaagggctctgtgcaagctgatctaactctgatgtttgacaattttgaggtggactttgtgggagcagctgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcagtgccagatactacacttcactgtacctgaagtagaggaggagtttatgtactcttgtgatggagatgagcggcctctgttggtgaaggggaccctgatagctattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctcctcatatatcttggaagaacaggcctctctaaaatgtggcttgctgctactaagaaggcctcatag
